United States Patent 11,549,145 (METHODS AND COMPOSITIONS FOR INHIBITING AND TREATING NEUROLOGICAL CONDITIONS) - sequence listing, part 115

SEQ ID NO: 2057 - DNA, 960057 bp, Homo sapiens
tcacttcagaaagaaacaaggtttatttgatgaatataaataaggcgatcagcacaaagtacttctcatacacatgacaacaaatttatgaactgtacataccttgtacattgttctactagacacgaggttacaatgactggctaatacatgcccactggtagtttccagggttccttagttttatttatttatttttcatatcgatgtccataatcacatggtcaatatcacaacccacatgccactcacttgaagaaatattacaagaagcactatcaaacgagggtctcggggaattagatacactgaccctgggcagcattcaatcgccactctacacaaaaacattgcagatagagcttacgtcaacacatctgaggtctcgtcataaacactgtttaaaaagtaaattgaaacccactttcaaatgaaagttgacacgctgttaacgtgcatactggatacacaaaaatcattaaatacaaaattgagactgtacatcgaaatcaaatggggtataaagcacaagcctgcttttgcacaaagtaagaccaacttctcctaaatgttagcccaaacttcttttttcaactatgttatgattagaagaaaacctgttaaagtttgcgcaaaggaaatagcttcccaacatcacagtgtttgttgtaaacccagagactattcttaatatgtgaaaaagggatatttttggtaacccccaaacatcagagaatattacacgaaatgggaaaggttgttatgttagagagaatttaatttttaagggactaaattatacgacctcataaaggtaagatcagtaatattttaaccaatgaaagttgggcagaaaatgatccctccaaacaagagctgtgacaaaattggcacatacatagaaatagctagctatacatgggttggttttttttttctgtttcaaggaccctattttccctactggatttcctacttcctacttcaagtattcagttgcagagttcaggtcaagacctggttgtaggaggcagtgagaaccacttctttgaggacatccaaactgttcactgggacacatttgtggcctgggttttcagtgcaacattgtgtcaaaatgtgctaaataagcttgcaaagaactctgcttacttctctaaccaagacctagatccctctgatagttaaaggacaaacttttaaaacatgaatgcatttggattgtttatgcaacacataagcattacatagtttgttatacttactgatgacaagaacaaagccagaagcaagaaacctgcttgagtatcttaaccgcgaatgcaccaagaaagaatggtgcaactcagggacggtttcatcttccccgacaaataaggtgtttgtcttttaaatatctctatggctcacaagagaggtccagagttaattgcaccaacattttaaaaagtaataataatgactaaattcaatgcaagacttcagggacatctgtttagaatcctttccacagcagcaaagaaagacaactatatttattaaggccactcatgcttaaattcactgtttgtcctttaaaaatgcaggttttcatctcccacttgcatacacgtggaagggtttcttccattgacaagaaaatggagcaatacaagagttgcacatgtttgccagactcagtcatgagttttatgaagttataacaatttaaattgtttcttaatattcagaggaagcagtaggagtttaattctccttagtaccatatcactgtatgtaaaagacctcaaaatttggtctttttccctggcatgtgctttaaataatgactgtatccacatacatgttgtgtagagctatatacagagacacagcttttgtgattgttcctcattcatcaatgttttcatgtttgatgctgaaaatgctttggaatccatgttgcagacacattttctttaaaaaaaaaaaaaaagagaaatgacccttcatttacagaaaatctaagcttacactgtttgcacagcatttggatcttgaaatgtgaatgagtcccagcttcttcatggagacctgcatgcaccgggatggtaagagtctgaggcttggtggcgtccccaccgtggggatgtgcagaacacagggactagagatatgcaggtgcctcagacttttgccactctccagtacatgactgggtagataaaattatgaatgatcaatttagatgtgccacgcattgtcagagacacacaccatgttctcataaggcgatttcttggcaagcattagtggtttaaaaaattgatttcttttccaacctggcccagaggtgactactggttacaccctcaaaatgcggttcttcaaacaacagattaaagaaatagaggagggtaaaggctcgcaatttttggtgttttttgtttcttcgtcaaacactccatgcatcatggtatacaaacactgccaacaccactcactcacagcgaatttatactttttgataatctaatgcattaggaatgaccaattagagtgaaccagcaggatactggagatgaggctagttgtccaacagaagctgaatccacagataaaatcccatggagttcaaatttatccaatgatgtttaagtaacataaacaaaatgttatcaaataatgacattcagcaaagatgatcacattcaaaatgcccgcatcccaacaaaaatggaggatctgtcacttttctcctcctctgcattcttcctttccatcataaccaaatccatgagaaatgacatgaggtggtgaaggaaatatcaagtagaacagaatcacgctcaataaggtaagtgaaaactccccttcagttctgatgagccgctccaggtggtggtggacagtgatgtgagccgcactgcaatacattatcagaatattgctgcagagctgcatgttccctttattcagcccttctaatagctgcaacaagaaagcacataatttagcaggggaagaaactggcaacaatatctgagataatcctggcagaacgtttcccactcttcacccctacaacagcctctccaccactctcaatggttggggttgggtgggagtggggagggggtaaggggaagaaacacagaggaaggacaaaggaaacagaaagataaactacgtcctgcaagtgcatctgagaagaggcctctttcaaaatatgtcacgtatatgtataaatgtctcttgatatacaaaaaaggaaattgaagggaaatatgccaaaatgttccagtgattatttccacataatcggactatatgtcaacttttattctctctacgcttttctacaatgatgatgtttttaaaattattttttaacttgattttatggagattaaagaattaaaggtggttaagatatcagagaacttagcatgcacttaaaaaccaaccaaacataaatgtgacagtcatccatttgtctatttactgccctggggaacaggtatccagaagcaccccaaggtttctcactgtcccagtgaggggcccagagtgtggatacaactgcatcctgggaagcaatagtgcaatgagtgagaagggggatccctcccacactactgcttcagatgaggactttcttccctgctgatgctcaactttgtgtgcctgtgccattatcattcacatatggcctgtgagtgcttctgggtttccagccacatgagctcagctatctgggaaatatggcagggagaggaaagatcaaacatacacacacacactcgtgtacacacaagtcaccttgtatatatatcctgagctgtctcatttggtggttgatatgcagcatttttcgagtcacgccgactaacaagaatgccaaagatcccagtgtctgcacaggtagccagctatttcaagccatcgttaagtagtgcaaatgaaatatgtggcttggatgaactctgctaattcatactctgaggactttggtgtaacccttctggttaagaaacttgaatcggggcaaaaaaatgacttttgcagagccagaaagttagggagttcctagagcagatcatattactcattctggcacataaactctctgcaaactttgtatgaaaattgtaagtcagagcacgctttctgtttcatgagctgtgcatagctctaattcttttgtgcattaagcatttcttaatcatccttttaaagggctgaccaatatattaaaaggccacatgattaaaaggtaaagagaaaccctaagtagtattaaaatgcaccagtcttttgttttgttttgttttacagatgaaaaataattacagtgaatgtctgatgtccttgatgtttttccaagataaagtagcaaagaacagtcatttattcagttgtgagaaagatttccagctgggcagcaggtcacaaggcagaatacaatgccccacaattgcagcaaactgcttttgggtaaggtttatgctggagacaagagaattctcaaaaagtgtagccattctttcaatcgaacaatccattcaccaggaggcctaaatggctttaaggaaaaaaagaaaaacaacaaggaaacctcaagtgacaccgccagcatttagaaatgcagatgatcccttctgggggggcaaagaagcatatgctttaaaaataaaaataaaaaacgaatcctggcttccagcaatgagccaatctgggctgccacccactgtgagatgatccctggccagtcctccctcacctggacagtcacagcggcccttacccttctccagcttcctcttacagcacccaactctgcgctttcaacgcagcagccaacaacagcgccatttcaatggtgacatccagtccatagtgcattcccgtttacagtttacaactcctgtttacaaccctgtttataatcccgttgccctgagaatgcaggactgatggactcctggccatactggcgaggccccatctggcctctctctctgcagtcctgtacttaacgctgacattccactctttatgttccaccaaagctgagcttgcttctgcagccctaaaaatttattttctccccctctcacaagcgtgtctctctatctaacatgatttacaccagctctttatctgatcgatccctgtttattcctcagtttcagcttggatgtcatgtcttcccaagaagcctttcttgaccctctcggatgtgatatagagtgggaagtctcacatatactgcagagtccccttctgatgaattgtctagacttgtacatccaatagagcgtgtgtgcatgtatgtatatatatatatacatatcttttattttaaggcagggtcttgctgtgtcacccaggctggagtgcagtggtgtgatcatggctcacagcagcctcgacctcctggaatcaagcaatcctcctagctcagcccctcaaggagctaggactacaggcacatgccaccatgtctggctaatttttgtatttttttacagagatgtgttctcactatgttgcccaggctcgtctcaaactcttgggctcaagtgatccacctgcctcaggctcccaaagtgctgggattacaggaatgagccactaaacccagcctaccagtttagagagtacctcaggtaggcagaatccttaaatctactccttatccaagattccctatccgaatccctggcacagggagtgagaacgtttcagaccacgtttactataaagttaccttacagatgtagttactaatcagttgacttcaaattagtctaaagggagattatcaactaagcgaggtggcacatgcctgtaatcctagcactttgtgaggctgaggtgggtggatattttgagcccagaaattggagaccaacctgggcaacatggcaaaaacccgtctccacaaaaaaagttaaaaattagctgggtgtggtggatgcccctttggtaccagctatttgagaagctgaggtgggaggatcaactgaactggggaggtcgaggctgcagtaagccgtgattgtgccactccagcctgccaatccagtaagctgggattgtgccactccagccgtgattgtgccactccagacaagagtaagaccttgtctaaaataaaaaataaaattttttaaaaaagggtggatctgagtggacctaatttaatgacagacgccctttaatagcagagacttttatttgctgtagcagaagagaaagttagggaaatctgaaaccagagggattggctgtgctgtgatggagggagccaggggcaaggacctgagagcttcctataggatgtgagaatgtcacccaggtgactgtcagcaagggaacagggaccacagacctacaaccacgaggaaatgaattctgccaaaaacccgaaggagcttgaaggtggatgcttcctggagccttcagattaaagtccagctaagtccaccttgactttggctttatgagatcctaagcagagaacccagttgagcccatctggacttctgacctatgcacaaaactgtaagctaataaatgggtgctattttcaccaccatatttatggtaatttgctatgtagccaaagaagactaatgcagcaccacgctgggtcaggcagtgtgcttgatgccaggaatataatagtgagaaaaacagacaaggtccatgctttcatggagcctgtattcttgggaggaagacagaaacaaatagacacacagatcaataaatgaatgagaatgtaaacatttgcaccatgaagaaaaggaacggggaactgtgatagggatgcctaagatttattaagtgactgatgacaattatgacgtcaatctttattttcttttgataggaaaagatgtccgtccacaacttttcagtggaaaaagcagattaccattttatatgcatagcttcatctcatttttgcatcaacatgcacataaacaaacatttgcaagtgtatacattagaatattattaatatttatctctgggtggtggttttaaacttttcccctgtatttaatttttatttatttatttattttgagatggagtctctctctgttgtccaggctggagtgcagtggcgcaatctcggctcactgcaacctctgtctccctggttcaagcgattctcctgcctcagcctcccaagtagctgggactacgggcatgagccatggtgcccagccgttaaaattttctccttcagactttttttttttttgctctttttggatttttttaaacctaagaatgtataaatagtatcatactaaaatataaagctattttctttgtggggagaaaccagtattgggtgggactgctgctcttgacttggttctaggtgggggtgtgtgaggggcggggtgggtgactgagcacagcagtaagattccgccccaggacagacgccccagggagagcaggctataaacgtgtggtgtctcacaaatattccttcagactgtttttctttggaataaagacacctgcccgattatggctttcttctcctgccctttcagtagtgatttgcagaaacaggctgggagaaaggggtctttggtaaacacggaggggttaaaggggaaactgtttaataacagtagtaaaacgcaggctatttttgacatctgggttaatgtccattatgttccatgtgctttccaaatgtgtgcagtgtgcccccaggtacaaaaacagacacccattcacgacggcttcagatgcccctaacacgctgcacgtggtgcccacataaaaggcaagcccctgatagactaattaacaacggttggaggagaagagctgctccttctgggggcagcgggcatcctgcagaacagctccatgaagccactctgctcacaggaaaacccaatagagtcgtttctgctaaaaaaaaaaaaacaaacaaaaaaccaaaactataactacatctgtgttattacttaacatctttaaaaacggggtggaatgggtttcccgttttcctcatgaagatttatttattattgttgtgatcaaagtggcaacaaattatgttaaatcatttaattttcttgatagaagcaaccaccttgaaaccataattcaaaaaatatgagtggagagcaacattttaccttgagagtggactcctacagctccacggggcaataaaatgtaacacttcagaacccaaagggctgggggctgggatgggggtggggcggggccagccctgtgctcagaattgcacactgctgttagggatgacggagtttgctgggaggaggcagtggagggacttggtatttcaactttggtttctgtgcacggggtataactcatccataacgttttaaatgaagggattcaaatgaatataggctgtgtacatcaaaatggcagcacagactgctatgtctccgtaggatttatttttgtcattattattgtggtcagaattattaacaggtaccatttgttgcgtgctatctgccaccaccctctgtgttttgcattaattatctgaaaccagctcgatagcactgaggtactgatgcagttggttaatagcccctcatgcagatgaggaaacgaaagcttagaagaactggatgcttttggtaaaattccccagctccctggggcctcatttgaatccaggtcttttggactccagcgaccattctctccagagaccactgcctccttgaggcaagcatttcctaaacctgtcttttgtgtcctacttttcccatttttgtaacctctccacaatacctgtgatatgtaactaacatttttttaaaaattatctaaaaactggccgggtgcaatggctcacgcctgtaacctcagcacttcgggaggcagaggcgggcggatcacttgagtccaggagttcaagaccagcctagccaacatggtgaaaccccgtctccactaaaaatacaaaaattagccaggcgtaatggcgggcacctgtaatcccagctactagggaagctgtggcaggagaatcgcttgaaccaggaaggtggaggtggaggttgcagtgagccaagattgtgccactacactccagcctgggtgacggagtaagactccgtctcaaaaaaaaaaaaaaaaaaaaaaaattatcaaaaacctaaatgtttcctttttaaagaaatatttattttgctgccataatagaaccattatctgtctaatatgcactatgataattgcatggctattaaagtaaaagtgcttgttcacagaacacctaaaactatctcctggatatgctctccttgccttcaatcagccttgcctgcaagatggttcccagcgcccagccatggccttctccccactggcagaaccaggcacgagtcggctggtcttgcatatactctggccaccggccagccccagcaccaccctagtctacattttgggcttttgtcttctcaagggcagaaagcagtgaaataaaagatcagatatctgccatttaacacaagcattaggtactctatgcactttttaaagcattggttgagtagaaatgtatttgattgtttttcctcaaaagaataccttctttaacaggagagactgcccatggccaaaggtctttgtcactctactccaaggtttctccatcttggtactacggccatgtggggctggatgattctttgctgtgggggctgccctgtgcatggtaggatgtttagcagcatgccaagccactgcccactagatgccagcagcactgcccctctcccagtcatgcaatcaaaaatgtctcaggacatggccaaatatccctgggagataaaattgctccacttgacaaccactggcctagtcaattgttactgtacacaattggttgactgtgctgttttaagcagtgatatgttggtagatatgtacagtatatgcatacatgcatctaccaacctatataagatatgaacacttttggagaaataaagattaatttctaagctgctttcatattatttcagaaacagttgcatagattgaaaagtcctgtggaaataggtaggtacaacctcagtaataaaaataatgaaaatgtacaacttttctgacataaaaacagaaatgctacaatcctgagatagcgagacacctaagacacttgctgagttaagtgaaaaggtgaaatctagtttaaatttatagcattccttcagtgtccctctaggagtttggcattttgccaagcttccttgttaaaaatttgttaaacgtgtttggcattaatgcaaacacaaagtggtcatttgttacaaattctattggaatgcattcatttaaggcaatgaagtagttactagaaaagaaaaaaaaagttcattaagtacattttaaaaatacaatgatgtatgcagtgtgtaactgtggcgccctggtggctatataaatcgctgacagaataaccacacgttgtgtttagtttgaaattggaatcttttaaacacaaccgatagaacaaaaactggttttgtttgttgtcaaaactaatgatagtctttcttttctgaactagttaaaataaccaaaggtttggaatacaatttctaacatctcaaatcagtgtaacatacaggttaaaagaatgctttgggaatctttgcgggtgccactactgacatcagagatgggggctgatccaacaaacagaacacctgcactctggaaagagggggatgtccgagtcatcctggagaaccccacttgggtagcgccggtacctctgctctctgagctgcctgaggttattaggttacctgcagagggaaaactgtggctttcatcacagagacaatggtatcctatgaacaaatatcctaagcctgtgtctagaactcccactccctgtcctgccctaaactgttcacacaaaggaattattgctgagtaatagtgattcctgagcttgctgaagaaacagttctgaagctcagctccatgagaaaggggatacttgacatcatctgaaatgtagccctgccacatggctggctatggatgttaatgtggaatacctcatcccagggcccattgatgctggctaaaaatcattgttaaaggtgaatgaaaaaactcaccatttccaagaagtattcagaaatgatttactactttcttcttccctttctctctcacacgctgacatatttaatacttagtaccatgaaagtgtccagataatagaattccagtggtcctgagaccctgggaccagatcaaattcccatggctcccaaacttccttatattgatctcttctgccatctgggtttgatattatctaggctgcccttgaagcagatggatccaggatctcttgatcccaatctctggaaacattctcctagttaagggtaaatttaggctggacatcatggttcatgcctgtaatcccagagctttgggagactgaggtgggtggattgcttgcccaggagtttgaaaccagcctgggaaacatgacgaaaccagcctgggaaacacgacaaaacctcatctttacaagaaatacaaaaaattacccaggtgtggtggcaggtgcctgtagtcccagctacttggtaggctaaggtgggaggattgattgagcccaggaggtcaaggctgcagtgagccatgattatgccactgcaccccagcctgggtgatagagtgagacccagtctccaaaaaaaaaggaaaaaaaaggataaaattagacaaaaccttgcaccctgtatgtggcctggaaaagtttaccgtacccttcacaaatgccaaacaggctcaagaaacaaaaaggcagccaggcgcagtggcacacacctgtaatcctagcactttgggagggcaagggggacagatggcctgagagcctggccaacgtggtgaaaccctgtctctactaaaaataaaaaaattagccgggcatggtggcaggtgcctgtaatcccagctactcaggagggtgaggcatgagaattgtttgaacccaggaggccgaggttgcagtgagccgagatcgtgccactgcactccagcctgggagacagtgagactctgtctcaaaaaaaaaaaaaaaaaaatctaagaagagagaaaatacttatctccagaagcaacaagaacacatgataggaaagggagaaacacaccttgaatactgtggaacacatcttggttttgtgtggcctaaagttcgtaccattttagaggccttctttcagaaaaagaatacataaataattgactatttcaagcttgataaaaagatacggccttgtgaacatttcactggggcacctcccagggccttggaaaagtcagcttacctgaggtgctccaaacgtaagctccattatcttcatgataataagccctgttatcttatttttgagatggcattttcaaattccaatgaaaataaagtaaaacactgttaaaaagccctttactgaaaagaacttggttttaagatgagcctgccatagcatatacaagtcacaggaagacatctccctaaactggatcttaagaaagctgtcatgttcgggaaagagatgccccctcctagaaaaggagccagagagaggcattctggagaatttgaaacatgaaggaacaatttgatatctcaagtttactgaccagaagtggctccaatgacaagtgtttacaacaggatcttcatagagccaataatggcaattagtctccaggatttgaaggcgcccttcccgcctcactgaggtggaatgccatttactcttgggctggtgactaattaggggtctcgtttgaagatcaaggttttgcgattcctgcttcttaataacatggtttgcctgtcggccacctgggtccaggcgagacctccctttccctctccccacacagcaagcactgccttaggccagagcaagtgtgggcaggaaaccacagatccagccttttgagcaatttaacctcttcaccgccaagatcctacaacccagtgcttgattcagctgtgcaaaaatggaggcatttgaccttgtttctcaggcagggctgaaggcttgcctgtggtgcaaagaaaccaccttggaggtgaaatgctatgcagcatactttcttggagaagaagagagagagaaagactccacttttccaggtgagtagctcatcaagaggctgtctgcatttgcttcaggctgggccatttccagaacgcctaatagaagtgactggcaaaagaagggggtaggcagagccctgatgtaactgctcatgagaccaaagaggctgaggtgcctgcatcttcagacatcttgccaggaccccgtggccttgctatgtgaggctgggctggggctacactttctaagacatggtgggggagaagccaaaacagcaggaaaagtaagctgcaaagaattaagcttgtaacaacttgggcaaagcacaaacagtgactgaggttgctcctttggctgttgacacacgctggcctgggtcggttgtggtcactaaacccattagcgttccaatgtggcaacagctaatgcagcaagttcaatgtgtttttgtttaatttctaaatgctgggtgtatgcctgcaaggatggcctgctgaagacagacaactccactgccataaacacagtcatcattgtcagtgatctgaaattcattttttaaactatttatttcttggcagataggggctaaatggagttttgcatttcatgaactattttttaacttcaacttgctacacacttctatgtgttttctaagcaaccaccaattcagagtttccccgcaacaaaaggaaatagtcttctctggggggaggggaccatttttggtaggggagaagggaaaagggaaacataaacacaaaccagcaaccagctgggtgaagtcaggccttttaacgatatgctgcctctctgggccctaatcctcacctgcaaacaaaggaacaggaagaatgctacctcgttttggtctgcagagttgaaagtgaagtgggttcttaaatgagatacaaaggcagattcagtctggattttatattgtcttcaatctttgtttatgaaaactacaggaatccttccttcctttctcctttccttcccaccctcccttgcccaacagaccaccttaaagggaaacaataacattcccctccaaagaatgaggagtttgagaaaagcaagcagaggttatttcagtgggaatctgaggccagtcacatttgcacagtgccaaaaagcagacatactctctggtttgaacttatatttaaatcccatgccaaagcctgcccttgtaggtctgcatgaagcacaagggcccagggctgaaacccttggtctcccatctccagctcccactcagggatataagtgaactctgtaaatgtctccacgtgtaactgggagagctgtaacaatgggcctccaagatgggcccattctcccatctgttatggggcttccagctatcatacatgtttccaacttagatgtagacgtaccctgagagggaatttctgtgctgcttttgtccctggtcactttgaagattaaagagaggaaaatgtgttttcataatatgtgaactggctggaagtttccctattaaatcccaaagtcctggcaggcagggttcaggcttaactcctctaagactgggttggcatccaggactgaaggctaggaaatgcctttgggcagacctgggccagagaccaagggactggggcatgacaaagtggtcacctgaggcataatgccagtgggttccgggggcacccttgaagccactgccaaagcccaatgcagcaggactgcagagtcccctggaagacccatggatataccagtggcctcagctttgctacggagaacttgcttgggagctagtcccttgagtgatattgcaaaactctacagagatgtatgaaattcctgatccggggtgccaatccatgaacagagattcctactgctggaggaggcacatggctgggtcttccttcagagcttttgcataggtgttccctctcacttgggcactttccccatcatcctttatctggctaccttctgcttatccttggatgtcagcttcaataccacttcttcaggggagccttcctgacttcccttcctggtccaatcctcttgccaaacaccgtcttgacaatttctcccccctctccccatatgcactcctgcttctgggcaacttggcatcagacatttgtgttaggatctgattaatgcctgactgcatcctaggctgcgttcatgaggacaggctatgtgtgtcttgctcactgaagtgtttcttgtgttcctgccacacagtgggcatgcaataaatattgaagtaggtgaagaagagagctaactaagttcattgatggtaacacacatttatcaaatgctgactgtgtgccaggaatagccccaaatgcttctgcagcagtgattttcaacctcagcactactgacattttggactagataatttgttgctgccataagcactaaaagtgagagccggagacagggcctaacaggagcttcgtatgtgtagactacctattactccttcccctttccattttgctgacttcaggtaagtcacttaacctctctgagcctcagttttctcatctccaaagtgaagatagtaactctaacctctccaggtggttgagaacataaaacaaaatgaactctgcctataaagtcccttactaatggctggcatataacaggagtgcaatgagaagtagtccttattatctccccctctatactcgcccatacagcagagagctgggcaataggaccagcttgatcctgagtgcagaaataaccacagtggggtgttcatgcccaggttatgtatgggcttggtcatcttcatgaaaagatgtgtgcacagtaaagagagaacacatcactggggccaggaaggaacagtggtagaaggaaccccaagcttccccaaaactgcaaattccctgcctccaacctggggcacctctggcagccagccacgttggcagcctcgtactttctcttgggctcttcctgttggcatagcccaccctgttttacaaagctccagtggttttttttttttttttttttcatggctccagctgttagataaactttcaaggatatttctgtggcaggtacaaacctggacaggaagacttgggaagaaatcctaaattaattatatgtcaacatttaagccacaagaaggagcagttgtcataaatttttggaaggttaaaatccaattttagttgtaaatgtgagcaagctcactgactcacttgtgaacgggtgccaacaaaatgatatattttacattctttcacagcttgttttggctaaacacaatgaaaaaagagagagagagaggaattacagtttttattcttcagtgggctgaggtgttcaatcatgcacaaaagctacatgtgccaaagcagaagaaattagctgagtttatccatatttttgggtgccttccacctttatagagaaaggaaatggagctgaaaactcaaaagacggccacaggtaccgcagttggtcatcgttagtgctgatggcccaaggctggacattcctgatgacaaatcaagactcctccaggaactaccctcatggtttatcctcagtcctgaccaaaccctggcacactaacaatttctaaagcatcatttctctgagtattggcttgggttgaatgcaatggtagggtgtcaagagcaggaaggcagaagaatttcctttaattttcacaaaattaggaaggtggctgggatacagttataatttttgcctattttctcattcattcatgcattcattcagttcttcaattcaacaagcaatcatttttgccagccatgggccaggactggggatttgagggggagtaggacataaaccctaatctgggagacttgcagccaggtcaggggcacagatgggtaagaagacaactgaaatacaatgtgatgtgtgagttcatgggggcccaggatgccccgagacacctcatatggtgtcagagagggccagcaaacattcctcatagaagatgacttccaggttgagatgtgaggggtggtgagtaggagctaccgagtggaagagggaagagaggaaccatctgagcagaaagcagcatgtggtaaggcctgaaatagagccaggccaaagctgacccagtgaacctcaagcaccaaggacacaacatggaatgggaaggggggagtagcagagtcagggcagagatgcaagcaaggccaggccacgtgggactttatggctacattaaggagactagatgctgccttcaggcagtgggacaccatggaaggggagtgacctggccagatgtgtgacttcagggcaaagtggaagctgggtggaggcaggtggggactacataacctttccttaagggaagaacaattccttgggtggtgtcagttgaactctgtcccctaaaaagatattttcaagtcctaaccgctagtaaatgtgaatgtgaccttgtttggaaatagggtctttgcagatatatttgaattaagataaggttatactgaattaggataggccttaatccaatgactggtgttcttagaagaggaaaaattggacacagagacacagaatacatacagggagaaggccatggggtgatggaagcagagggtggagcaatgcatctataaaccaaggaatgccaagggtaccagcaaccaccagaagctcggaagaggcaaggaagggtctcccctagaggcttcgaagagggaatggccctgccagcaccttgattttggacttctggcctccagaaccatgaaagaataaatttctgttgttttaagccaaccagtttgtggtactttgttacagaacccctaggaaactaatacaggagtcatggtggagttctgctgcactgctcccaataaaactgaaactccaggcagccttggtgctgaaaccatgggggtccatttgggagagggtcatctgagatccaagaagcatctcctcttgcttctgtctccctttgacctggttgagcaacttgtgctcaaaggcccgcgtcgtggctctcccaagggtggctgtccgtgagagagttagcaccaaaagtcaatatttgtccacaggcaacagttgtgtttgcactatgaaagccccaacaggttttttcagagatttcaattggccatgaagtaactctgtcccaaggaaacccctgaagatgagccaggagggacaaaagtcccaaacagtaggctctggcaggcagcatcacaggaagcacgaggggactcgtccccgggccagggtcttcacggggccttggtgcacaatcgctgtgcttgtgctgctgctggggttggacttcctcatgcagctcagccaaagcctcctggccctcccttggtgctgatcagctgttcccagctggaagcagcaatgtcatcctcttcccaggactccagctgacacagctgatgggtctgcaggccagcaggagcacacgtgtctccacacctcctttgggaggaagggatgtcctggccaccccagttctggcctggatgggggcaggagagtcaggaagtatccacatggctattcagtgcctagcacagtgcctggcactaggaggttcttaataaatgaatcagtgaatgaatgaagaccttgggctctttaatccaactgaatttgagtccaatcgtggcttagcccatgattagctatgcaaccttgaacaagaaactgcacttttctgggcctccactgccccatctgtcagacggagatagtaaaaatatctaaagcatagaggtgttgagagaaatagcatagaccagacatgttagtgcttagtggggggcctcacagtcttaagggctcaataaatattagtcaatatgactatcatttttattgtggagttgtatgccagtgtaaaagaagtgttcatatttgccagctctagacttgggggaaaaggatgagagaagagaacgtagcgaaatcctcttaagactccagttcacaaaccctttgctattaccttgatctcaactgaccgtcatgacaactctgtgacatagggcaagggttgtcatctccacttctgataagagaatctgaagttcagggcaattaagtaacttaggcaaacacttttcagtgataagtagcagagcaaaaccccaacccagaagtcttcccatgacatcacaacaaagtacagaggcatgccatacctcctcctggaatgaatgaatgaatgagaaactcaatcgcaaaatgattctcaggtataggtgggaaagaaaataagagctaaaaactataggatggaagcatcagagacttgggcactatttcatgcgtgggtttgggcagtcaactccccttttctgatctctgtctctcaatctcttctagttctcaaatcctaggaggaggcaatagggtagagtcagggtagagtcagaggccactcctcagctgtgatttaatgtcctgagcctcagtttccttacctgtccaataaagatagtaacaccccacaggcttccttggaggatcaggggtaatatgtacatgaaagggcttcataagcagcactgatattaaaaaggatgaagcaaaatatgatggcagattggaaaaaagaacctgaaggaaatggcccaagataaaaatgcattaatattaaccaacaggttcctttagaacaacaaagcaatgaaacaataattttagagaaacaaaaccctgcctaggaacagcctgccagagggagcggaaatgaaggcacaaccaagtggcccttggcttacctatctggaaaataacaagatgaaaaagattctttgtaaactaatatttgtaaaagccccactgggctttctgcctgcacagactgcctattatcttggcaaaggatgaaaacaagtgaattcttatttaaaatgagtatgaagcaaattcaggtaaatgttatcggcatcatcatgagctgccattcgctgaatacctactatgtgctgggcactgagccagggactgtgcatagatactttatttgacaaaaaaaaaaattttagcactctcacaaggcaggcataatattcaatcattcatatattcataaatgttcatgtttctttgttcaacagatatttcttgagcatccattgtgtgcaggtatggtactgtctggtacagacacaaggataaacaaggtctagtccttttctgtaagacaagtcatttctgacttgttgagattattctttatttaagaattccttgtggggtctgctctatgaattacaggatgtttagcaacatccctggcctccacccactcagatgccagtagtaccctagtttgataacgaaaaatgtctccagaccttgccaaatgtccctgggggtggggagggatatggggatggggttgctcccggttgagaactgctgacttagatcttaatttccacatcttttaagatgaagacagtggatctcagagaggctaaatccaaggttgcaatcaagtatgggattctgccatatgaagcagaaaccagagctgacctttgaagttgatagggttttgtttctgcatgttgagttccaggagatgggagtccccaggccatagccctgggattctgtctcatttactatcaatgcatatccacccttcaagtctacctttggattctttttttctctccaaatctgccaaatcttaaccatcataaacatttaattattgaaagttgaaggaaactctagctaatccacattctgaacccaagacatccctgcatattgctatgaatgtgagtcaattttccagtgagctcctggattgactatggagcacagttcacgttttgactccttaaacagtaagtcagtgagggtgtacggaaactcttagaggaaagagaactgggattattacattcccaaaatatcttggaatttttaaacttcaaagttgtattgcagttccaagagtagcctaacctttacaaaggttactttgcaaatatatgcaagataaagaattccctggaagaatgtccaccaggatcctaagcctacatttatatttaatttataatcaccctgaaaaaaatgggttcctctttcaaggagctcgcattacccttggactgacattgtgcaaaggagtgacaggtgcaatttacgtgaataatcaccataatcagccacacttaagaacaaaccagagacgtgctcttcagggggagaaactgctgcatcacacagtcaactactgctccctcaaatggtgcccaggccactggctgctattgacaatcaaatgcagaagacacaggagaagtaatatggctgactactgtgattcaagtactctggcctgggagacctgagttctagtcccaatattgccaaactcattgtatggtctggaagactttttcttcactgggcctcagtttccccattttcaagattaggtcattggtctagatggaataaaggctcctctttattctcttcctaaagcaagaggaataaaggattcctctttggagatgatgtcactggtagcagtaatatctcacagtaggcatttcatgaatgaatgaatcaacaaatgagtggagttttcctgcaactgcaatgctgagctgcctctgccatcttatttaattcaaaaccaaggataccttattctggggaataaatgatgtttaggtttatgaaaaccatgctatggaccagggattggtaagatagcaaagggccagacagtaaatgtgctaggctttgcaggtcttatgatcctgtcacagctactcaattctgcaatcgtggcaggaaagcagtcacagacaataagtacatgaatgggtgtggctgtgatccagtaaaacaaaaacaggaggcaggctggatttggctgtgggctgcagtcggctggctcctggtatggcttgaaacgtctgacctgacatgttctctccatcttgatcagtccctggtgctcagggcctggagagcagcacagcagcttcccaagatatctgcaataattatagccccatctctccctcagctcatctcctatggttggagcctacaaaaatctccctgcgagaacctccttttcagctcaggaacaagtatctccaagattattggcatcaaaagccatactttctccatgcgttaggctggggcctcaagagctgggaaatcagaaggaagaaatggttggaaatagagcacctgtgcacaggaacttggcccaccactgtcacttgctcatcactgggaaatcaaatccaagtgttaagtgttacgaagcctaattattacaagcagcagtcagaggtgggggtgggcatcccccctccaccagaacacctttccatctcacacaggagcacggtttggattctaacaggactatgaaggaataatttgatcgggaggtcatcgcacagggctccagagcccaactgaccttttgaagtctgctcagggaacctcattatgttgcattttggagtcgatcccttctctgatttttttccaagtctttttgccctttcattcctttgatggttagatttttgcttgatagagaggcacaggctgaggggagggagagccatggaaggaaccaggaggaaagacttgattattaagtgaatgatccactctaggggccttggcctgctactccttgggcttgacttgctggctaggatgtctttaaggagctgtaattctccagaaggcaagactcccattggttaccaacacaatttggaatgaattgatgcaaccctcaagtcacaagcaggagcccttgccaaagcaagcacagtttcccttcttgtaaagcagtaattgggagtaacttctaggaaaaggaagctgatccttccccatgacaagccacccctcccttgcccctgaacattaatgtgtttgctcagcccactgtctgcccctgatgtgcatttgtgtccttgctgccatttttcatgctaatgactcctgacttcctgctagcagaatgtcagagcacagagaagtccccaaagattcctggttcccttttaaaagatgatgaaaggtgacctggtgtataaccacatgcacaaatcacagatactcacgatctcatcaggaaaggaggtcattctccctctgatttcaacctgctgatgggaaccctcagccaggcccaggatttcagctcagcgatagaaatgaattccccttcctggctgcctttgtcgaatggtttgcctttccctgggccaccactggcaatgacaggacataatcctcctcttctctccttcccacctcaacatatttgaagagttttaaggcacatagcaaacctggtgaaggggctcatctcacttgcttgaatgaaagccttggcagtttcgcagtcattaatcatggctgtaaaaagactggcaaataaaactcaaggaactgtcctcggcttcagccttccatgctgatattccagattcaaggctgctttataccaagactacgcaaatagagctacacaagatctttggcttgagctacatcacccttttcataggatttctggatctccttggtggcataaagatatcaagggccatttcaaagtaactctgactaggagaattccctgcatgaatgggaagaccatagagctgacttctagttcaggctagacctgcatccttgtcccagctttaacatgaacacagagggtgacctgggttgagctgctcaacgtttcactgccttgatcagagctccccagctatataggtctcttcctctgaatctaaggaccgacacaatatgattgctttcattttatgattacaaacaacaccagcaacagggactaagctggggcttgtcatggggtacaaaactcagtgagattcatccctgccctcaaacaaacaagcaaacaaacctctatgtccagtgatatctcaagtatgtaataatgatgacgatactttttgagcatgaaccaggtgtcaagtacagtttctaaggctgtttacatatattaacgcactcaattctccccaagtcccttttcaatacatactctttttattctcatttagagatgagaacacagaggactgaacaggtcaggaccattgttcagggccacaaagttattaagtggtacagccaggaccaaacccagcctggccactgggccctagtaagctgcacccccatctcatggacataaaggtactatcaggctccttctttacttgtgctgtgttctcagttaatcggttcacttttacatttattccaaaatattttaataaactcttggtagagcctgacccaaggctgggtgctgggatgatagcagcaactgagaaagacaaggtccctggctctcacagggctttcaacggaacaggaaaaaaacaaacaaacaaaaactgcctgaaacccttcttctctggtgagggcccttggcccctaaaatcctggggcatgagtcagaaaatgtcttcctagctgtcaggactggctaacctgcaaagacagggtcaacactggaaggaccacagggtaaggcctcattttaccaaaatatgcttctcgcctaagggattttcacagggttagcaaatcctgtgtccgtcaggggacagagtgagatctggcaggagtgtcacagatgggagaggccaggctgtggcagaggcctcctggcaacagaggctgagtccaagaagggctcagggtgcttgggtgagagacggggcagagggagaagaacatgactaaccattctaaccagggctcatgaccgttcaaaggttccctcatctccctctgtgtccggaatgatactgacagtattcacacgaatcaccttaggaaccaacgtttgctgcatgccctgtaccaggcttgacactaagcacacagcatgtcttttggcatttaatccacactacctccctgtaaggggagtgatcatagttccatccaaaccccgagtccactccctcaggcaaaaggagcaaagaagccaaagagtagaagactgccaagaagagaggaggtgagaaaggaaggtgatggggtgagggcagtgggtaggagacccagaggcggctcaggccactggggctggtgtggagagatcaggatgccagcaaaccaaacagcaacacacgtgtgctgctcctggggagatgcttccatgggagtctcagacccgctccttgctctcctgactctcacatgcccgcacttcacccaggacagctctgcattttctcccttccagatgctgaggttccttataacatttccttcgaattcaagatttcatattattttgatgatgcagagacagtgaagcccagcgaggggcaggtcacccagggagtgagtggtagcgtggcgagctggataagaatgcagcccctacaattggacaggtcaggatggaatcccagcttggccacttactggtcatgtgccttgggcaagcgacatcctctccgaaagcccagcttcatcctcaggaaaaggataacaggaactccacactggatggatgtgaagatgtgatgagatcctgtactgaagaacttagcacagtggggtgcagtggctcatggccataatgccagcactttggaaggccaaggtaggaggattgcttgagtccagcagttcaagaccagcctgagcaacataacaagacctcatcttaacaaaaagaataaaaataaattagccttagccaggcgtggtggcatatggctgtggtcccaggtacttgggaggctgagatgggaggactgctgcaatcataccaacgtactccaacctggatgacagagtgagaccctgtcaaaaaaaaaaaaaaaaggccaggcttggtggctcccgcctgtaatcccagcactttaggaggccaagatgggtggatcacttgagcccaggagtctcagaacagcctgggcaacatgacgaaagcctgcctctacaaaaaaattacaaaaattaacagcatgtagtagcacacgcctgtagtcccacctacttgggaggctgaggtgggaggatcaatcgagcctgggaagtcgaggctgcagtgagctgagattacgtcactgcactccagcctgggcaacagacctcgtgtcaaaaaaagagaaggacctagtacaggacctggtgcaaaataatagctcaataaatagtagtgagtattattttcagtcctattcaaattcttcccttttcttggggtcaagctgcaatctgaaggagcacaaggtgatgacaggaggttccccagtcatttcaaaaccaggacccaaacagaacagtgatggcccccatggttttgagaggaaatggctgagcatcatggtcaatggaagacataacggtgaagaggcagcatctgcacaaagaatccagtggctgaagtctagcagctgaaacagccagggacacaagtcactcgaccatcaaccatcagtcactgtggccatttccaccagggttcctgctgtggccatgactcatcccaggtgtatccaggatgtagtatttcatggtgtgtgagttcagtatgttatttcagtggctcagagcttcatttcccaaccagctttccaagtggggctgaaacatgttccccttcatcttgcctgacttgtagtttcttcagctcctcttctaagtgacaggagaaatatcctctggaatattggaaagcaggaaactactgtacaaaaataaatgggtaccttaagccaacttgctggaattccactgcatgactgccttccaaattcaactaaggcccagagcttgtgtgagtgccagcaggtccaggaatattatttttagagagaaaggctgtgggtgggttttggggagagaaggtggaagtctattctaagccacaattgaggggtgttgccagagcaaaagatttatacccaggagacaaatgtttggagaaactgaggttctgatgactggtgtgagccaccggcagcagataacagtggaaaaggtgggagtaaaatagaggtaaggctcacacccatgaatggggctgtctgtaccctcttcctaaagcatgacctgtgaaaggggctaggaccatctcccccatcctatgtggaccttcttccattccttatattaaaacaacacaggctgggcgtggtcgcctattatcccagcactttgggaggccaaggtgggcggatcacctgaagtcaggagtttaagaccagcctggccaacatggcgaaattctgtctctactaaaaatacaaaaattagccggacatggtggcgggtgcctgtaatcccagctactcaggaggctgagacagggagggagaattgcttgaacctgggaggcggaggttgcagtgagccgagatcacaccactgcactccagcctgggcaacgagagcaaaactccatctcaaaaacaaaacaacaacaacaacaaaaaaacaatagttttaagtctcaaattctaatcccattgtctctgatgtgcccagagtaaactttctaaaacatacaaattggcataagtccctttggtagctccttactgttctaaggaaatacccacaagaccaagtcacctccttaagcttcttccatcttcccagctgcctccactctctgatttagctttctcctgtcctccttcactggacaaactcaaactcactgtccagacctcaggttagacaacactgcctctgggaagccctccctgagccctggtctgagttagatgattgttgcccttgcttccaaggccccgtacctccccaaccctgagacttcccagacgtagctgtgcggtcctcccagctgggctgtgagctccatggagacagggatcctgcctactcggtctgccactgtggccctagcactgtgcctgatacagagtatgtgcccaataagcacatattgtattgattggctgagctgacttgatgcagggcctggagtaaggtcttgcaggacccaagtttgttagtctctgtcaaaggagttgaagtcataaattgagaaattgtgaaacataaaaattgaaacttatttaaagagtttcgtagtaataaatctgaacttcctggcccctgctaaggggctacactaaacaaacgggtgtgggaaataactgaagggtaggagcccctaccatcttactcagatatcaagacaacctaccagaagtggggcaaaccctagatcactctcagaatgctgatggcctcccagccccctcggcccagtgcctcaaccccgtcctacaggaagggactgtgaaacctcaagcttttgccttgaaattagaggcatctaaacctgtcacctaagaactttcgccacatataattattgacctgagacatcagtcacattaaaaaattcaatgctgacagagggcaaaagaaaagcgtctagaatatcaaaaggtaaagggtccagattaaaaagagagatgcaaggagggcttttcccaagtcacagcctttaattgactccagtctctgctgaacaccttggcgtcctttgccagcatgctgggaggccgcatgggctccaccgacaccggtaactcactgcagaccagcggggctggccggccacatttccacaagaagtctcccctcacagccatgctgggtgccacaagcaatcaatgtctgcaaatgacaagtttgctgaaagaacagtcttagaaaccaggataggtttggagcatagaggtggaagacgatggtttccccccctgaagtgacagactccagaaaagcatctagaatatcaaagggtgagataccaggcctgagacttaacgaagtctggtccaaagggaggctggctggtgtttttcattcaaaggtcagttgagtaaatgttatagtcagctagctgatttctttggatcctagcttacccatctgtgaagtgattctagaaaaatgatcggtgtctctgctccccgactcgcactttagagcagaggcatacttttaaattaaaaagctctccccgcttacaaaggctgcatactctgggtcaacctctagtttagtacaaatgcagctttccactctttcagatacaaagaaatcataagctgtcttggaaggaaattaaaaagacaaaccagggtaattcttgtagagagccttagaaaccaaagtcctgcttactctgcatggaggacacaggtcatgaggacacatttcaacatctttcccttttgaaaaaagtttcattagcatcttagttttctgcaaagaagtccaaaaatggaccaaagggcttctgaaccacaaatgaaggctgtgcctattactctattagaacactgcatccccttcccccaattgcggacgagcccaccaccctccaattgtctctctggtaggtgtgtgggaggcggtggggaggagattgtatgatcagcatgtcaaatcctttgaggtcatttaggataaaactggtatcaaaaggaatgtcaagcagagaaatctaaataattaaaatctgttagtagctatagaccatcatctcttcctgtttggggtttttgtccctggccttttctttttatctgaatttcacatcaacccgtgagattttgctgggcaaaaccagctttcctccagttgctgggctgtgcttattaaatgtggatgaatgtcaatgtcacccatctcattaataattgatttccagccctgtctctatttgcagagcagaagccacttacagagtctattattccaactctgtgtgtgggtcacagggccaaaggggttccaccaggggtaacctttgttggcagcaatcaccatgacaacaccacacatctccagcctcaactcggatgccgagaaggtgctgagtcctgtcccacactggggactgggttggagtttgctgcgctaaatggctgtgtgagcaaagctgctggcaaaatgggatttttccattttaatttttagtctttgttgaacggcattgcgtgctttaacgaacgcttttggaaaccaccatggaaaagggcatttttggattcacaaaacaaaaccctgtttttctttctgtctcctcaggcaaaaaataaagacaaggtaaatccctctctggctgcttttaggtcattttaagtcaatgaaacctatataatcccggaataaccgattgtttcttttccacccgaccaaagactgcaagcttagatgggaagaattactgttttgcttttaaccgcctattaatattttgtcctaccagccacgcttcctctatccctctatcccttctttgaagatttccccccattaaattaatgtttaacaattaaatgaagccaacggagagttttgaaagatccacacaattgtggattgggtgggcgtacagagcctttaatttaagtgggaaatgtttcccaaattatggcctgagacctcacagctaattacataattttctgcatctgaaaaaacataagctgagaaaatacaaacagaatcacactgataataagagagaaaaacctggaagtgggtccattcattattttagaaaacagagctactaggcatgaaagaagcacaatgttagagtatattaacgaagggtgcataaaagcccaatgctggaacttcgcatggcttcagagatcatctgccccatgttcatcaggttgaggctggacactgaattgaacaaatccacttggtcaaatacatctgagaaatagcatatattttatccatgcttggagattttctaagacgtattttcttttcttttattttcttttttctttctctctctctctctttttttctttctttttttttttttttttttttttttttgatggagtcttgctctgtcgcccagactggagtgcagtggtgcgatctcagctcactgcacgctgcacctcccaggttcacaccattctcctgcctcagcctcccgagtagttgggactacagacgcctgccaccataccaggctgatttgtttttttgtaattttagtagagacagggtttcaccatgttagccaggatggtcttgatctcctgacctcgtgatctgcctgcctcggcctcccaaagtgctgggattacaggcgtgagccactgcgccccaccctaagacacattttcacactgaaagctctaagtcctgcaataaaaacaatatatttaatgttgtttagcccagaattggccaaatgtttgtgattatagattttttaaaagaatacttatttcagtaatgtttattaaaataataaaaatattttaaatgctcattgtaaataatactaatttaatatatcctgtggggattttttttttttttttgtaaactttttacagttctatggaaccagtgtttatcagaatatatttgggaaatgccaactggatcccatgccttataaacaaagatactgaggcctagagaggaaaggatttgttcaggatcccaagggcatcttagggagttcttgggagataaggatcctggatcgctgcatttccaggctaatgcctgtggattaaacctcatttatgccctacctgaggttatatcctacctgacaatacagactagatgctctttaagatcaggataagtcaatgtgccattctgtgacatctttaaaagactgtgatttttaagggagaaaacagaatgcacttggggaactggggagcaagttcatcagaataggtgcccactgagaattcacatagatcatttcacaccttactcttctactttgggcaacaacttgttgtggtgagaatgttccagactgagaactaggggactaagccagtattatttaaggctgatcttttctgcaaagtatggatgctgagatggctagggaatagaggtaagaaatggtctatgctcatttgggagaagaaaatccaagatttaatgaaagctcagccactgagttgctctctgagctcaggatggtgccttcttgtccgggatcttagtctccccatctgtaaaacgaaggaggtgaaccagagtattttggaggcccctcccagctttaacgttctttatcccactctcctgggagtgacactcaaagccacattcacacaatgactgtaccatgaatagctgcttttaaagtcaaaattctcttatctgggaaagaaatgtctttgttcctttcaagagcaaggtcagttcggaccggcaccccacagaccaaatgcttatgcaaagcttatgccatttctgggaggcacctagggcagtcctggaagggttggctgttccttacttcccagtcactgcaagaccctcagataacagcttctcttattatagtctggctcccactccctatgaagaaagtgagaggtgcagatgtgcaggagccaacaagtatatatataaacatcaaagttttctttggaagggaatttcagaaactcaagaaaagtcagatccaaactttgggttcagctcaggtcttcctccttaacaaaagccccattcctgaaatgctatctgagaaaaaacaatttcattcaggacatcaagccgtgaagtcatcaagtcttgaaaaacatcaacctcccagaccaccatctgttatgcaagctacatgcaatgtacaaggttgctaatttttttggccagaacttcaaattccatgcttttaaaaattaagatgacaaacaacttggttttacaaagacgctgaaacagccaaaaacagtctggctcccccttaggtcccagaaaagccacagctttgatgaaaggccttaggttgtcaaatcacgccattggtgctcgctggggtttagaccccgtagcctacatgacaagagccctggtggtagggttgactttccattgtaaataaaagccattggctttccattgcaaataaatgctaggaatggtcattcccattcttggctcttatctggcttgtgcatctgactatctctgactatctctggtagggaaagttcatgggaaggtttaacaattcatcaagagcagctttcacaatctttatgttgtcttctccaacataaaaattggccattcctaagcacatactatacacagaatccaaaaattgtgaggctaagtgtctacacaaaatggattgtctagaaagccaggcgaggactgtcatgagactccagatagtaatccaagcaggaatgttttgccctggttagttttacaaacgttgaatatagacaggtcaatgtgttaatatgccaagtcaatgttttttgaaccaattcagccaaaaacatattaaggcaagttgctagacttgaaagagtcttaagaattttcacaatttttgccaaactaccccttattgagcattttccaagcgctgtgaaaagcaatgacatatagcatctttaatcttcatagtaattctgcagagttgacgttttaaacccattttactgttgagaaaattgagacagaaaatctaagaatctatctaagatcgcaggatttatataggatgaagccaggaaccaaccaaatgtacacagataagttcttttccctatatcctacagaagaggtcagttctttttcttttcagtacagctatggtggaggtcaccactcccttgtgccacgttaatcccccaatgctgagatcattgaagattgtatcaaaaatgggaacattgcccaagatggtaaatacatctcatctagaatgttattaagacaggcttgccatggctgcctggagaaccatactcactgtggctctgtgaaaagagtgcagaaggtattggttaagccagccttgggactggagagtagtggcacctgtattacagatttctgactctgaactatggatattaatactgtcaggaccaaaactcatctctctctctctttctcatgccttgaaaaagcaacacgttgagtccgtaactcatggcaccaaacttgacttcccccaaaacttactctggcagtgaaatatctgagaacagaaaaaaggaatatgaaaagatgggacagatctttcatgaaaaaatgaagagctttgagtgtctttcagattatttcccctttctccccttctcattgacagcagctctgggtaacctttttcatccaaatttttgtctacttcaaggttacccatagcttccctaacagcagactagttacctcttgactaaaagacaaaaggaatagtcaaaacttctctaagccttctaatggattccatagtggccaatacttgtcttccttctgctttctatttccacccagaaaggttcaggtcttcctaaaacaaccactctcagcttctaccccttagagaagggaatcctctgcagggattcctcctgggctgttaccactgggatgatctgctaggtcccacatctgctcaaagcctccatatctctggtgtttcactgcaagtccatgagtctcccttctcctggcctgccttcctgccttcctgcacccgctgtgtttaatctgtccttccatctatccctgaactccatcagacctcgtctctgggggagtggaggagtaaggctgaaataacaggggctgtggaggagctgtctcggatgggggcagcagcaaaaggctgtccacgtgtaagcagtcaaatatctgcacttggagggagagctacagggagacagggttacatcagccagtaacatcgagggccagagcttagactaataggaagaaataaagaatggaaatgtttcggccggacatcaagaaaaacatcccgatgaaaaaggaaggctcccacgtgggggatgttctcataaagatgagtgagtggccaggtcactgcagcgctctccccagcctggctccagtgcggtcacaaacgaggcctagtggcctcaggcgggttagcggttggcctccctccagtttcccttcccttggagaagaccacagagatggttcatgcagatgacatggtgtgtggtcaccttcaccctgtaagtctctcttagttgtaagaatgaaggaggcacttaagctaaatcaagagaacgggagcttggctggggacggattcacccagtccataggatctggaggagggtcaggagctggggcagcatggatctcctcgttcctgctgcgctgtctctgtgtgccatttgcttctctctacgtccctcttctctggttcctcggaactacagcttgcatgtcatggctgccctggccactctcccactctctctcgaagccttacctctcaccactaatcaactccacctccccacgatcctcaattcagattctcaagaacaagaacctgcctggcctatttcatccgttcagggaggccgattcacaggagtccatccagatgatgaggtggctgctgttggtcccagtgctcagccctcatccaatcaaccatggctggggcagggcagcatgggactaagcaaggctgcccaggcaggagaggctaccgatggggatgagagtgatgtgggcctttagatacctctgggcctgtctgggacgctccctattcccctcttcaagcacctaagtctaggcctccaagcttcaggtctcagcctcccaattagagttatactcctccttgagctccagggccctgctgcttgggttgggcaagtgttcgacagacagaaaagggctgtcctcccactcacacatgtggcccagtgatgggctactgggtttattaggcctcaacgacagcattttattagtgactgatgtgccatttggcctccattccttacctcccacccccagctctatcacatccaccctttgtctctggctggaaagaggccaaatccttctccacctaagaagttctccacctcccccaccccatatcagtgggggaggatgacggggcagtccttctaggaattgtcccctggggcattatttggtttcctctcacttaccagagtcacttaggataaatctgaattctgagttgtttgccaaatgctggatcctcgctggatactccttggattccttgaagaattcagcataatataaaacagcttaaagtcaagaagccccttctgagacccttaccaagggaggcaggaggagggacaaaatacaacaatcactatcattccacacaaccatatacaaatcatcatagcaatggatgctgcctgttacgtgcctgactccgtgctagggctgttacctcatcatatcctcaaacaacaaaggaagaattacatctcacaaagtgtaaattctttgccaaagggtcctgtgaccaatgtcagacaagagatttgacatccatatctttgctaaaggtgtctacttctgtggttatcattgtgacgtttccttcatgtaatgcaaaatagcccctactttccacatctactgaactgcaccttcatctgtattgtcagtcatcattttcctggctgtataagtgctttctccaaaagacttctctcccatctcatcaatcaccaaaccctgatgcttttattctttagaatatctctggaaaccagtgcccattctccatcctcactccaccacggccacatctctcttctagattcttgccatagtttgctaatagaactccctgcgtcaacatcctccagcccatccatactccaaactccaaatggcaaccagagagctccttctaagacgcaaatccaattacatgactccactggggagggatcagaaggatggagtggtaagaagcagtgagccaccaggacacgcagtgaacactgatgtcctactgcatttctgcagagcggcggaaggtgtgggctgctgtgcgtcggatcacgtgggaatgcatgggatcaggtagaatggatgggtcacaggagtgccaggcattgtaaatggggaagagttgaacatctcagtaactgaggaacaatttatcctttcagtgggactcttaggggtaatctgcttccattggagacactccaagaagcactcacagaaaacctctgccctccagtcaggagtttctgtgtgtgtcatatggagcagacagagtacaccaacactgcaaagaacaggacaggaggagacttaaaagaggcaaagagaggatggccagctgtgctcatagttgctgtgccagggggtacccactgggccgggtcctcctgccagggttgtgagttcttgggtgtggttcagagcatggctgggctggacagccggcagcctctgctgctaaaggaacccaaggggcgggggaactagagaatcccatttggaggtcttgggtcccgttaccctgtttttggtgccttccttagggtccctgagcgcatacagggttactcagtaatgctgtgagaagagaatacatggacggaaaggagagcagaaagtgaggacccagtggtcaggagccagagagcatcatcctgacctatgcagtatgggataagctaggaaaagcttcagactggggaggagggtccagacatctggctctgtggttaatacaatgaaaagaagaataacggcgacagcagctacccaggaggcagaggctctgctcggcacttcctgggcctcttcattctgtccggcctccctgctggtccttcacagactaggctggctcctacctccaggcctttgccttccctatgccctcctccgggagcactgtcccctcagccctggcaagactttgtttaaatcatttcccagtgagaccctccttgagcaccctattaaccctgttccatgctgcacccccaccccttctctgggattcatttttcttcaagtgactgacatcattttctgacatgcagcctcatttccttgtttatcatattcactgtccatctccacattagaatccaggttctgtaagggcagggattttggtctgttttgttcactgctacatctccaaggccaagcacagtgccaggcactagaagctgttcaataatgtgtgttgaatgaatcctatttcaccatcacagtgacaccaatcaaaacgaggtgttgaggctcctcccatttcatgaatgagaaaactgaggttcggtgagggtagggaactgtctatgcacagccagccagtaaggagtgaggaaggaagatgtgtgcaagcgcaggcctctccggtaccagagagctgtctcctccccacccctaacccagccacttacaacttatgtgggaaacgaggagtttgggctcaatgatttattgccgaggctctctctcctgaggtctgaagctcagttcaagtccataaccatttcctcataggaggcggagtcgcaggtggtttggggcactttctctggaacagagtttaagtcccatttttcccactcagccctgggactttgagacaacttctcaacatctctgagcctccctttctttcgtttgctggctgcaaaacgagaatggtaatagcgtatctctgtaggggcgttagcaaagacagcaggggatgcgtgtaaagggcttcttacagtgcctggcacacggcacctgtgagctgctgtcttggcactctgctgatgcccagggctgtcctcgacttgccccagccgggcccaccaccactgaatctcccggggtgaggaagcacccctggctcctttcatcctctacatcggccaggtctggatagttcagcctctgggaggcagggtagggcccagcgggccatgtttgcagcccagcaaatgttcctggagccttgttttttgttctgttgctgggccatttgtttttatagcttatcgtttctgcaggggggctttgaaaggctgccattgctccagtggacgtttccggtgcgcctccatcaagccacatttaatgaaaaccagtttaaggtcttctttctcataaaatgtctcattgttgctccggcagctcctctttagaataatgaagatgaacgcttcctccgtggggtagcacacaaaacccccagccgtaggagagctttgctcagtccccaggaagtctcagagaccaggggagaaataaaaagctagtgcagtttctattagggaggaggagaggtgggggcttaggaaccctcagtgctgcaaatatagggaatgaagcttgggttcctcatcctctctgaaggaattgtcaaatgaaagaattttgctactaaaagcgttttataagaccctcaacaaacacttgtggtccaaagaagggaagcagcagacgtaaggtcacacagcagagctggactagttggggtagagctggggagacaagcagttttcctgggtccccatccagacctccttctgctccagaggacccccatgagacagggccagggggccttcttcaggctgtcaggtctagcccggagttgaagatgcctgatgaggatctggctggtccacaataggggctggggaagcagctggtggccagtttcacagacagcaggaggtctcctccaaataaaaatcacaaggattttagatgcacttgttgaatgccaggctgaagtgacctgtggcccctacattccaggggttaccagctgatgtgaatgcctgtgggtgagatctagtcctcccaaaacatgccacatgggcaatgccctccatagcagttgtttgaaaaggacctagtgctcgtctcccaacgatacattaatttttctcctttcagattaaatttaaataaatcattttggaattactctactaattgactatttggtcagttgttacaggagatgtaaatagtgtggcttgatctgggttttttgcaaatgagacatggccttttcccctctaaatgtgtctacacagttactcttaatttgcccattcattgccccatgtgccacacttgctctcacttaagtccctatcttctgggctagaaaacaagggcagggaaaaaccccagccacacagacatacgtgtgtcagcaaggagctaagcatggccaagggcggggctggagagaaggcatccaaattctctgtctaccccagttctgacaatcaaaagctgggtgtccttcgatgggccacttggcttctctggaactcagtttttctactttaataacgtgggtggcttagatgaggggtcccaaatgtgcactgttcacatgggtaccaggcaggcttcttaggagtagaaggcatggtggcaggcaaactgggagagttcctgggtcaactaaagagacagccaccacctctccctccagccaatgttgtttttcagaaatggagatctccagcagccagatccttcatttctcaaaagagaaaccccaaacctagagttttatgtgaactaccaaattcctacatcttggcaacaaaatcagatgtgtaagacaccgtgctatgcaggtcaaacaaaatgcatctgttgatctctaaagtaactccggttttaaaaccccataatccatacttatttattacagaaaaagagtgtgtattaaacagagaactgaatttggctgcataagacaggagttagagtcctggattcaccactgactcaaagaacctatcacctcgagcatctgatctttctatgaaatggtgtttgcaatacctgtcctatggttccaccagtagcctgtgaggacgaaatgaggtccctcctgcaaaaaaaaaggcctctatgaagggtagaataccatgtcctggttattcttattatccagaaattcttctcttcaccactggggaccctgaggcctaaacctggaacttaagcagctgtctcccaggcagctctccgaacacaaaatgcctgagacaatatggaaaccagatgcggagcaaatgccgccttaccttttttttttttttttttttcctgtgcttttgtacgttttcaaagcctttccacattcatgggctctgatatcaataaactcacagctgctctgcaaggctgttatatcaggtattattctattccagatgaggaaacggaggctcagagctaagaatgattgggtcaaggtgccagagaaagtacatggcacaagatggaagccctgtggcctagactgctgtctgctggcagtcctctctgggtggttgcctgctttcaaaagatgaactttctaaatataggcttaatgcacagggccctgtcctcagcgagctttgcagcagctgaagcatcctagtacatggttttggtagtgaggatggtaaaaacagcaacagcagctgcttctggtcaccaccacctcctttctctctctctctctgcccccaacccccctccccgacacacacaagagagagagagagagagagagagagagacagagagagagagagaggggaaatactatgttaataggacacttttctgtggcttcttactgcacattgtctggaccatactctttgacaggacttcccacctggtctagcctggtcctgtgcacctttgccctttgcaaccttccctgggctcatgctccctccctctctgctgaaccttcttgcagtaatacttgcctcattccctccctctttaaggcctttgcaccacctgtttcccctcagctcaagtgtcactgcctccaggaagccctccctgaagcctccattcttggtcatattcatctctcataaaatcatggtcctttccttcaaagcccttattcccatttgtgcttgtatgtttgggtgtgtgattatctcacttagttccatctctttcactgaaatgtaagctgcttgagggcagggcaatcagccctttgtattcaatgtcacaactccagcaccagggatgatgtgcagtaactatttgttgaaccaatgcataaataaatatgtgaattaggtaacatctacctcatgtaattctctccacacccaatgagatattatgaattgttattcataatatggattcataacaatggatgttatgaattgttccttgttgcaggggatggggagaagactgagagtctgagatggtcagtggcttgtccaaggtcacacagctagtaagagatgggggaagatttgactacaggtctgcccgatttccaaattttcaaacagatataatttaagaaataggggccgggcgcagtggctcacgcctataatcccagcactttgggaggccaaggcgggcagatcacgaggtcaggagatcgagaccatcctggctaacacggtgaaaccccatctctactaaaaatacaaaaaattagccgggcgtggtggtgggtgcctgtagtcccagctactcgggaggctgaggcagaagaatggcgtgaacctgggaggcagatcttgtagtgagctgagatcgcgccactgcactccagcctgggtgacaaagcaagactccgtctcaaaaaaaaaaaaaaaagaaagaaagaaataacatgataagcctctgtgttagccatggttttccagagaaacagaaccaacagtatgtgtgtgtgtgtatatgtgtatagatatacacacacatacatatatacacacatatatatacacatgaatatatacacacatacatacacacacatatatatattatggagggagagagatttatctcaggaaattggctgctgggcacggtggctcatgcctgtaatcccagcactttgggaggcagaggcgggtggatcacctgaggtcaggagttcgagaccagcctggtcaacatggtgaaaccgcgtctctactgaaaatacaaaaactagccaggcgtggttgtgggtgcctgtaatcccagctactcgggaggctaagccaggagaattggttgaacccagaagatggaggttgcagtgagttttcacggtgccactgcactccagccttggagacagagtgcgattccgtctcaaaaaaacaaaaaacaaaaaacaaaaacaaaaacaaaaagaaattggctcacgtgtttagaggtaaatccaaaatctgatggggtaggctggcaggctgaagacccagggaaacatttaaattcaaaggcagtccactggcagggttcctccctagtctctgttcaatgaaggcctcaactgattggatgaagcccagcacattctggagggtaatcagctttactcaaagtcctccgatttaaatgctaaactcgtccaaaaaaatatcctcacagaaacatccagaataacgtttgaccaactatctgggcactgtagcccagtcaagttgacacataaaattaaacatcacaacttctgtatacccatcactcagattcagccattatcaatgaaattgctacatttgctccagctggcccccttcttttctttttttctgttggtgaagtgttttgaaacataccccaggccctatatccttctatcccaacctactttataagtcaagctatccaactgcaaggcatgcccatagaaccccgcacctctaagagctagctcggtcctcaactgtgagaaacctggcctctcagagtgcagagaggaggcttcctgatgtgtaggcccaatcggcatgcccaaaaggtgaggtctgatttgtgagacaatttccacagtcttagaaagaagtttcctctatgccccagccacgtctgtttataacttgaccttggccaggggtggggttgggggcagggaaaaagacttgcacgttccactccagcaaagcgctctctgtttttccatggccatacattgttttcattttcatgttgcacccgcctgctccccatccatttattgctttctcctccttctcttttcccttcttcctccccctcattcttcctccctggctttgaggcgtctggacttttgcacaccagagaaagaaacctatttaatctaccatgtttacaagctgcgtaaacaaggtacagtgagtgaatcatggaaaaaatgcactttatgtgaaaaagttcattatatgactttgttctattaaaacagccgggtgtaactaaccccaaccagagaatttggaaaaaaggaaaaaaaaaaaaggagaaaagaaaggaacccctgaaaatgccctgttagcatttatatcttacaatttcacattagcattcatataatttctgctggtttaagaacatttaaatggagttctcctctagggagaagatatagggactcattttctgttgctttctaataatctcttccttaaaaatatatacatatattttttaaaattgtcccagtggatttaaggaaatagggttaaaaaccaaccgactgaattagttcttttcttgagttgttgagtaattggtcatcattcttctaccttactctcattttgtttgggtcttctaacttaataatttctgtgtcgttattattgtggggcttccagattttttttttttttttttttttttttttgagatggagtctcattctgtcacccaggctggagtgcagtggtgcaatctcggctcactgcagcctccacctcccaggttcaagtgatgctcctgcctcagcctcctgagtagcttggactacaggcacacaccaccatgcccagctaatttttgtatttttagtagagacggggtttcatcatattggccatgctggtcttgaacttctgaccttgtgatccacctgcctcagcctcccaaagtgctgggattacagacatcagccaccacgtcaggtccagatttttctatttttcttatgatgataacaatagcaagttattaaaatgcactggcactatgctgaacaccccacattaagaattttatttaatcttcacaagagccccatgagaatatggaggtattgtggggttaaggaactggccccagttcatggttaagaaatggtagcactggctgggcacggtggctcacccctgtaatcccagcactttgggaggccgaggcgggcagatcatgaggtcaggagatcgagaccatcctggctaacatggtgaaaccctgtctctactaaaaatacaaaaaattagctgggcgtagtggcgggcaccggtagtcccagctactggggaggctgaggcaggagaatggcgtgaacccgggaggtggagcttgccgtgagtcaagatcgcgccactgctctccagcctgggtgacagagtgagactccgtctcaaaaaaaaaagaaatggcagcactgaggcttaagcctcacagccaagcatcggcatcattcaagtctaattttctaagtaagaaaagccaattggaaacaatgactatgttaatagtcatagaactaactttaggacgtgggaatatgagtgacttttagtttcttcttcaaattttattaaaatttccaaattttccatagtgaattatggaatagtgcctttagaactgtttcatggaggaaataatgtaatcctgcctaggcttaactagggaaaacaatgtcttttatgaagtatctaaatacatctgagaggaaataatacacatctttgcataattctttgcatatactgaggtagaatgcggtgttctagggtgtagacgacctggactatcttaccatccatgaaggcaagcgctttccctttcctgggccccagttgttccatctgtaaagtgagactcatagactgaaatggctttaaaaggctttttcataaacttctttgtttatgaaaaaacctctttgagaccaaagatggcctctttgtcaccaaatattcaaagatactgctttatgggagctgatgacatccttaacaagtagaaaggcctttcaggcattttccgtccttccattttgtctgttgctttcaagacagaggtgcagacgggacctgaaggagtgagtagccaggctgaagccggactcctaggaactctgacaagagacacaggcctgtttttaggagacaccaaatggatgataccctctcctggggtgtggatggtctcaggctgctgtgaatggccttttcctcttcttcagaaacagcttcaaaaccttccttaatgacaaaacaaagacatttgcaaactgcatggttcagagtcctctctgctgcttcccagggggctgggttcccatgcatgtgtcccttcccccctccccccttccccgtgctgcaagctgcccttgttttaaaccaagagttagggctcagcctaggggcactgtcagcctcatctcagagcacctgggttctcaaggctggcaaatatctctcttcccaggccccaagagaggatgcagctgctctgcccgctaagctttcagcttaccccagcctctggaaaggaaggagggggccttgggctgcctgtgaggtggggcccaaagccagcccagagccctggctctcagacagaaacttcaccagcgattctgaggatcccatttcccaccaccacgcccagccaccttggggaagtcagcaccgagagcagtggaaacaaaatcaaaatgcaggcacaaataagatgaataatcctaataatttgagacatgccgcccttgctaaaaggaccataaagggcatttgtttctaattaaacaccaaaaccctaaacctttcaactctgcatccacaactactgtaaatgtttatgaaaaacgggaaattctcgtttaattcaaaccatgccagaaatgcattttcgttgtcttgaccggtggagaaaccctatcggccccagcttgagcacatctgagctttaaattgagaaaggcaacaggcctgcaagtgaagctgagtcctgagcaagacctgggtgaggaaacagcatctcctcatcatggccaactctcaaatgacaccagagcaaatgcttggagcgtcttccagaaagagaaatgggtaccagggccgcttgcaatgttagggggagggtcacagacgtctcagaaataaattaggctgcccagcaaaatggttaaaagcagaagttgtagagtcacacaacttggttggatcaacctcttaccactggggtgatgtgggcaaaatagttaaactttctgtcttgggttcttcaagaatcattgccacagttaagtgagatgaagcctttagtgtgacggcaagtgaacctgcaaggcccctgccttcatgaagctgacgggccaggcagagaagcagattaatcagcaacctgtgctcagctctagagtgtctccaggtagcttttccagtgccctctctacctgtggagttgctgaaatccgcgctgctcgctcagaaaacgggtcaccgaggaaagatttcagcaggaaagagcagcccattcaataattccaaagtgactgtacccagggacttgaggaaccttaaatgcctatcccccaagccccacgactgagctcacagcacccagagaccatcacaatgaaaagtacactgggctgtggaaactcccggggcaggaggaagctctgcctccttaatcagaggatggaagccctcccttggaaacaaacatttcaatttggctgagaaggacacagcagggaaaaagcctccaggactcacgtgactgcatttcctaactcttcatccagctttaaaaatcaggggatttcctttgctagtctttggggaggagggttaggacctaaaatctaggcctgagtaccctttctctcactgcatggatatttccactctaacaatgtcaacagcagcctttcaaaagcaaagagctacagcctctcagtgccccacatggagtcacgttactgcctgctaggcacggggttttgctccacagcccccattcaccttacttccaggaagacagaccaagttcccacctcctccactttctgtccagaagctcccaccacccccataagctccagacatagagcatatgactcaacttggccaatcacagcatcacattctctggcctgcagtgattcaatcaaatccagtgagaggagctgagaattttgctgaactactgcaggaaaggcacctgctctttgcttgtggatctgaatctggaaggatgatggctggcagccatttgctaccaacagagcctgaggaggtaaccaacacacgcaggacaggagagactcagggtggagacaaatagctcctgaccacatcatctgagcccctgggacccaccatgcatgaaggcgggtctcaatcttctaattccacaagccaataaatcttctcatttgcttaagtgattttgagctggtttttctttttgcttgcaaatgaaagagttgaaaaagggaagagctgaataggggatagagaagaggcaaaggctatgagtaagatcaaacaattatttactgcaagtctactacatgcctggcactgcactctgttcactatgggataccagacacacacatagacccagagtttacaatcttttaggagagatgagacatgagtttgagtgactgtaatataaagaaaaaatatgacaaatgctgtgagcagggaataaaaagttctgctgacacacaaggagtgagagccttcttctggctttaggccaggaaaaggattcatggagatggctcgtagcactgctttgaagagggctggaatttgacaagcagaatttggggtggaaagtggcagatggcccccccagtggaggggacagtgtgagcaaaggtgagagagacatgttctagaatggcagacatcgtgttgacagacaagcaccaggggaaacaaagggcagacatcaggaattctgcagggtcctggccagggccctcccttcctctcagggaacctcaaatgtctttgtctctatactgcagccatattctggctgaagttctgtcatcttgggttgctgagggaagggttttctacaacagatatcagcctgcaaaggattctagcttttgcttctcctggccaccccttgggggaatcctttatatattaagtagttgccatgtgagatctactgccactcaaagttaaacagctcagttggcactctccaaagtctgcttccagcataaacccatgccacatgggcaaaaatccatttgggaaaagactgggaggagcactccagtcaaaaccttacatggtctgatccctgccaacctcttctcactccatggccccctctgctttctgcattccctatggcttccagccacaggacctttgcacatgctgttctctctgtctggaacaccacccttttacctaagcaactccaacttatctcttagatcacaactcaattgccacttcatcatagaagcctttgctcgtggccctccagggctcaaggcctcccagtacaggagttaaagacaagggttccagagtcagaatgcctgcgttgaaattctggctccagtgcttactagttttatgacctttctgtgcctctgttttctgatctgtaatattggctaattaacggagaggcttgataatggcaatagtgttggcagataacactgaatgaacatgagctaccatcatatgatttcagagcaacttgtcctgcctctctgcctagtcacagttgcaagttaatgcattcatgtgatcctttgattaacgtctgtctttgccaattgactaaatgccctactattaataggtagaacaatgtctggttttgcccacctctagcacttagtatcctgcctggcacgtaatagatggcttaaaaatatttcagaaatgcaggtatgaataaaagaacccagagtggggaaaataaggtcccaaatattcttatatttgcagaaaccctgacctcaaaacgtcactccaaataaccaaggagcaagacctcaaaagttgcaaacatctgtggtttcaaagatgaataaaacaagttccaaaagatgctccagccactgaattcctctttagcaattcatttcctgaaaagtggacatgaggctggagtaaatgtggccagccaaccagatgcaatgctctgaagttaacagaagtttgtctgatgtgcatcaaatgactataattccttttctagtatccctaacagttacagagaggtttctgtgagtgtggcctttggcccagattttaaataatattatgctttgctgcaatgctgttttctgagagtttacatctttggggtatgtttttaatatgcgcctcataatgggccaaattctcctctgagatccaagctagatctcccaagtacagactatgttatagatctaggggtaaacagtggtttccatgtcaaacttttgatccatcattattctgtgatcctccaggaagaagggctcagatgcagatgaccaaaagtgggtacagtttgcagggaggcattagtatttccctttgcaaaacatgttagtcccacagcaaggtctggagacacagttgggcaggctgagagagcaggagacccagatgctggagccctcaccttgggatttaccaaggcatgtggctccaactgggtattggttttccctggagcagggcatggccttttaaccagttttccctttttcatgctcccttaaaccagtccagcatctccctatgggcctggaccacagagatgcctttcttcctgactcctgagccttctgaaagtttttccacatttttctccttccaagaaagcaatggttctccaactcagaggttctgatttcaggaagcatctgtggagtgtagctctgagaagaaagcacccaaagtggtgaagagtagtgtgtgcatgcacttaaggcccatgccctcctagggcaggactgaagccatagctccaggtgcctgtaaaatccagaactcacaacctcagggttcctacctctctacctcattttaggtctcaatagctatctgtttagcaactaagttgttggtttccaccatgctacaaatcaaattagtgacatcagacaacacatgtgtccccaagagacctggcccatgaagtaagactggaagtccccaatggatggggcctgggcactgtgctgggctagactgtcaggggtgcaacctagatccctgcaaaactccccatggagcggcctcagaggacaacaccctcagtctatccatcaatgtcctccttgcctttggcctctctccactggagatgtgaacaaagagagaacaagagagattaatttctttttaatccttcctttctagcaagggcttgacctcaggctttggcctgtttcagcttctccccaggcaagaccatatttcacgctgaatcatcagtttctggggaaacagagcgctagcccacagcgtacggatggccatgctatcttgaaggagcccacaggggctgctcagacattatctcatccatccctacccttggagcaaggtgggagcaaggagccgttatcttggttgggctgctgaaggaactttagcccagagacaaggtacttctccggagtagtgcagtaccaggcccttcctagctccaggaaaaccctcagcagccccttgcttcttgggccagaggaaagcatggtggtgaggaaccctgcagaccttgactactcagctctgccactatgtctcaagagcagccataggtcagtgaacaggtgtggctgtgttccaataaaactttacttaaaaaaacaggcagtgggctgacattggctcacaggccacattttgctgaactttgcccctagtataaggctatttcttgctcaagaaatgatcttagaatgtcaggttggagcaaggtttctcaactgcagtactattgacattttaagcctgataattgttgtaggggtctgtcccatgcaccttggtctcctggagccctaagctgccatgtaagaaattgcactacccagagagaaaccacaggagaggctctgagagtacatggagaagagggtcccagaggtgcccagcctgcagctgaccccaccaaggcccttggcatgtgactacagccatcttggatgctccaacccaggacagccaccagctaagtatcactgagggaccacactccgtgtccacatggagtcaaacttcccagcttagtgctgatggaattcctgacccataaaattctgatatgtaagaaaatggttgtttaagccaccaagttttgggggcatttgttatacaacaagaggtaactggatacatttcagcgaagaatgagaaaaatctgtcatttagccaaaaatcttaccaacctaggttagaaatctgatcaaaggggaactaaatgatcagaaacccactgtggtggcagaatattaggtcactgtcttggcagattattggcccagtaagcccctaatattcctttagtgagtacacggaacctcttctcccaacaagactcggcctttttggggagggccctccacacctcctcttcatggcttgggaaacctgaaagactggctcatcaatatatcgatggccaaaggcaaacatggcttcaccagttcaggcagaagctttagatgatgtcggcacagtcacagcagaaagctcaccaaactactgctgcttttctttaaaaaaaaaaaaaaattaagagcaagaagaaaaactttgggctagaaatcagacatcttgggatttctatcaccatggaagatgacaagctatatgacctttggcaaatttctttacttccctggtttttcattttttccgtgtgtccattatggctttggacaagctcagaggttttcatatctactttttggaagcccacagaaacccctcagaggctgtgggtgcatttctgtgggttagagggtaggtaagagggaagacttggcaaacggggctccaagtcctctagcttcatttcactcaaaggcatttatgggcatttgtcagaacttaatttgaaactgaaagctaaaccatgcctgcacatcactggtcttcacagtttgtaaggtccttctagaatcctcatccctaaattctctgcccctaattttgatggggaatgaatgtggcatttttgtgtatctattttccccactgcccttttcagaaaggtaggcatggtgggctactcgctttttttcttgccctgtatccatcctcccttctaataatagcacccccaatttactctgggaaactatccaaggtctactctcagtccatgacccatctgagtgggagcatgtgagcagacctggtctattaaaatgcagcatccccttggccatgccatattattaagtcatgaatgggcacagaacctaagccagcccaatgagagtctgccctgaattttcactggaaccatcataaaagtggctatctctttgtggaattgtagaatgctagcctggagttgacagaagccatcctgccacctcaatgtgaaaggcagtttaagaatgaatcccacctaaaggagtggaaagccaagtgaagaagaaaatacagcatcttgatagcatcgcctgggctgctggattgagctatacctcaaggcaataggtccttggattttctagttctttaagctgaaaaattctcccgctgccttctttttcttttttgagacggagttttgctctcgtttcccaggctggagtgcaatggtgtgatccctgctcactgcaacctccaccttcctgggttcaagcgattctcttgcctcagcctcccgagtagctgggattacagttgcccgccaccatgcccagctaatttttgtatttttagtagagacggggtttcaccatgttggccaggctggtctcaaacccctgatctcaggtgttccaactccctaggcctcccaaagtgctgggattacaggcatgagccactgtgcctggcccgctgccttcttttttaattaagctaatttgagttgagtatttgtcacttgaaactaagtatcttagctaatagaagaagtaaatacagtttaattgagtctgggatgccatataagaaaagtccaagtgttttgcatactctgcttgcaaagaaaacaacctcccaggttggtggcctgagggtttgtgcaacaccaaagaacaccaagctcagccagcccaattgccctcccatcccttttctttttttttcatttctttccagctgcacggtcttttatggagcccatctttctaagacattcaaaatgacatgctattggaagacatttctgtccatgctaatacctgtgtttaaatttttttgttgttgtttaaaaaaaaagatcatgatatgatagcaaatgaatgttggcaaattgccaactgacaggtgtaaaattttatgaacatgcacattccaaaggaatgtggaaataagccatccactgtagtccagtttggcagaaatattacaaaaatataagtttggcatatattgtaattcatttaaagatgcttaaaaacccatccatcaaccttgcacagaaggtcaaagaaacacatgaatcccaaataaacagcaactgatgtacaaggaaaaggcctgaatatcagctccagataccagagagactgtacacatatgaagaggatgaaggtgctgtttggaaggctgagcttctaaaaccttcattggtgtttaaaaagaaataataatcatttcttagcagtaagtaaggtggactgttgccctctgcgtggccatcagaattctgctcctctgggagaattttgctgaagaattggtgagtatgcatcctgagtgtctttccttttttttttttttttttacttcaaggaccatatctgcaataatcaattgctctcacgtatttggtacctggacactcttcactttgtcacaagcatgaagaaactaacttacttcttcccagccccaggatgggctcccaactgggacttggccagtgtgattactcaacctctggtcacagtgatgggttcaaggttgggtaagtgctccatttgagtcttccatgagatctgataagagaacactgagagagagagacagagacagtgacagaggatcccttcagaatccaaagcagaaagggccacggaacgtggagaaatttctatctttcccccagccatctaaagggagcttcctgtagaagggaatgagtccaacatgcagagagaagcagagaagagagatgaatgcaacaggggtgggagagatggaaagatagagagatagacagagacagaggcagagagatctgagaaccagctgtgcctgccaacagagccactcctgcctgggctcctcagtaacattagccaataaatattcttttcagcttcgtttagttttgagctgggcttctgccacttggaactgaactaattttcactgatacagttacccacaatatttgcagcgtgatcaagaccataagagaagttggatacaggaggaggatgacacggttcttacttcaaaggaattcacaatctaatttgtgttcagtttggtaatggtttgctaagcatctattctgttctaaggcgcggtatctggtgactccaagatcaggatgacacagatctcatcctataggatttccctgctgagcaatggggtggatgtctgcctgatgttttgaagacggagagatctgttattatttggaactaggaaggcaccattctgctggagaggaaggtgaacaaagtctagaggaaatgaaaaagcttggaggatataaacttggaagtctagttagagtatttcataccgtggaaaattatttaaaagagattgcaaaatattcatgcttccctgatgccctctagtccccaaattctaaatggcttttttccacccataatttaaccagttgtgaaactgaggtgcgctttatcataagttgtttaaatgcttgagattgagcttccctgactgtaatatgggaataatactcacattgcaggattcttgtgacagagacactgccagctgtccactccactaagtacaccgtccttcttagttatagagtttgttactttcagatggacacacagctattagaataatgactacatttcccaggctctgtcacagctctgtatagccatctgtctaaattctgactaatgaaatataagcagagggactgcaaatagtttctaagaagtgtccacagaaagaccctccctctttgacccatccccattcgtgtggccaaaatacagccactaaggctggagcttgcgagcaaccattttgactcagaaggcagaatccatgtcctaggacagggatcagcaaatgttttccataaagggtcagacagtaaggatttctggctttgctggccatatgttctccgtggcagtactcaactctgctgctggaatacgaaagcaaccatgcataatatgtaaacgaacgagtgtggctgtgttccaataacacttcacttataaactcaggcagtgggctgcaggccatagtttgctgacccctttctctaggatgggagagcagcaggttaaaggaacctgggaccctgatgacattgtaacacccatcacccagacatggactgcctcccaccagatttatatcatataagaaaaaaagaagtttcacaattattttagcattttctgtcatgcgaagccaaacttaattctaattaaaatagttgtttaaggaaagaataagtgatgtatataaaatatccaacataaatattagaaacaaatggatattgaataaaataggtatttcataataataaccagatagctgtattcagaaaagctttaacccacctctaagttaagaacatagtggctgacgggtactggaagcctgctgggaagagaggagagaggtccaggccacaggcagagtgtcccctttctgccctttgccgtgcacttgtctagaggggtcagtgaatccacgttccacctctgcatttccctctaatatatcagcatggtactccttcccagcctgctgagatgctaccatcaggactatcataaaccactcagaaaaaaaaaaagtgctaaactttattaaacatcataaaaaaaatgtgatggcctagatccatgtaggctcacttgggttagagtgcccaggcttggccgtaagtcactctttggcaaccaaaaccacatgaaacatcgtgttgaaaacttgctaaatcatttgtcactcaaaggcttttaaaataaaatactttcagaaataatcatttgatttcagactctgaactgcaggctgccctgagatggatgtaaatactctgtctgcacaggcacattcaatagcaactgaaagcagggcgagtcaaaagtcttttgctgctaagtttcaaatccaaaactacacttctctcaaattccaaatttcttcttccttatatctcaaatgaaattgttgcacccagcaaggaggcagagtggtctcttagcttggggggaaatgtcttagccactgagtattctggctctggatggagtagcttgactttcactctatgatggactccattcattgaacttcctatggtatatcaagagcatctacttggtcctaacagtgtgagttcaaatcctggtttcaccacttaccaattgtgggactttgagcaaacccataatgtcctatctgcgattgtataggtacatgaagaattaaatccattcattcattcaccatgaaaaatgtttttacacacgtactaagtgccaggtactatttgatgcgcaaggaacaaagtaggcaaatagcctgcatgtatcaggcctggtgcaaagtaattattcaatgaatgcttgctgttactatgctggtaattctatttatttatttatttatttatttatttatttatgatggagtctcgctctgttgcccaggttgaacaggttggagtgcaatggtacaatctccactcactgctacctccacctcctgggtttaagggattctcctatctcagccttctgagtagctgagattacaggtctgtgccaccacccctgtttaagttttgtatttttgtagaaacaaggtttcaccatgttggccaggttaaattcctgacctcaagtgatccactcgcctcagcctcccaaagtgctgggattacaggcatgagccaccgtgcaacagattgttgttctattacccaggctggagtgcagtggtgcaatcttggctcactgaaacctctgcctcctgggtttaagcaatcctctcaccttagcctcctgagcagttaggattacaggtgtatgtcaccatgcccagctaattgttttgtatttttagtagagacaaggtttcaccatgctggccaggctagtctggaactcctgacatcaagtgatctgcctgccttggcctcccaaagtgttgggattacaggcataagccactgtgcctgaccgataattaattttcaaaatgtatatatatatatatcagaccatattccaagtgctggaaatccagagcgaaataagagaagaccatattctcatagtacttgcatatggaggggagggcaggcaatatacaaatatgcaaacaagatccttccctatggtttattgccatgaaagcaactagccagggttatgtgatggcaagcaatcaatgatggagtggtgaggagagttgtgagttggagaaactgcttgaaccaccatgtgacaatctggaggtaagcactccaggcagagcaatagacctgcgcaaaggccctgaggccagaatgttgggaaagagacaggaggccagttaaacaaagggaagagtgaaataaggcaaggttggaaaggtgggtaggtaccttatgggacatggaagtcctcataagtcatttggattgcatccaaataaaatgagattccactggagggtttttagggagagcttgatctgattttcatttcaaaaactggtccttctgagcgtatagagactacggtggaagcaggactcagctgggaggtgatggtggcctggagtgggtggtgaatggtgagatggtaagaaagggacagtggtgaggctgacaggaggtgagagaggagggagaggtgaggatgatgccaaggtttttcaggaggaggactgcatctggagtgagggtgagaaggcactgagaaggagatttcccagtggccaatggaagcaggatccggggccctgatcagggctttagagtcatcacccatgaagccagggggagggatgaggtcaccacggtgattagtgaagtaacagacagcagcctggaaaatttccttccggccttttctctcataactgttttatcactatctggtgagtttcactcctggtgatggcttccctctttgggcccttctaatctgtttccttttagaaggtggctgttttcagtggtttttcatttctttctctggactaattttattgctcataggcttctcttcagctgccttggcagggagatgctgtatattaaaatagttattattttattttatagctcagttgaatctatattctgctcattacaagtgtataggcctcactagccaagtacatttcataatggcaaactcttattgagacagaaatctcatgttctctcagtgtctcccaggaggttgccctctgaattgtgatgagtggtatgtgggcacgaggagcccacgggttggatcagtgctagttaaatcattgccctggttcaacttggccggggacccatgtggtctaagctcagagtgatgaggaggtagaagaggagtcatccagcaagcaatagttagcaggcatctcaaaattaatatgtccaaacctgagctccggaacatcatcatttggcttctcctgtaatcttccccattctggatggcggcagcctcactcttctggctgctcagcccaaaactctggagccatctttggctcctctttccttcatgttccacatccaatatttcagcaaatactattacctttcacttgaaaacccatccaaaatccaactgcttccctccatctccactgccatcaccttggtccaaaccatcaaacgtctgttttctgtattacttcaatagccttcctgcctttgcccccatcctgtttattctcacagagagaaatagccagagaaatcccattcagatgaagccagctcaggaccaacatctgccaccatcttctggtgacttccctcctcgttcacagtgaaagcaaaagccttcactgtgacccatgagaccctacacagtctgacctgctccccctctgacacgtccctgactgctctacctatcctcgctccactcatgtcacgtgtcatgaacacgtgctaggcacagtctcacctcaggggctttgcatgtgctcttctcactgccaggaaagccccgcccctagatatcaccaaaactcgctccctcaccttcttcaggccttcactcaaatatgacattctcacggaagcattcccttgggcctatacaaggaacttccaggtaatgtggttgagggggaggggctgcacattacctttgaacccacttcaaggaaatagcaccaaaactctagaagtcatcaccctcagggagaaagaatgcttatctataagaagcctagcacacaacagcttcccaacctatctgattaaacaaatacacatgaagaccgcatttggcggcaagaaaggattaaaaaaaactcctccaagattatcttgggctaaatctgaagaaggaatctgcactccttccattccgatggcatgtttaagttcagtggctgaaaaatctgcagaaccagttgggtccctatgccgaaggggcagggaagaggcatgcgctgctctgccaatggggaggaaaaaaatttaacgagggcaagataagagccagacgtgtggaaatatttctctttgaggatattctttgtaccaattactcttcaaagatatcatgttagcatttttggcacaacttgacaattaaattagacgaatcgttttcagtgtttttgcatttgatgtgcctgaaactcctcttaagctaaaatgttcagcctgtcacacacatttttttaaactttggcaagtcacatcaacactgatttcaattaagtcaagaatttaaaaacatttcactactcatctttttaaaaaattacatgacatataattaattgggtttgatgatcatttcgtggtgtccaaagtttggggatagaaagaaacacagtcaataaatttctattttggagatgacttcatttctattttttttttttttttttttgagacagagtttattactcaggctggagtgcagtggtgcaatctcagttcactgcaacctccacctcccgggttcaagcgatttctcctgcctcagcctcccaagtaactgagattacaggtgtgtaccaccatgcctggctagctttttgtatttttagtagagacgggattttatcatgttggccaggctggtcttgaacttttgatctcaagtgatctgcctgcctccgcctcccaaagtgttgggattacaggtttgagtcatcatgcccgaccccccatttcttatattcattgagtctctccatttctcccaggagccaatggggctttaaatctcccacccgtctcaatttcatgctccaaaattggttcttgtcctggtacttctggtcccagctcagtcataggcagggtagggcagcacgagaggctgtgctgaacgctggaaaggcccccaatcacagcatggtcacggtaggaagttcggccagaagagaggcgaagtccacatcttatctccatggttggagttttcctcttgctgatgtgacaaagtaacctgacgagataatgatttccaggttggttccaaatggtctgggatgaggtgagtgcagagggagggccagggggagctgcagccggatgatgcatggggctgttctgcaggacatctctcccaggagttcaaagggttctgacgatattctctaactcaccactggcatgcccggggaagaacagatggtctgtggtcagataaaccacctagactgggatgtgattagggtggtcaaggaaaattacaaaaccttggagcttccctttccttccccaacttctggcctctgcccttacacaagtcttgttttgttttgctttgttttccttgcttttgacaggctccaatttttcattttagtttagtccattttgaccagcattaataatgagaagtgggccgggcgcagtggctcacgcctgtaatcccagcactttgggaggctgaggcgggcggatcacgaggtcaagagatcgagaccatcctggccaacatggggaaaccctgtctctactaaaaagataaaaattagctgggcatggtttggcgtgcccctgtaataccagctactcagaaggctgaagcaggagaattgtttgaacccaggaggtagaggttgcagtaagccgagattgtgccactgcactccagcctggcaacagagcgagactccgtcaaaaaaaaaaaaaaaaaaaaaaaaaaagtaattcaatgtcttcttccctactggttagaaaactctatgatgacaagaatcgggtctgttttgtgcacaactgtgctcctgacagcctagctgtagcaagtgtggctttttattctgatgctgtgacatctggggccttagggacctgaaggacactgcctctcctagggctagctaactcctagagatagtaaacaattttgacttggagctcaccttttatatgcaaaccaatcaatccaaagccccgaccccaaccacttcctcccttctggggctcttctaggggtctcacactccagaccattatttccctgccccaatcaccctgggaccaagcaccagacagtgaggacaacaactacaccccagagtccactgaaattattcaagctagtcagttctaaacctgctcaccctgccttgctcgcctttcccacaaaagccacaacaaaggctcttgcccacgttttcccctggctccctctgctttctgaccaaacagaatagtcaaattctgtggagtgttcagaagtgtttcctgagtggtcctgcatgatgtggtgtgccttcccctcttggaattgtgagcaacaaatcatcttttcagtggcctcaccagacctgattaaaaataaaacctacattctaagacactagcacagggcctagcacacagtaggtgctcaattaatacctgcagggggtactgaatgagtctttccttaaatgtaaaagtccacaaaaacttcctggatactgttccctcttgcttcagccttgtccttccttacaagataatgtgaacaccaggccacctacctgggccgaaattcaggtgttccctctagacccagggagtgcagttcttcctgccacccgcagggtctgtgcagcccaggaaggcaagactgacggcgttcctgagggaggtggcgttgggacagtgaaggggcatttcctggctgcctgtcatcatgaggcattccagctagcgaggaaaacaaagacagcggccagggagcgtcgccttttatggttccatcctggctgcacttcaggagcagcccagaaagtggcctgggagacaggcaggctttgtcacccacttctgttcacctcggtccctgggccagcagctggagaaatgcttgtggcccggccagctagaggcacaggaacccaagggtgagaatttgatggcagagggaacacccttcctggcggtgtgctttcctcaatcctcaatatcatctcccacgagcacccatgtaggcaacaaaaagaaggagctgaagcaattctatgcttaaataacaccaggggccattttttggaccctcaggggatatctggaatcttctagaaaataacgaatatttattgagcagttattttacacaagctcctacatggagcactttgtattcttgacagccaagtctcacaataatcttgtcagcaaccccattttcagatgggaacacagattctgactggggctgggggacttgcctaaggtcacatagtgaagggtggggccaggtgtaaacccctgctatctagctttcccttaccctggagggcctccctccaatagtcaaattctgttaagtgtttaaaagccttagctggtgacctctagggttctcagctgctctctcattacagtgaggcagttgcccccagatgatcccactaaggggttttttctactctatcactttaattcagcaatcaacacttctaacaacacttctaagtactgcaggtcttcctccaggagctcagaaaccccagggcctctgaaaccccctttatatagaggctgtgtgaccttgaacaagttgcttaacttctctgggcctcagaaaagagaacaggtttgaccgcaaaacaccaggcaccttccaagtgttctccacttataccacctccttccccatcaacagtcttgtctcaaagtaaatatttctggtatgttatggaatgacaggacataacacagaaagatgtcggtaagaaatgggctttggtatggaacagaccaaatcttacctccaatgtttattagcaaagtatttagttttctctgtgcctcagttccctcatcagtaaaatgggtatggataatagcaattgttttacggggttatttgagaattgtctgagatgatgcatttagcatgaagccaggcaacagcaagcactcaataaatgttagccagccatttgattgttgaactttaagattcacttttctttttttgcatgcctctccatctggagtgatgatgtgaagagcaacagatgcgaggggggccaggatagtggggtctgcagcagcagcaccaagaggcaatgtcacagctagttggaggcaggccctgatcaaggaaaggctggggtaggtaggtgacacactgggccgctcctcatgtggttcgtcacaatttttatgactttcttttccatttgcacagccaaggagtcttcctccttagtcctctgcttgccagagtcagctgcctggaccttcctcagcccacatgtccctgcctcatctttaatgtgagtgcacacagttcatgcagcaatgaagcctgccacgtgccttcagcctaagtatggattctgtcaacacacttttctggagtgatgaagagccgtgaatttccatagtcctagactgcaagatctccctacctttaagtttttctgaattgagaacatagcttttatttgatgagggcacttgatgtagcgcttctcctcatcaccaaacagctgtcaataaatgcaagaggcatttaaaaattgagggaacacactcatttatccttgcatttgtacagagattaaatgctgtcctgccagggtcagtggcagtaatcatagcagttattgctattattagaagctacttggtgtcaagttttttcaaaggcccagggctttgcatgtgctattttttatcctggattaggtctggttattctcatgtgaccaatgatgacactgtggtccgtacaggtgaagtgacttatccaaggcttcacagcttcatagcctgggatttaaacccaggcctgcctggcttccagattcctcctgtttcatccataccattcggtggttgctattttctctgtcaattccctaatgaaatcttgggcaggactttcctttgccaaagtcccttgataaaacaaacttttatctcccaagtcatctggccgatgcatgaggggatgtacagaatggaccttcctaggaggaatgagctctctcacactagatatatccaagaggaaggacgtgccctatgaaaggggtgccaaggaagattcctgtggccttgggaagagctgggatggggggagataaaatctcaggtctgttacctactagttgtgtgaccttgggtgaggcactgtgcctctctaaggctctgctggctcagtattctgcatgtgtgcattgaggacaagagtcttgtagagccactgaggatttaagaagtttgcagggtgatgctcctaagagggctcaagtgatggtggcattgctaccatgactgagaaggctcgagttgatcactgaggctgtctctgcaagctccaaagtcccataagttctcttcagtgagtcagagcctagattaactatcacaagtgccctccagacacaggccagaatgggccctctgttttcctagggccagttctaaacccctagctgaccccactgccatgtaagtgcccgctcatccatggtggagaaaccacacactggaggagtggagacttctgggtcccctggctgaactactggctcacagaaggtgcactttctttctttctttctgtttttttctgagacggaatgttgccctgttgcccagactggagtgcagtggcatgatcttggctcactgcaacctccgccctcctgggttcaagtgattctcatgcctcagcttcccgagtagctgggattacaggcatgcgccactaagcccagctaattttttggtattttttagtagagacggggtttcaccatgttgggcaggctggtctcgaactcctgacctcaagtgatctgctcaccctgcactcccaaagtgctgggattacagttgtaagccaccacactcagccagaaggccagaggtgcactttcccaccctcttcctggtctgaccaccccagggttcttctgaccaacagaatacagtggataaatggggtcctgttaccagactgccttggttcaaatcttggctgctttactctgactagcccatgtgacctcttgaaaatcatgtaacctcttgattgcatcatctgcaaaatggggatgatggaaacaaacccagcagggctcttataagaattctttggagtggatgtatgaaaagtaagtaggacacagaagcccatcattattatggactagggtgctgggcccagttcctggccccagagggctccccaccagccaccatgatccctgtaggttgccctggctccaggccttctccagctccactagtggctcagctgaggggagaggaaggaccaagggcaccaaatttaccccctggctgaaacagtacagctttaggggaaaaccagagtagcaagagcagtcaaaccctgcctgggactttgtgccaagccctgggctgtgcattagacacatctgattgcttgaatcctcacctttataaacaagcacgtaggtacttttcctatccccacttacaaaggagtaaactgaaactcagagaggctgctcagtgatttgcttaaaggtcacacagttagtttataactaagctatttacctctataaaattctccaaaataggttgggtacggtggctcacgtctgtaatctcagcactttgagaggccgaggtgggtggatcacctgaggtcaagagtttgagaccagcctggccaaatggtgaaaccctatctccactaaaaataaaaaaaattatccaggcatggtggcacacctgtagtcccagctactcaggaggctgaggcaggagaatcacttgaacctgagaggtagagattgcagtgagctgagatcacgccattgcactccagcctgggtgacaagagcaagactccatctcaaaaaaaaaaaaaaataaatccaaaataaaaacattaatggaggccctaccatgcaccaggaactactggcagtttatacagattagcacacttgatgcccaaaataatccttcaggggaggtattgtgatgttattttacagatgaggaaaccgatgcttagggaggtaaaggggcctgccccagagcagtgatgcagcagggctcaaacccaggtctgccaggctccaggcacgtgcccttagcatatgtgtgctgctgcccaagggcttctcatcccaatttccagagcaaaagtaggaacatggcttttcctctgaactccgagccaagccaagagatagagaagcagctgcggaggaaacccccaccttgcatcctgcccgttagctcacagccgtcccctgtatctttatggcctgggctgacggccccgtcctcgtgcctagcccctcagcttcctgcccgaccccaccatgtcagaaaactgcagctccaaagtggcaacaagagtcagtcacaccgcatcgtgcgagggaggcttgggggaggatcttaggctgaacccaagctctcagggccctgtggcctttcctgagccctgttcagagtcctggcctctctgtccagaggagagtcttgccgtgctctgtcttagacaagtcgaggtgattaaagatcaaaagacaagctaagacgtctggcttgccaacaggctattgtctgccctgtcctcagcgccaacttccaggccccagaggcctgcgatcagcccctctccacccgatcaccttttctttcacaactgatttttaaaaaaatcccctcctgctcttaattgcatgctgtgtgttcagatttcctgaagttcatgaactgctgtgaaatttaagacaggtctgcattcccactgcattgctactttttaattctaaattccacccaccttccctaggaaaaaaaaagagaaaaaaaaaaatccaagctgagtgaaagaaaatttatgccagttgaaaggagaaggccagccttgaataattctactaataaaagggcagtgagagatggggtaaaaataataaggttatatcctcataaagttccctttatttgtgattcccgaggcacttggggaatgatagctcatcagggcagggtcccaaatgtagcatctgctccccagcggctgcctctattgctctgggtgctccataaacactggatcacagcaatcacaggcctgcaaggtgggctggtgggaagtacaaaccagaggaattttatagcaggaggaagaggagccaagaagcctaaagacatccccatagtcaccagataagtcaggctgaaccccaaacagaccccaggcatgcaccatactctaggccttggagaggaacctgctaggtggtggccacaggttcttcattaagagatgctccctaataacaaagactaggtcctagagggcttcatgtaacctccatgttcctgcgaaagaagaagggcacctctcccgatccactggagtgaaaggaaatggaagaggttgtctagactgccacagtatgagttggggtagaaaattgagagaagggctttgctgaggcaagtatttactaaggccctactctgtgctgggcactggagagggagagagaaaggggacgtggcccccactgcagggagctcaccaatacatgggaaacctcactgggtaaacagcaggctctaaacaaggcaggatatggcgaattctgtagcaagcagagaggggccttcccacttagggccatcctcatctgagttcccagcatctctcatctgacttctgcagtggtctacccactgggtcttccaaatttactcatgctgccttgcagcagcctagaaagttaaaaatgcaatgccaccctcttgtacagagttgtcaatggcttctcccagcacttgtaccaaaatacaaacaccctacaggactccatgaggtctggtccctgcgactctcccagaccttttctcttaccagtccctaaagcccacctcggggccttccacacacttcactgtgctccaggaaagctcttgccttggctcctaccacagtctgcacctcctttcattgaagtcttggctcacctgtctcctcagaaaggcctttactcagcgttttatctaaagtaacctggccaagtgaccctgttttattccctgcaaggcagatgtccttatttgaacttctctccttataaaaaatacagtgaaacaaatactatctacttacacattgcaagtctccctgtattagttagctattgctgtgtaacaaatcacctcaaatcttagtggcttaaaatagcaactatttattattgctcatgagtccacaggtcagttgggtgatatgtcttgtcttggctgggctcactcatgttcctctataagtggaataggtagctgtgctgatcttggcagggctctttcacacatttggggcttggctggctgtgacctggtctagggtggttttggctgggacaactgggctctcctgcacatggcctctcatctaccagcaggctagcctaggcttgttttcacatggttaggcagagttctgagtgaggggtggaggtgggagtggggagagagacagagagagagcttgagctcttgaggcttaggctgggaagtggcgtactgtcatttctactacattctgttggtcaaaggaagtcttaaaaccagtctaaattcaagcagagggaaaagagagctatatagcttttcccacttctttatgggaacagttataaaatcacactgcaaagggcatgcatataggaatcctgaaaattggggacatttttgcaattaacctaccatattcttctacaatgtaaattctacaaaaggacagacctcaatgagcacttgccatgcatcatacgcattttacccatactttgtatagtatatataattcacaatctacatttggtacgtttttcaatttgaaaaaaaaatggcatgaaccccttaataacactggattcagagacaaggttgtattctgggttagacaagttacaacaggcatctgctatatggagttgttctatgctgggagacatatttgccccatgggatatcaaaatccacataataacaggtcatgttataatgaggttttgctgcacatgcttgctctcaatttagacggcaggacctgccaggtcttcctccagctgctggcttcagacctctctttccagaaggataagaactacctgtcaaaatgcaaagctctaacaatgaaatatacagcgcatgctgtgggaaagccctcggtttacttccacaggctgcagctggtgtgcacggcagaaatgattcattcttccacccagcaaaacaagtccgtttacaggatctcctaaacagaacacatcctcaacctttcacatgctgcgcactcggctcatgatttaacctcctttgcgttgaagagccacaggctcagtgctggaaaagaatgctccttcctgcattgctgtctgctccaaggcaatatactgttacatttctaggaaatcagaatgtcttttaaatcctgcttcaagtatctacacattccatgctaagctgcaatgcttaatttaatatctccacggcagtggtgagggtttcaaatagagtccacagcctcagggacataggaagagaattcaaaaggtgatatgatagtttgggatgattgtatttaggttggtgcaaaagtaattgcagtttttgccattaaaagtaatggtagttttgcaccaacctaatatatttaagaagtggcaaaaacaccaaagtgggttttgccaccattgccaaaactgaatgtaaataccacttgacagcaataggaagcatattttttttttttttgtcttggggaagcttgaatcctactgagttcaatttggggagggggtagtgctgccagaggcgaaagaataaaggctaccactttgcgaaaatcttgagggcaagaaacctatttcagccacaaaaatacaaatgtcttttcaatgtcaggaaactctggaagaaaagacagaggatgggaccaagagagaccaaatgcatttcctttggaaatcactgcctggatcaggggtcctcaagttgttaccaactcccacaagagccctgaaatcatttctccaaatcacaggtgctaattgctttcataagggtgctggctagagcagaacccaagggcttggtaagtgtgatattctcatttctctgggcttgtgtgatgcttgagtttggaaggtaagtgtctggattgacttcatatatacacatggtcctagagatgcttatctttttcaaacccatctgggaacattattggtttgttaattcattaaatacatattgaatatgactcatgtgtgccaataacttttctgggcacagagaacacaacagcctatgtgcttgcctacatggggttctaaacaaaattgacattgaaatacatagtattctagatgatgataaaggtctaaacaaaccagggaaagggatgggggctatttttaaatagggtggttagatgaggtctcattgagcagataatacttgaacgaaggcttgaatgaggtgagggagtgagccaagtagttatctgagggaagagaattccaggcagcaagaaaagccagtgcagaggccttgaggcaggaggtgcctggcctgtttcaggagcccaaatgtgctcctctaactagggggcagtgctgggtgactctcactgatttggttggcccttgaaggagtcagttttaggatgagcatctcagaggggaaacaaaggtactatggtattatcaatctttctcttttcaaatgcttaagtcctaagtctcccatcgccacttcctttaaaaaggaaagtaagggggaaagaaaaccatgtgtctgaaaatacccatgcaataataccatttagcctggcccatggggaaaaaaggtgagacatctgggggtcatccctcaaggtgagtttatatactgtgcagattttttaagagtatggtacagtaattacactgatggctgattaactcaggggagttacccagaggtgaggtctttagatgtgtagggagaagtctgcatgcacaggtaagagtggcagggtttatggagagggaattcaccatttgtggccagcactatttccaggtggaaatggtgctcctctggtgaaagggaaagaagccaaggtttccaaccagtggtccttatacctccaattcatggacaagcttcaagaggtgcctgtgaacctcttgaaatgatatgcaacgtttcaaatgtgccacatgctttttcttgggaaaagggtccagagcttctcagaaatttccatgacctcttccaaaatgaagaaccattgacttcgcatggagcaacctctgttctcacttctcttccaggacaggtgggttagcagatgacccctggggagaactctgccatcagggagagtataaccagctcataacacatgagtcttcatctagagtcatgaggccgatcatttgtaatcaatacccaagaactttgaaatatacatgcatgctgtcccctccccacattccaactggcctgggctttatccagtcctgcagttatacacaggctctcatcaacctcctggcctctgtacaagctgttccccctgtctggaacactcttcacttttcctgtagctaactctcacacattgctcaggtctcagctaaaacaacatgtcccataggaagcaattcctcgtggctagactagatcatgggccccagtaacatcctgcatgtactctatcataccccatcagagtttattgtgaactctggtttcacagaagctttctctgctagaatttaacctctgtgagggcctctctcccttgacacagatccctgctccaagtaggtactcaatacaataggtatttatagttggatagatggatggatgcactgatcagttattcttctcagagtggcaacttctggacaccgacctgctctcctcctcaaacagtgtcaagtatctatgaagtggtctaccacactctgcaactgcttgttctcatgagcagttatatccagaagttggctatcaatattttgaagtggaatcttcttttttaaatgaatgatctatctcaatggctgaattttgcacagctaattgattcctatttcaaattagtttgtaagcaagctcagactaccgactgcctttgtatcatatcagtcttcacaacttcatactgtttttcttctgcagggctctgaccagagccctcccttgcctaaaggagtaaactctgtctttgaaaggattgttaaaacagacaggatcatataagaagtagcctgagttcaaatcctgacattattacaaatagctgagaagtcttggcaggtcatctagcatttctgagcctcagtatctcagcacatgatcaactcaatgtactgcatggtggtgaagaatacggggctttggagaggaagccctgagtctgaataatgacacaattcttgccagataagtgactttatgcaggttacttaacctttgttagtctcagttttctcatctgacaaagtgggactaataaaggtttattgcaaaaatattggctgcttagcacagaaactaaacatagtaagtactaattagttaatgtactcatgccattattgtatcatccttacagtggtaacaccaattgttatgctctgtggaccagctaagccaaagagaggggacttggatcatttactcgagctacccagactcttcagagtcaaagcaaaatgtcacattcttacccaccaaaagatggcctttgggttctgtgcattagtgaatatcaatctaaagaaatcacaatgtaaagtcaggcatctgttagctactggctggtttccagtgtggaagcttgcctgcctgtctgcctgcctgcctgcctgcctgcctgccttctttccttctttctttccttccttctttccttccttccttccttccttccttccttccttccttccttcctccctccctccttcccctctctcccttcctccctcccctccatccctctctccttccctccctccctccctccctccctcccttccttccttccttcctttcttccttccttccttccttccttccttccttccttccttccttccttcctagaaaggcaaggatgcactggacggtatcagcttccctattaatttactgagtacaagtctatgctagcaactatggttagtgctaggctggtataagatgacatgggcttgtggaagctgggggatctgctcagtataggtgatggaaccagccacgtctgtaatgggaaaatccctcttcccaagtatccgagagctcactgagttgcttttcccattgcaggcttcaaagggcagcagagggcttagaaagtacctttgccagcaagtccaaccacatgccaacttgctagcccccctcccaaaacaggtacagggttaggagtcaagctcccaagactttctgggatagaattttggcttcttcacttattatgtgattctggttaagtcactcaagcctcagttttcttacacataaaacggtaataagctcagagttgattcatcgttaaaagagctaacacatggaaagtgcttgttgaatagtacctggcacaaggaacacactcagtcgatgaccactgttactattcttagcagtaatgtagcctcagggacccccacagggaagcctattggtgaagagcttaggccctggagccagatgccctggatttgaagcctgggcctgccccttcttgggcaaggtactttcccttgcagactcagttttcccatctgcaaaatgggttcaataacagctcctacctcctggagctttaataaggacttaaagtattaacaggcatgcagtccttagagccacgcctggtttacatcaatgttcattcaacaatggctgctatgactactagttgtccatgccaggtgttctgggctcagttccttcctctacccttgcctcgccgagactcagaggaaaggcagtttccctggcagaatttccacttagatgaggttctataatcacacctctcctaccttcccacttaccctatttagtgtggagatggtgaggcattggggaactctgcttggagaggccagagactcctccctttctcacctgcatatgccacgtaaaccctcatgggtggaagcagccataacccacatctccctgctgaggctgccttgtttcaggagcacaccaaatacggtggggagagaaagatgtgtgtgggcaaggataacataagacagagagtggcacctcccgaactgagaagattgacaggggagcaccaccagcaaattgcaatccaccatgtagtacttgggcattcccgccccaagaaggaagatatccaagcgcatggcttgtctcaagctaagcagaggccctgattttatctcagagtcaatggacaacgagaaccagacctgcctgcaaaatacccggggagttacaaatccaaatacggtcttgtctttgctgtttcgggagcctgatgtatgtcaatccatttggtggggagaagctcaggaggaagcgaggctctttcgggcaggctgctgcttccgctgtggtccctaagattcagtgattagcattcctcggtttaccgtaaaattcaaacagtgccatccattcggtccagattctctggcctgatctaagacaaatagcacccggtttggcctccacagctgtttgtgctgtcaactaggcagcactttgcaagatgggttaacagatttaggactaaatctctaaaggggcctccatctggtctcctgtttctcctgttttagggctcagggtttttataccagtaattgcccttggacatcaagtggcccattaaatggctagatttaccaccgctgaactggagcttcattcaaacaaatgttccccccaataagcaacctgtcagttgtgacctcaagtggctgctggttccataataatccaactaacagtccagttaatcagttatagaaaaatctcccaacatcccctctcttcccctctctataactgttggggttctagatgtttaaaataaagtcttttgcatagggtgtggctcaaaaacaagcaagatttctatttgaattacccctgttagagagagctctttggggggaccctggaagataacaaaatcatgtaattgttattcccagtcatccaggccaagggtaaggctaccgaaggggctccgtgggtttgaggattttttgaccccagtccttcctttgcagccatgtgaactacctttttgattattaagaacacagagtgacctagaaaaagctgcaggtttcatggaaatgaaagatccacaaacaaacacagctggtttcggctttgatgctgataaacaaagcgaggcagagcagaaccgcagaacgaaaatcaaaaaaccagactgaaataaagtaaagaaaatcctttcttcccttagcctgcagccacaggagggaaggctccaggaagctctggaaagggcagcgtttgagagcagggcttcctggagaagagcctgggagccccgggggcttcctcctggttcacacagaggcccccataggcctgacttggaggcacactggtgcacctgaggtgactggcggggtggggagggagtggggactgcagagggttggggaaaggaccacggagaaaccaagagggggttgtattttcccaaagagaggtggccctcggactgtgagtctttgccttcactttcaatgccaacttcaaaccaccttaggccagcacaaaggcagatcccagccatgatgcttagaaaatcctattcataactcccatattactttgggaaaatagtttagtgtaactttatattagtctatttgactatgatagcagaaatgccactatgactgaaagcatcttaccggatatttccccattctaaattcacaaacataagaacgcaatctaaactagtcatcgagttggtgacctatttagccattattaatttcttttgataagaacatttaaaataactgtcatttccaactgttcttttaaagaagaatcatatttttaaaactagccttttaacttaaaaatctaatgatccaaacattttcacatttgtgacataacacaaagctccttaaccccctctcctcttaccgtaggaaagaaaatgcaaatgccttgaaaggagtatttatatcatcttattattctttctctgcatgaggcaatttaatttcatttattaaaaatttttattctgaaatatttcaaatatggagaacaaaattgaaaacaaaatttaaaacacttatgtagccaccatccagtaaaatcaatctcaacattttgccatattttcctcaaaatttttttctatgaacaaaaaagaaatataattgaaatcttcctcccactcatccctgttttcattctattccctcccctagtcctgaagtaaacactaaactgaagttagggaacatacatttaatgctgttgtactctatgtattcattcactaataaatgtagtacaaatttgcaagttttaaaattttaaacaaatgttatcatactgcatgtatcattatataacttgccccttccccttcctctccttccttcctttttcttttctttctttctttctttcgttttgctcttgttgcccaggctgaagtgcaatggcacgatctcggctcactgcaacctctgcctctcaggttcaagcgattctcctgcctcagcctcccgagtacctgagattacaagcacacatcaccatgcttggctaattttgtatttttagtgtcactgcacccagcctgcttctttcatccaacattatgtttttgcaatttatctatgttaatgtaggtgcattaatgcagagtgcattttcatgctgtgaaatatcctattgcataaacataccagaacgtctatcaatgaatatttgtattgtatccttttttgttttgcaattacaaagctttaataaccctaatggcacatatcttcttgtgcctcacccaagcatttccctagggtatacacttaaaggtcatattgctatgtcatagtgaatgtttaatttaaacttgcctacttactgcagaattactctccaaagtggttgtgaaatccacaccagtagagtgagggcaatgcactttctgtgccgtgtagagtattttctgccttgcctgctgagctggtgataatactattcagcggtttttgtgtgccaaaccttggactaagctattcacatgtactatcccacttaatcctagtaatgaccttttaaaccaggccttatcaaacccatttcacagccaggggtaagaggcttggagaagggaagccacttacacagggtcaacctgacagccagtggtgggatggtaatggtaaccagctgtggcagagctcttaaaaaataaatatcattgcctattgccttccaaacgcaaaacagcctttttcattgaccagacacatgagttgaagccataagtaaaataaagttatccaagtgcctaaaaattgggtatacatccctaggctgaacccagagcctgcctccttcctcccaacttgtggctagtgcaaacatcagggtcgtttcctggttggatttccccaagaaaccagctgaaggctcccagctgggtggcatcaagggcaggcatgctggctttcagagcccagaagtaatgatgttcacagtccccaacccctccttccagccccaacccctccttccaaccagggcctccccactgtcaatcagggtgatgtggagtgcatcagttacacgagccatttggagcatttttccaagagaaggaacaacatcataaagcgtcggcaactgaatcagaacaaagggatcctaaagacaactttccacttaggccccggtaagccgaaggaatgttaaaaagacacacgaaccttagaagtgaaagcagagagtgagagggaaatccccctcggcctgatgaatcaattccagaaaaaccctctcacctgtgccccatccatcagcaccacagtcagaagatgggaaacattggctctcactcttagcacctctgtgttagttacctaacctctgagtgtgatcgaagaaaactgatcccgagacagagaccagaaaaccctgactcaggattacagcacatcacaaaagtggggctcccccttccttcccacaaagggatccagagatgctgataagatggcgcttgactggatctgggctccaatgcttcagtttttagtttgagttcaagttcacaccagctacagcaatcctgcacactggctacaccagcctgcctcgagtgtgtgggaacactcgaggaaggccgataatcatggcttggggcatttcggaggaccattttgggggtaaccatattccaatacagagggagggtagggcaagcattaaacacaggctttggagtcagccggacctgagtttgaattcacttattagctgtgtaacgtgggcaagtgactaacttgagactcagtttccttggctatagaggaggtaaggctggatgcagtggctcacacctgtcatcctagcgctttgggaggccaaggcaggaggattgcttgagccaggagtttgagaccagcctgggcaacacagtgaaacccagtcactaccaaaaaaaaaaaaaaaaaaagagagagagagaaggaggtaaaatcatcaacttcagctggctattctaaggattttaaaaaccatgtgcttagagcactcagcccagtggttggtgcgcaaacgagcagcttactgtgatggtgactctgtgagaattggaaaaaggcacccttcttcaagacacgtgacggtcatttggcagaaataattccgcacatctaccatgactacacggggaatgttgcctgctggagctgtgcagtggacaacttgcataaccatgagtactggccttgcacatagtaaatactcaataaatggtaactgatattctattagtaaggataaaaaccaccaccacctgaggcctccatgaggagtccttggggtggcactggattcctgaaggagcttatacgtgaattcccagcctccaggaaaagcagaactcgtggacagaggcatgggaggggcagtgaggggagggcaggaagagttgtcaggcaaaagtcccagcaggagacagggctcatgattctcaggtcaagcccaagaggcaagcctcattagtcaggggcaaggtgaagttctgacttccaccaggaaggcatttggagctcagctgacctcccagggctgcactgaggagcacatgggggcaaaaatgtgtgtgaaagagaaggccctgtgcagcacactgaaggattattactgcctttcactccccagtgtcccatccatgaaaaccttctcctccctgcagccttcaaaagtctcacattctcaaaaaaaaccttttaaaaaatcatgtatattcttttataaaaaactaattataaaaataagacaatacatttttttgaaggtggcaacgtcactcaaaaaaataaaccaaggatacaagtgggcaattgtaggataacgatggccaatgaacaaatgaaaataagcgaaatctaagtgaagtaaaaagtaaaaagcgtgagatcgtgccctgtgtggcacattgggaaaaacataaagactgatgatatccaaatttggcgaggttatagggaaacaggagctctctcatcccgttggtgggtgcataaggtgctttcaaacatcatagaaacaaatttggaagtcttcattaacatctaaaaagagcacatcctctgactcagaagttgtccttctgggaattgattctgcagaaataaaagcaccagaatgtacagtgaaacataaatgatgttcactgcagccttcttaaaaaatactggaatcaacctaatgcccatcaaaaggacataactgaataaatatgatttttccatagaatggatgctgcattagagaccagaggtaaaactacacgaactgacctgaaaggaggaacttgatacagtatcaagccaactgcaatgatccaacaatgaaaattgcccaccacaattctgtaaaaattgcatatgcacttatgcatgtaaatgtggatgtgtgttttaaactcaggaaaacattgggaaagacatataccaaattgtccacaatggtagcatctggtgttgtaatcaaactgccaagacaggttgtggaggacattaatgtcctcttttatagctctataacatttttttttctttgagacagagtcttgctctcttgcccaggctggagtgcaatggtgctatctcagctcactgctgcctctgcctcccgggttcaagcgattctcatgcctcagcttcctgagtagctgggattatatgcacccgccaccacgtccagctaatttttgtatttttagtagagatggggtttcaccacgttggccaggctggtctcgaactcctgacctcgtggtccacccaccttggcctcccaaagtgctaggattacaggtgtgagccaccgtgcccagccatatctccataactttaaggggtagaattatggttgattttcacttgtgtcttttagctttttttttttttttaaacaaattttgaaagcatatgcttgttgtagagcagctgggaaatcgtgagaagtgtttttctcatttttgtcttttgtctcttctcttaggattgccttctgtcacgtaaaacctcatgtctccacctttgtgggacccagcactgtgactgggaagtgaagtctggggtacagcaagcatagagaatccttggacattatgggtggaatggaacccctcaactagtttaaatgaatgaaaactgagtcacacattttgttttccacatgcggacactgagacccagggcgaaggcagggcttggaagatgttgttattcaagcaggccaggagctatttacgaggagaatgacccctcagaagtttgtgtgcgtgtgtgtgtgtgtgtgtgtgtgtgtgcgcgcgcgtgtggttttgaccaaagcagcagctgaccaaggccaaaaccaaacatccgcaatgaggaaaaataagcacaagtcttgagtgggtcccgggggtctccccagccaggttcactgccaatcactgaactccttttctttgccatcaggcaccccatccccattattcttgtccttcttctatcctgtgaggtacattctatttttcccatttcaccaatgaggaaaatgaggctcagagtaggtaaccccgttggggaaggtcacacagcatatacatagcagaggcaattctgaatccagttatgtatgtttaatgctgacacatagcttctgaagaaaagctacttccctgtctctaaggcctttttctagagcatttgtagaaaagagtagtgcttgaaaagatgccaaggaatggctggtgaggattctggggctgtttcagtgtgtaggcaggggaggaacttaggattctacgtgactaggaagggtgactgggccagactcagccttccttgagcctctggttgctcatgaacgaatccggcttcctcaaagtctgcctccagagcaataacaaaagcagctcttgctaactcagtggctggggccgctgtgggcatatccccgtatctgggcacaagctttgctcattcattccatttttctcatctgttgaaaagtacctgatcggtaagcttctgttttgaaaataaacacccttttggattccaccctttctaggccaatcccttcagcctttactgatgcttgtatctctcccctctgccctctccttctgggaaggtatttttctttcattcttttgggatttggctgacaatcgatttctccatgctggtagagtcatggggaaaggcaaagacctcattcaggaggggatggaagggaggagagggtagaaaaaggtgagaaggaggctctgcttctttatctggaacctgtttttcatctctctttgtcttgccaggtcctcagcttcttgtctacaatgacgaagtgtatttttttcaacagctggaatgagaaatgactaaatcatcttggatccttggatcagattactgaagggaaaggagctcatttatctaaaagccaaaccaaatacgtgtagacacctacgtagttaaatcacagcagctctaggtagttaaaacagcagaaagcccccacgcagatctgctgaaagtatctcccttcacctacccacctttggtagctgatattctattcttagagagtcatttgcttaactactgtacccgttaaaatgcacataggtataacagtgctttacatttgcataggatgacagggtgcttgaaatttttttcctatgtccttctattcactcattcaaataaattctatgagcacctattgtgtgccagaactgagcaatatgctggtgctacaatggcaagcaagaaagatatgccatgttgtgctgtgagagcacaatgataggttaactaactagacttgggactacacgctaggcccttgactcctgatccagcgctgctttcatccaactacctgtcacactaatgttagggtgggagaagacactgtgttttagcatcatccttgccttggtgcaaatcagtccactggttcatttctatgtgataaccatctgagagcagggatgaacatggagatggagagggaggtcccatgggggtgtgggagcactgaagggtcatccatgggattccagggtgcataagggagatcctaggaggaggacccaggatgaaaataggatgaaacaatgtacacacaccttctttccttcatggtgtcccttagcaagtattttaatcatctctggctgacttcctctccaatttcagatggtacttcttgttaaactctctcccaagctccttatgtcttcaaaacatctctcactttcattagagatctcactttcccttaagagaaagtcaagtccatttagcatgtgcctcactgatgacacctttcctcccctagtaatatccctgtctccccacttttccacttggtggtggggcaggtacttttatgggccaatgaattcctccttatacttctcccatttcctccagggccaaatatctgaatcctcttgcttttgtatctgaagactcaacctcttctggctccctcctcttggtccacaaagaggccccattctcccctgtctaaaaactctttctactctggagccacctctttctcattcctccatgtctgtggccttcaccccttcttctctcaagtattcctcgactctccatcttttaccatcacagtgatactgtgtcagatgccagcattgacccttcagtgccagaagttacggtcctgcccagccttcttcatcctcaccctcactttcatgctcaaagcagtgaccttcctcctgtgcctggaactgtctccctcttttacttctgtgacacaacactcagatttttccccacccttgctgttggcaccttttttcctcctgtattgtcttctttgagttccttacttatatatgcaaatgactacagaaagaagagttggtaaagagatggcagatacatgttcaaggaaagacagaagaacatcaaagtgtgcggtgtcctaaagtatctttaggatggagatagatggcaacaggattacatgactcagaataacactgtttaactttttagaagacaaatctaggcctgaaaacacaattgcctgaatgaactgggcttttgtggtttgctgcctataacagaattttgctaagaaagaatctcctagtggctgaaagtgcccaaatagaaactgggagattatagagcaggtagttttattgttattattattattattatttgagatggagtcttgatctgtcacccaggatggagtatagtggcgcgattttgactcactgcaacctccgcaccctgggttcatgtgattctcctgtctcagcctcccaagtagctgggactacaggcattgtgccaccacacatggttaattttttgcatttttagtagagatggggttttaccattttggccgagctggtctcaaactccttacctcaggcgttccactgaccttggcctcctaaagtgctaggattacaggcatgagccactgcgcctggccagtcaggtagttacagataactctgcttcttcttgagttctttgattacatgataacctttctcagtctttttcaaaaccccaactgtcaccaccaccagcattatcctcatcaccatcaccatcaacactcttaccactaccctccccccaccataatcatcctcatcttcaccaccataattcccaccactaccttcatcatcactgtcaaatgccattgaatggtcccctactaagaaccaggttctgtgctgagcccttcatatatattctctctcttcatgttcatatcaactctgaaaagtcagtttataatttcagttttatagatgagaaaaccaaaactcagaaaggttcattaacttgcttagaaggacccagcagtttaaaatgtgttccctactaatatacacaagagagtttattaatccaaaatcaagatatctgtttaaatgtcaaccaaaagattgaggtaaaaaagacattgatatgacttgcttatctttaacaggagacactgaaactaaatagtggtttaatagcttctcctcagcattctgtctcctaatggactttgcaggactattttaggttgaaatttttcctgtccagtaccaaagctcttcaaagattctattcccatcccttacccttttgggagacggtcagggagagagagggaggtgtaaaatccctcttacaaatccttttccaaaaatctttggctgaacaaagactttcccatttaagagcaggtgacagaaagatttctcccataggcagcgcattaaggctctctgcagaagtaaacaaatctgttatgatgaaagccggacattcctcagagccaggatctaatgaaaatgtcagtgttttatgcagtttaaaaactgacaattcaacagttttacaggagctatttaatgtttatcatcacttacaagggctcaaatgcagacaaagggaagggcaactaaagaaaccaagtggatctttgcttggaagccgccatgttatctataaaccatgagagtatggcagtttataaattaccaggcagcctcaggcaataaagtgtaggtcttagcaaatgaaagttggaaatccacactccaagatacaatcatcatagtgaccatgctctgcactttcatttacacctcaccccattaaagacccaaccactggggagtgaggatactagagaaagcccttaaactaacctaaggtgatccattaaaagcttctgagttcttgccaaattgtgctttagatactatcaaaaccactaagaacagagaaatagaatatgtaactcccaaaccagtagggggaaaatagaaataaagaaagcacagtcaattcaaataggacattaaaggagaggaggggaaaaaaggagaagggaacaaaagaaccataataagagaacatgcgaaataagaagagtaggtccaaatagattagttacaataaatacaaatagcttaaattcacccattaaaagacagagatgctgggtgtgattgctcacatctataatcccagcactttgggaagcagaggcaggaggattgcttgagcccaggagttcaagaccagcctgggcaacatagtgagaccccatctctacagaaaacaaaattagcttggcatggtgacatatgcctgtggtcccagcaacttgggaggctgaggttagaggatcacttgagcccaggagttcaaggttacagcgagctgtgattatgccatgcactccagccagggttattgagcaagatcctgtctctgaaaataaaataaagtcagtaaaaaaattaaatctagttttatgttgcttttaaaatggaaaatggaccagtgacacacaaaggctaaaaataaaaggttggaagaaatatgcacttgcacacaggaacagaaatgtaaaggcaagagcattagtacagatgaagaagattattaatgaaagataagaacaacctaccaggagctataacattagatgatgacattttatacaattaaaagtatatcctagatagagagaaaacaaaaaatgactgaatccataatgattatgaggattttaatgcttatctctcagaaactgagcagttaccagctaaaacattaatagagatttagaagatttattagataacttataagcttcatctaaagaatatacaaagaacatgcacccaaagagagaattctcttcaagtacatatgaaatatttataaaaaaattgaacatgtgcttggttacttagaaatctgaataaaatacaagaagcattattatgtacttgatatctgcacttctgtgttaaaagaagaatgatttggccgggcgcggtggctcacgcctgtaatcccagcactttgggaggccgaggtgggcggatcacgaggtcaggagatcgagaccatcctgactaacatggtgaaaccccatctctacaaaaaatacaaaaaattagccgggtgtggtggcaggtgcctatagttccagccacttgagaggctgaggcaggagaacggcatgaacccaggaggtggagcttgcagtgagcccagaccgcgccactgcactccagcctgggtgacagagtgagactccaactcaaaaaaaaaaaaaaaatgattttagaaccttacacatcaaggccaatccacccagtttccacccagcctagaaaatagtcctcattttctgaggcttgtcttggtgttacctcctcagaaaaatcttctcgggtcaccttaagtccggtagttcttctcattcccagtgactccttaataactctactgtacttttcttcatgcaacttactagtttctgaagtcatcctatttgttactagttcactgccttcctggccccaccctttgaaatataatgtatttgcaacatctagctcctggaatggagcctggaacagagtaggcatcaatgaacatgtgctgatgaaagcctgacttggcaccctacagtgaccctagcccttcatagagatatagaccttgcccctagaatagatcacattacatcaggattacttgtgttacaatctcagtaagagttagtgagtttgtcatcatatccacttacataatagacggtaaataaatgactaaactatgtccttccccatgcaccaaaagaagccacaccttgggaagccacatcgcctgcttacagccacatcttgctaacgacagagcctgatttctgactgcgagcattactctgctcctccacatggcctccatgtcccctgcaacacaacctattatgcgtggaggctgcaaggacagagaagacaacttgcaaatgtctttttcagcaaattcagtgtttctgttactattatatagatactagcttttgccaaatctattaaaattgactcaaattatcatttcttataataactgcatgtctgcataaggactgcattgtccaattaaagaaacaaagaaaataatagttcattgactcaaaatcagctgtgtggccatattatcagcccaatagttaaagaaggaggaatcactgtgtgaccttggacaagttgcttaatggctgaattctcaagtttccacatccatgaaatgctcataacattagtgctgactatgcaggctgctatgaagactaattagattactccattaaagcactgaacatagtacatgtgtcccaatgagctcgataaatgtcactagcatttcagacacctgcatagtcaacttgattcttttgcactgctttgcaagctttgctcgagaaactggtttttgatcacctgccttccatagcccttccagagatgcaccactgttatggaatgaatcttaatgttcctttgaatctgattaaatccattcctccctgttacagtggacctagaaaaatcctggccaatgccagatgtatttgttggatggcctttttaccgaagatttcaggaagatggggctgctgtaggggcagtcaagatcacagcattgattaacaaaggggcagattgtctggggaacattcttctttgacctaacccttcttcctcagaaggagctatgctagaatagaaagtttccaccacagacatctgcttgccagatctgtcccaacactgtagccactggtgagagccatcaggcagtacagattttcccttggattggcagctacttgaagaagggcacaagtaggcttcaaatttatcatggaagacaggagcagtacaattttggcaaggactcccttcaaacatcaaaaacttttgcagactcctccacctaagtgtaattttatttctcttcaaataaatggctgttgaataaatgactaataactataacctcccctgtgtgccagaagaagcctgacaccttgggaagccacgttgcctgcttacagccacatcttgctatggactgagcctgattcctgactgtaagcactactctgctcctccacgtcccctgcaacacatcctatgaagcatggagactgcaaaggaagacagagaagacaacttgatacctgatgatcgacagctactaggaattcagtaatgttctgaaatgctaatgtatttaaattaagtaatgtttttaaattttagaactcataatagtgtctatgcacacaccagagaaattatcacacatgtatttatgaggcattctattctggatcatggttcattatgtgtgtgtgtttgtgtttttgcagatttgaggactcccaaaggtccttagtccacagataaggagataagtcatggaaaatgtagaacttgttccttttaaactggagtttttaaacttcagcactaaatcaatagtgctatgctatagaaaaggaagagtgactacagtcatctatagtaagaaattctcagttggaatattcatgctcaatatgtgtaacattttgatcaggttgaagataatgacaattttttctaccaaattatttattttcacctcaaggttgatctttaaaattgagtcttgtggatgaataacgccttggactggtagaagatccaagttctactttcattttcaccaggaactaacaacataacctttgacaaatcatatcgctctctgggcctcagtttcctatcagtgaaaaagctcatgtgaggcaccgaggcagaagactatagacaggacagaaaatggaagggaattgaccacccagcaaaaatgcagtaatggaatcaaagccagcattagaagtagcaaggagctgaatcactgctctagaaaatatcatcagaaaaataggctgtaatcttgtgaagttatcccagaatatagagatgtaatctgtaagggacaacatgatagatatgggaattacatagtgagaacctgaggataatagatgctctagaaaaaaagaccaaaaactaagaaagggagcaataaattaatgcaatgaaacacatatatggcaggttaaaagggcttaccagaaaaatgtaaaagaggtaagcagtagaaataatctggcacaattgttgacttgttgatgtaaagaaaaaacaatctataaggatctggaaagaaaataacaggctgtctttaagagcacacatcaagatgggcctcaagaagtacccacccatagaagtacctctctgtcatcgtgcagaagatgggggaaacattcacgtctgccatcttctccccaccactcaagtcccattttttgttgatttatttggattttcagatcaagacattatttctggtttttgcattatacccctttgaaaagcctcttttgacatgtgtgctcttcactgattccagtatatgacagtggcttgtgatgctcaacaccaattcaggaagaggaatagaagcctagaagagtgctgttgggggcagaacacttgtcccagagagcaggggagctctgcacaagcttcagtgcaggcctttggaagttgtctgtgtggacacggcctctgcgcctcacctagagccattaagtcagaatccctaatgcagtgcctgggcaagtacccacgtggttcttattggcagcctgggtgatgagctgctgatgtcgctcctactggccctgccatgtggcatctggatgaggagctggggaggcaaatctgggcatcattaatacctgctgctggccatggcaagctcgccacaggccctcttctgcagtgccaaagcaggttcgcacaccatgcggacgggggctgggggtaacacaaacgaaggaagtgaggcagatgtgaggaaggccacattggtgaccagtaaactggagagggctggctggacaaaggagattgctggggcaatctcgtgggaatatagctcgctataaccagatcatctgtttttttccaaaaacccagaaagccagaatcgtatattatattttccggtttttggaacactctgagccaaacaaaatgccatctaggcagaactggcttataagctccatatgtgactccaggcttaaattcttcatgtccacagaaattgcccttttattttaatcaaaaaagtcctcctcagaaacaggtcaggcctttctcagcaagtagaaacctaggtgctccaaatgactatcttcattaatttgttaattgtttaaaaagctactcagactgccctgaagttcagctgctccctgtcatttcacattcacactggttgtgtgcaaacaaccagcgagctgtccttcggcactgtaaaatgccacgagtccaggaaacaagtgcttcctgcctatgggagagctctgcccctctgaagagaagcagacacattcagagctggtagcctggactatcactcctaaataagagaaggataaagagccggggagccgggtgcggtggtttatgtctgtaagcactttgggaggctgaggcaagagaatcccttgaacacaggaggtcgaggctgcagtgagccatgttcacaccactgcactctagactgggctacacagtgagtcagatcctatctcaaacaacaaacaaacaaatattcgggcctctggaaaagtccatcggacaggaacacaaagggatccagatgccagagtaagtactccacttcctttttaataaccagcatccactgggaacttcccatgagccgggctttgtgttttggctgcacagtgaaacagtaagtcctcaataactatttctgaatgggtggatggataaatgaatgaatcaggtatctcttctatttcacattcctgaaattgaaccttagcattgtgagggcacttagatttgcaaaatctcttccttcctttgtcaacaattttcaagagccagatctgtgcaaagtcagtgtgtgagagactgagaaaacaacaaagaatctgccgtcaaactgcgtcctggacagaaggacatgtgagacctgtgaaagatgcctctggatccagagggcagtgagagaaggcagttctctgggaagattcctgaagatgctcacaacccttccctaaaagccatacaaatccctccatggaatagtgaatgtccactgcaggcagctttgctctcaaggaggagaccagcagaggctgccctgaaaaggaggtatctcagacagaggcaccataagagttggaggaaccaggaaaacaaccaaaaacaggtaccacggtgctgatgtcatgctaggacagtgcatctactattagtggacacttggaaatctcagtctctgcaggagaagcgctctgccgctggggttcactctgtggcagtgttgctcaggaggttctctgctgtgtagcctctgtgggcagaaccctagctattgtgggacatgatgccagctccccggggacattttcccttgccccccttcccatgctaccacaacctaacacaacctaacacctaagccatcagatgttcattcacccccccaatgaacgcctgatcatctttcatttcatggtcttaacctcatgtctctccttgccagctccagagaggacttgtttacctcttctatgctgtgctagtttctgtactcatccttcagagtgtgtttcaaagtgtgaaaatgtagctatttgctaaatcctgcccagcctctggctgtgggttctcagagggtgggacagggcatgcctgtcttgtccctactcacaagagaagaccgagcatctccttaacaataagaagggctccctcatatatccacagagcttaaggtagtaaggatattcttactcctcatgctgggatatctttaccaggtaaggagaagctgggagaccttaagaagcatttcccccttccctacctccatgacttctctgttctacagatctcaaatgaaaggcttcctaatgagcaaataatgtctaaaaccagagatactatgtttataaaataatagcctgttattgtgaaacttagagctagagatagtcaaaacaaaaataagacaaaaagtccaaaaaccattgcccttgttcttggatccagaagtcctaaatttttaagaagccgcagccgggtgcggtggctcacgcctgtaatcccagcactttgggaggccgaggcaggcggatcacaaggtcaggagattgagaccatcctggctaacatggtgaaaacccatctgtactaaaaatacaaaaaattagccaggcgtggtggtggacgcctgtagtcccagctactcgggaggctgaggcaggagaactgcgtgaaccccatcttactgcaagcaggtggagcttgcagtgagctgagatagtgccactgcactccagcctgggtgacggagtgagactctgtctcaaaaaaaaaaaaaaaaaaagccctttgcctcaaatccaattcattttttgaaacaaatcatatttgaaatgtgtgtttctccctgtctcattatgaagaaaatcctgagatacagtattttcacattccataaaaatctgaacagctgctttatacacaaatcacacggtatacatgatatcccaaagatcaaaactggcattcatagataatcttttaaaaagacaaaatccaatgaatatggtcaccatcctttctaaaacttgaataaagacagtaaaaataattcactgactccatcaatattcttgtgcaaaacagatgatttcaccccccccagcatgtctctccggccacgtttattcagttcccactgtgcctgccaggctgactctcagagagagaaagcaatgaaaatatattacactaagatgaaactaaacgactttaatatttccttaatgattcaacaaatcctttcagactttgctagcattgtgagggcatttggatttgcagaatctcttctttcatttgtccacgatttttgagggccagatctgtgtgaagtcagtgtgtgagggatgaagaaaacaaccgagaccctcccctcaaactgtgtcctaggcagaaggacacctgagacgtgtgaaaggcttaaaggtgaggccattaatattgattatgctattaatatattacacatctatatatataaatatcaataatattaaccagtggagagagtagcttaggaatattttataatgtgaaaaaaatacttcagtgtccaagtctcttatttaacctttacaattctctctaccctacttcccttttctctatgttcctgctgacactacactcagcaggcatgtctgaggatgagaaagaaggccagtgcagcatggcacggcactgggggagggagagaacagcaacagatgaggttgggaaggtagtcaggggacagagcatgccaggccttgtaggcttgagctaagcatttacgtttattacaagtacaaaggggactgcctggagggatttaagaagggagtgtatgatgtaatctacattttgtaaagatcactctgccaacttgcctgatgaatttatgccttatgcccttgatcagatcacaaggagctggatggtagggccatacgtagttactctccctttaatacccccacatcatggactggtagaatgttaaaccagtggctctcaaactttcctgtgtatcaggatcatccagaggcccatttaaacacatcttgttggactccatctacagagattctgattcggtaggtctgggcaaaacctgagaatttacattactaagaagtccccaggtgatgcgaggatgccagtggctcttcaaggcactgcacttagagaacctgtttaaatctgtttgcagaataaatcaatcagtgaagaaacatgcaaatttttttttttttttagttggttatttgtttttgagacggtctcactctgtcgcccatgctgggctgcagtggcatgatcatggctcagtgcagccttgaacttctgggctcaagggatcctacagactcagcctcctaattagctggaactacaggcatgcaccaccatgcctagccaattattttattcttttgttgcccaggctggtctccaactcctggcctcaagtgatcctcccacctcagcctccccagtcactgggattacagacatcagccaccatgactggtgaaaatatttttaaaacaaacaacagaaataatcagtggtttgaattttatgtaaaatacaatcattcattctttttctttttaagaattattcttttcaatctataatgtgatgataacaaaaggactaatcattgcatacggaagtactctgaaaggaaatagatcattgtgattaggcaagatgagacacttcagaggctgtactgccaagtttaattataaaattaagtgtcattcaaagaaatttttattgcaaaagtatgtgatttacttctgtaggcagttattacaatactgcctcaatccagaaggaatatgagatggtgaggcatctcttggttcaattccaaaactgaaaattaaactacaatttccttagaactcaggaataaaactcatcatggctcattctgtttggttcaaagtgtacaacattgatgaacatatctactgtaaaagcaagtagattcaaactctcttcctaggaggaacccccaaagattccaacttaggtacttattatgccaaagcaaaaatgcaactcaagaatgcagagtaaatacagactcagagccaacagatgagaataaaagtcagacccaggagagttgagtacagacggttgcacaagaagcataaggccaatgccctatggtctctgtgggtttattcttttctgccacatgtgaggcttcggtttccatgtaccaatgtccatctactcagaaatcatgattgcaggccaatcaacaacagatagtccaaactccgtgatggcttggggtttaggggttcagtaggaagctctctggcctgaagcctgaaaagtcacaggttcatattctgcttagggaaggagctggttaggtatatccaaaatcatatagggctagtgaaatctcatctattcattcagtagttactctggatctcatggtctaagaagtcaactgggctgggctagggggtagaggaagattcaaaacatcaaaagccacaaaatcaaaacaagaaaaagtgttgaaaatcataggccttggaaagcaaatagtaaatgtaatagtcattaagtagcaaccaatgaccaaccttcctctctgtccatgtagcaagatccaaacaacactgtgtggccaccatgaggctgacacaacaatttacatcatgtggatgatggacctagattattgttctacactggtgggaatcatggaacagtctggctgtgaattaaatacaaaaatagcaactcctacactctagcaaaatgtaaagtacatgtgagcccccaaatccaagctcattatgcagagtctctctgaaacccagcacccagcatttgccgttacccacctccaaaagggtaaaagtaaacattggacctgctctggtgttaaactgccaccggatcctccccgctgtctccctcctcctcttcttctttacagacaggtaatgttggatctcgaaggaactgggggctcccactctaggcaaaggttggacaggtgatcaatgtacagcatgagatttggctgtgcctacgtgcctccgacagagctggatcatctgggacaatgaaaattatgaaaattataagcaacaagaaagcagtattaacagcaagggcagggaaaccaggacagcacataccacagttcctaggacacccagcaaccattcctctcctcattcagtcattctacacacattcattaagcatggtgccaggctctggagatatcgtagtgacaaataggaacacagaccctgcccccatggagcttatggggtatgtgggagaaagaccagacaggcagttacaggacagcgggtaaggaaacctagagggtgccatggagcacaaagcaaaggcagccaacccagactgggggtgagtggtcagggaaggcttcctgggaagaagtgacatgtaacgctgagcctggagaacccatggagttagccagccaagactggggtgggtcagcacgtgcgagattcctgagaatctttggctggtccgaagggctgaaagtcctttgttctcagccattctgcagcctgtaatcctacatccaaccagagcacccagatttggagtctgcagccctgattacaggaggaactggtgctcctccaatgcccacaatccagttgcattttgacttctgccagtgggatctcaggaaactaaagaacttagaaaatagtgtgttttttttttttttttctataagaagagagaaaaaaaaaacaataatgcagagttgaactgctacggaatagacccaattgcagcaatcctttctgcacaccagcatcggggtaagggagatgccatcctcatggagactgttgaaacagacaagaaggtggatcacagtttggtatcacaatacgggagcccactttgccccttcctttcctccaagtccctgagaaattgcagagggagcgctttgttcttcttacccttggtgttgacgtctaaaaggctatcgcagacatgatacctcccacttgcctgatgcaactaggggaaaccagatagcttatgaagccaatcttgtcaggagcctccatgtgggggaaaaaaaaacaaaacaaaaaaccccctaaaggctgggaaagtcccagcagcttgaatattgcccaggactctagctacctttgcattacgaaagagaccactggagaggatggcttaagactgggtagtaagcatgtggtcatttgaccaaagacacgtagtccaaagtagctttctgttttaatattatcatatgatccaagtcctacaaacaacatccttgactgaaatcgaaaagaaacaaaaccctcacttctaagaagcagagcaagcggcgtttttagagacaaagaaaggatagcttcttaacctatgacaacacaaatttgtttaggttttccctccaccaagtaagtaagcaattaggttttttacaataaaaatatccccgtgcatgtgcaaacaccagaggcaatcatataattaccctgcccaatcagattcaattgctgacagttgagttcccactgctcattaacttcagatcacaaagaggtctttaaggaagccctttccttctctttacaaaggttcctatgatgccgcgatcagccccggcactacctcatgcaagataatcatccccaaatcaccagggccaaggccagcctcctctggcttccttctgaaaaaataaaatgagaaattcgaagacaccttggcttaaacacccttgcttcatttggggatctcacttctaaatataatagtaacctttcacccccacattttaagtgccgtaattacataattaaaaccaattatgtcatttaacagagactttgtcaagatacggcaagccaattacctcaatcattgacctcagaggatttcccacactgacctgaaacagtgagaattgggataaatttagacactggcttccgaaggctggcatggactagcagggtgggttgtaactggtctagattctttgagactttagaagctaaactgaattcattcccatctacaccatcactacttgtttgcacaatccttcccatatcccaagataattgcttgatttttttataaccactctgatggaacgattacttccatgttgcagacagaaaaaggaggcagggagagtcctaaagttatctgaagtcaagcagctagtgttaacagcaacgctagggcaagacctaagtcttccaccacagaattcaaagtctccatgtagcgagtggtgtgtgggtgcctctcttaccccaatttccctttgaggcaacacatttgcccccacttttatttaattcacctgcacggcacaaggttccactgcaactcagggggtgtgtcctaaattaggccccagccaattagcttccagcattcctcccctagccacagcattggttcaggatgagcacatgatcccatcaaagccaatgagagacactgacactttttgcagggcctgtgcgatctctgcctaactgtgcttggagtgaccggagggaagactggaagttaagcagccatcatgctccactgaggaagtgagggtgactggagccaagagatgtggagggagaaactggttccaggaaacaccctctattccctgtcgcttcatgctgcgagttacaggggttattcaaaagcacactggagaaagcaggaagagcgccacctacagcttgggtaggctccatttcgaggatggaatcaatccactgtggctccgaggcctgcctcctgcttgcgacagttaaatgccttcggtttttgagttatttaaagaacataccattttatgggcaggaggaagcactttaatctgcaaaatgatttttatcacaaactaaacatccttgtaactttttggtcctctgctttggtcaaagttgtctctccttggagctcagacagctgttggagctcagaagatctgcctccaccctgcactttgccctgctcgctggtactctggtgctctccaattcctggatccatgtgggatgtaagaactcaggatcaggacgcctgcacgcatcaaaatggggcattttctttctctttatcccaggacttgagagaaagcaaaaaacaaacaaacacaaacaaaaaaaaaaaaaaaaaaaacaagaattcctctaatttaaggtttttaaccttgacacttgaagttttgggccagacaattatttgtcatcaggactgctttgtgcaatgtaggatattcctggcctctacccactagatgacccattagcacccctcatttgggacaaccaaaaatgtccgtggacattgacaaataaccagggatgggggccaagatcccccctcattccccagctccccatttcctggttaaaaaccactgctgacagcatctttaaaaacataattccttgtagtattatgttgtgagactgagagaaccaccaccctccttagaactttacaaaagccatataaaatatcccctgaggagaactgacttaaagaaacttcaagatagcagcctgcgcaacatagtgaaatcccatctctacggaaaaacacacacacacacacacacacacacacacacacacacacacaaagtagccaggcatggtggcacgaacctgtagtaccaactatccggaaggctgaggctgaggtgggaggattccttgagcctcggaggtcaaggctgcagtgagccctgatggtgccactgcactccagcttggccgacagaacgagaccttgactccaaaatagcaatactactgtctgtcagggctatgaagccacatgagacttgacccattaaggacaagagtgaagaaaaatgtatcaaatagaaataattttatctaaacactggcaagaggaaaaagacatggaggagaaacttagaaatgaaaagcagtgaggcatctatatggtgagttccagcatgggtgctcagcttctcactttcacaagtaagaaaatggaactttaaggttattgctgggtttccgggattcaaaacccaaagctaaaaatgtggaagaggttggtgttatcagaaatgatctttccagtaaacgcctaaaactcactcactctgcagaaaaagccaaaaatggtaaagcttcacttatttggacaaatgtgggagaagtcatttaaaataagcaaaattgatggatttatagaatatttttcaagggaaggcatttacttgctttcaaatgccagcagtaattaagagtgagctggcagaggtccctccttcaggattggtttgaatgagaagacagaatttattgaactaatttaagcattgttaggctgggaaggagggctttgagttagattgtcctctccgtgagctaattagttgtatctacacacaggcagctggctgagaccagcccaggaattccagaatagtggggttccaatgaggctttgcttccaggcacagacatctgtgcaccttgaggtattgatcaagtcagtcaggagaagcaggctggcttgtgtgtgaaggctgggctgtttgggggcctcactgtgtgaaaagatttggattctagcagtttctttctctacaagatctaatgtctggagagatggagaggcctattaggggagttcagatgactggagctgggacatcactgcttcttcaggtcccaggcagcctcccctccagctatcagcatgtctcggctatcccatgctgtcccctcaatctccaactgccctcctttctctccatcaccagagaaatgtgactgcctagggagcaaccatgtcttgaaaggagaaagagcaagaataaaggtgtctctgaggggccttgcttctcttcccctagttcttttaggcattttgttttgtttcatttggataagagctaacatttagaacaataatagaaaatagaagtacttgtctggagggtctagcagaggtccacagtgactcttatgagctgtataaaggactgtcccttctggagtctagtaatcaaatctggaggagtagtcctcaaatcttgttagagaatgaagttctcagggtacactcttcctggctaagcaatcccatcccagcccctctctactgaaatcattcatcctggtcaagtgtgtttctcagaatacctgggtatgtcaacagagataaaagagaagtgcagcacacttcctagtttcagctggcactaaaacaagagaatgagttgtgcgttttttggtggaggtgcctcctgatcgagtctacacactggcttgtgaacatgttgtctgtactgaagaacttatcccaaaaaggtggctccacttacaccatagacaagtactgtccttcccatgtcctttcagcatgaactgagagaggggcagtctcaaagtggcaggtgtcacaagaggtcactctcataatcaacaactgaagacttcccaaaacagcaactccttgcttttgccccaggtaagccttattcccagcatcaagaaaaggattttaatggtgtgtggactcctggttcaggtagaagttggtatccagagatgtcattccttatttatcaagtacttattcagcaggtccagaaatgttatgcaaaatttggtgttcatgcttatatactttattctgaggagcagaattatggtaaccatattcttaaagtagtttgaagctcagaattaaaaattaagcaacagttggcataaagcaatcccttaattttttttttaccagtttttccgaggcaaaatttacataccatcaaggtcatccatggtaagtgtaaagttcaacgattttaagtaaacttatagaattgtgcgatcagcaccacaaaccagttttagaatgtatctactatctccaaaagaccctgcaactgttacagtaaacttcccttaatttttgcagcaaatgttctagagttgaaaagaaagctctttctacatctgcaaggctgattcatttttctcccttccaagaactctactaaaaaaattatttgttgcttatctgaaatgcaaatgtaactggatgtcctgtatttgtgaaattccggcaaccctaatccaggaccaaagcagaattaaccaaataaatgaaagtgcatgtctagaaataaatgtacttttctggagcattgtaaataaacatgaattattttcctagttttgaaccatttgagttctaagatggtcagaacctagttccagttagaataccagctgagaactaagctacagagacagcctgaataattcacaacccaattgctgttttacaagcaagcctgggacctcagacactcataggattatatgctacatttcccttgaaaggttaaagtggatgtaattgttaaccttgcagctcacaatcagaactggaaatgtgacttttaggggcacaaattatagggaaatcattcttaacctttttggggggcggtgtcacaaactcctttgggagaatctgataaaagctatggaccttcaccataggaaaatgcgtgtatacacattcacaacattttccaggtaattttcttttaggtgggagaggtttcacagattccatgacattgttcatggaaaattcaagggtgcaagagcctgggcaagttgattaaaaccatcctggattcttatgccttgcttttctcttcctcctgtttgtgtgggaagtgaagaagtcgggataatggcaagggaactgactaactcaagacgtggctgtggccgggcgtggtggctcatgcctataatcccagcattttgggaggccaaggtgggtggatcacctgagggtcaggagttcaagaccagcttggccaacatggtgaaaaccccatctctactaaaaaatacaaaaaatcagctgggtgtggtggtgggcaacgtaatcccagctacttgggaggctgaggcaaggagaattgcttgaactcaggaggcagaggttgcagtaagccaggatcgtgccactacactccagcctgggagacagagtgagacttcctctcaaaaaaaaaaaaaaaaaaaaaaaaaaaaaaagaagacatggctgggctacttttggccatcagtggtaagacctggaggaatctgcccacacttcatagacttctgttcactgttgataaaatgaacagatcagcctgactctgttttcacaagttatatcctacggatctactggaaaggtatctggaaagggctcttttaggatctgaagcactgcacaagattttgtaggaaaaacaaaagttttaaaatcactagactacatggtcctcaaagtcaccaaaatactctgagttttaagccatctgattatctgattctagattctaaagagtggaagccaggtatcagttggggaggatctgggtattctttttctctgagtacaaggaaaaaaggcatttggtagggacaggagagaaagacatcccagccctcactactctccagttctgcaacatttctttcttcctttgagctgttctccttccttcatatgaaaaactgtctacaggtatggtaatggttggtcaaaaactacccatattttttctgataaaattaaaaaaaaatcctttcccaattatatgaattttcctttgggtgacaaagatacccaatgatctattatatcattatatactactatgccaatgatactagtagaccacgtggataaaagacaaatgtgctcactctgagttttatagatggcctctctttagtgccttagaggcccctacaaagtaggctccagtattatcatcctcattttttagaagaaaagactgagcggggaaaaaacgttgagtgacttacacaaattcacccacctagccaacagcaaaatgggatttcaggtcacagagcctatgctcatactatgttgaagagagaaattatatcacttaccactaaaacaaacaaacaaacaggttttattcactcattttctctcaaaaacaacctaccactttaaggaagtgtgttatcacacccaatgataggaaccataaaactattttggatgtttatttgatacttattgatgtttaagcaagcctactatgttcacagttatcaccccaaagaaaaatatattatttagtttttaggttttatcttatctgtccttggtccttgaaacagcaagagaaacacgtacactctgttcttacttgttgtcataggataccagctgcctgctgggaaaagcatactgggaagtactgttctacactttgtattaagagttaaaaaataaaatacccagagcctgtgtaaatcacagacaaagttgacaaatttcatggcttagtcatggttaacatatcagatttcatggcttgacagagattaacaagaaaatcatattagaattacaactattagtagattcttagatatttgatagagaaactccaagctctccaaacgccattgcccactgcacagccctcttgtccttcctcctgtggatagagcctccatgaatccagggagagcaaatgggatcttccattgttggtcacaatcacctcacctcctgactatggcaggagtgagccagtgcctagtgggccccagggaaaggtcttagcatccgcgaaataaagtaaggtttaatatttatagcctaattcataaaactgtaaggagaaaaaaaatacctcatttgtacataacacaggtattttacccaatattacatgcactaaggagaggaatgaatgatcattgttggaactatgatattttcggtgaaaattaagtttccatgtctttacgaggaagcaattcagcagaggccttgttgttaaaagtggcatgcgagcaggaacttcaaaagacctgctgactgcctgccgagccatttggccggagggctctgcatatcctctttcgggtaagaggcagcttacttgtcaactttgcataaaagacagccaatttgtcagccatttgctttaattttgtttctgagtcttccaacgacaaactccatataccttctggtctttaatatcatatatctgactgagggatggaaattcactctagtgtctcaggctggtttccttcccaggccatcctcctgggtcttataggatgtccttaatcagaaccacattactcagctagaggaagtccttgtgcagacgctggcaagacactatggcaaaagagtttcacaacatgaaaggtcagattgagaataaaagctgcagttatctgttgtgttttctttagttgagaaaataaaggcagggtgcctaactcctgaggaaccaagatttggataagtagcagccacttaggaaaggagttccattggccgctgagtacaatggccagttgtggaaatggaaagtccttaaattccaagtattctggacctgagcaaggattttctcattttatacagatacgtttttatatttcagtaacaccctagactggtaaaacaaaaatagctacatcttgtcaaaaaatataattgtcactggactgtgtaaatatacacacatatatatatatacactacatatatgtgtgttagatatacacatatacataatatatattttacatatatgtgttagacaaataaagcacattttaatcgtaaaagctaccagttattgtgcttttttttttttttaagtgccaggcactatgttaagcactttccatgcattatttagtctctcaacaaactagcatggtagggactagctttgtccctattttacaaatagaaaaaacttgagattagagaggaaattcaaggcacacagttagacacagagccagaagtggaacccaggagtgcctgacccccgagcccagcaaattgaaccctagcaattctcacttgttccattaagatgagtgcccaagctgactgtgaaaaacaggggaggaggtgaagtgatgagccatttcacttcactaacacataggtgtgaaggagttaggcgttactccaaccctgtatcttcatcccagggaggcagcctgcaggctttgccgatggaaggcagggtgtgagaaaaggaagaagtgattgcaaaaacccaagacccacctcctttacaaattttgcccaagatcagcctggctggggagactctgagaactcagagggaccagaggacttaatggaaatctgtccctcacccagtttcaaactgatagccttcccttctcatgcaaggggcttgccctagagatttggggcaagaaatatttccagtgcgcctctaccttaactcacaccacaggggcagctaacaattacagaaggaatgaactttttcatcaaatgtccttccataaaaccatttcccaggaaatggaacacagcatgaagcaagccgactgcaattttccaccaacaatgagcatcgtggggcacaggtactatatttaaacaattttcctccagcgttttggcaaggctgtctctcaaggagacttaccaagttgggctgaggtctcattcccctccggccagcaggatcagaatgtttaatatggccctgtctcttcaacacccatgtgtaaaccaccaataaacaagccaggaaagacctgcaggcctaattgccttttaactctgccaagatgataaactcccagagcaaagaaggaaagacttccagggatttaacaagtttatctgcctgccacttgaacattttctgtctgcctacacttcagtgaattcaccaataaaaggataaaagggcccagaatgtcagacccctcaaatgaccaagaagttccacattcaaaacgtatgaccagcaaaaattaaccagttaattgagcttcattttaggtgtttttaagatctggagcaagggaagtggggccacttgactctttctagcactggccatttctcttttattgaccaaggcctagaaatctttacttacaataaagaaaattgttttcacaaggaaactgggataggcaacccattctgaaacctctaaaattttagatagagcattatactgacaggagagaaactatacaaatctcggtggtgggagaaatggagtatatcatatgggcagtcataagattggtgtttacttctgtaaagatatttttcatctctccctgaaccaacttgcaaattaagcatgttggttgtttttgttggtttgtaccctaccacccagaagaaaaatactgagagctctttacctattggagttaaattggaaaagcaaagcaacaccaaacaaagagacttggggtaagtacagagaggtggtgccattcaaggcattaaagcagggtgaatgggcatcacctctgggaggccatttcacaatctttatcaatattaatgtgcaacttcccttttaggaatttattccaaagaaattattggctaagtgaataaaggttaagcccaaaaggctttagggaattctactagggaacattttaaaacatctaaagttcaccattaataactggctaaagaatgcaaaattccatactccgttactataaaaatgattccataggtgtatatttattaatgtggaaagtgtccaacatacaatgttaagttcaaaaagcagattataaaaacatttataatataatcccattctttttaagagtctatatatagtaaaattagaaagatacatagttcaccaaaatgttagtatttctggatggtggattagaggggacttttattttctttggcaaagatttttgaattatttgaaatgtttaatgagaaaaatgcattgcctttagaaatgttaaaacactaaagcagaacaataaaattgaataaaaacaaaacattcccaccaccatcattactgtcctgatcaacaggaaaagctgaaacaacatcatgggaagacccagctatcctttctcgaggaggcaggagtagagaacgctgatggatttggtcttgccttatcagcacatataactgttgttcaagcgtagtctccagtgagatgcgaatggaatggtaaaaccacaagtgggctcaaaatcccaacaggtgtcttctccaggggacccaggtgtctctctttcctggaatcatggtacaaatgtcgaggactcccctattaagctaacctgtaccacttaataaaacaggaacagttcttaagtacggcacttgccaactgaaaaatctggagcactatttttctattaaaaccttgtccatgtttttcctattggaacctggaaactggacaaattctgaagaaatccgaaggaatttctttagaaaagaattctgttaacaccaaaagctcccaagcactacacaaggcaaatgctaggttgcgttacgctcaaatgtaaaagcagggttccaatccaaagtgatgtgtccttcacaccaggctttgtgtgcatcagggtttatgcatttgtacactgatcctcgcacatttctgcatctccctgcttcataatttcataatcagttccagatttcctatttcttccacatcgtaaggcacagagttccagatttgagagatgcaaggtttaagggtatgaaagtgcagtgaaacgtacgataataataaaaccaaaactgaagttttgtttcatacccactgagaagtaacaaactgagtatataccttgggacccatctgatcttcagaaactgttggaacatggtagacatgtacaaaaatttcatatgtaaagtggatcctttggttggtagacctccttaccaacaaagctaaaagtgttcctacattgctataataaacacatcggatttggatatgcctgccaaagcaccataacgcttctctcaaaattcagaactctgtctctacattacaagacagagcaaactgaaagatcaggttaatctaggataaacttcatctcttgagttcaaagacaactggcctctctaggggtttcaatcaagggttctttgaaggattgctctcaaattcattaaagaaatttcactgacttcacagactttggcattaaatagataacctgagctcttcattgcctggcaaaatgactgttcacctttgaagctctgcaaattgggattaagttggctgtttgccttttacctcaaagatgactccactccattgaccagcgagtccccaggcaatgacctggttgatcaatgacatcaaatttatctctacaatgtgtctcttaaaacacccatcctttcaacagattggctttgttatgatttttgctttagatgtagtagtactcttgataataatgccatccccataataaaaattcaggaaatgaatcatattttaaaaatccaagtgtaatttccagctaacttgaaagatgtgtggggtttttagatgtataaactcaacttttaaaccctgctttgaatttcgcttcctcaattaccacagaaaatgaggtgtctcatcagaccctggagcgagccctaaagcagcacggacttgcttttcacaatgactctgcacattccggagaaggatcggcataaacacataggttttcaccctctaaccccaccgtctgcttcctctgtgccccataatctaaaacatctcttcttcgcaggtatatggtcttggatttgtcacagtgtacgggagactttacaaggccaataaaatgacagctgcacagagggaactgggtggcttttaccgactctgaaacaccactgcctttaactcccagggatcaggaacttgaaagcactccgattcacttagctctgtgtttgtcataaagttaaggctaatcagattttccccaacttgcagccctatcttaaatcctcaagctgctcctatgcaaacttaactgatggaagatgtgattacgccttctcaggtcataaattctagatatttataacataactgttgtcatttaggccaattaagatgcttttactagctcggaacaactacctatggggcttgtcaaatactctgacagtggtttatgacccttcacagtgattttatcttatagggatatgaaagatggttgcatgcaaaaatagccaggaggccttgaagcacattcttcatattagcatcatccataccccatttccattctgtcccctttcttatccactaaaaccccgatttgactctaactgccccccctccagccagagttggtttctttgatcaccttttttttctccaaagacctaaaagagggagataacacctcttgagacactactataaaacacccaagtggtgggctggttaaacgcccagctgggaatgccagacttccacatgcataacatgtccctaaagacaagtgggttttccttttcacttagggcaaacactccctcatgaaaagcaaaagagggtgggtgacaacaaagaaagaacgggacatatttggggagttcatacagacaggttatagcttctccttttcctttgtgaaatatcgcttatctactactgttcccctcctgccgtttcttcttttaacaaggcccccaagcactgatttcaggcactgtactaggctagggatacagggatcaagaaacactcaggctggctggagacacagacaccttgataattataatgcaaagtgttaacaggtaacaggacagtcatgcacagcaaattctggaagcactgaaaagtggcatttcacttttggaagggaggtggtcaggggagattccttgggaaaaagaattcctagtctgggccttagaaaatgccaggagacagctaggccaattgggggagaaaagtagttccaggagggagagaaagaacaaaggcgtggattggaggaggacatgggatacgtggaaaatgccaggcaggtgagtgttccagagcatcacatccctgccaagcagcagtgaaaattgaggctggaaaggaaagtcagggcacactcctgtgggactttgtattcacatgacataagctatttcctttcttgttcaaaggaggcctggtataatggtgctcttttcataaacctaactggacatagttgggtaagaatttttccatccgaatctgtttgcttcgtaccgccatccatagctggcactgtcaaattccccagactaacttgacagacataactgtttgaaaatccggccacacttcccttggtaaagaacgctttgctttcgatgaccaaaacaacactatttgtagaagccaggtaaagcacccaaaattccacctgatataacaaatatgaagtgctgactccatacaaagtcctattctgggaatgagtcagaaatgtggtggagaaggcaccacctcagcagccagtggattctcaagtagacagtgacacatcatggatcttaaaatgtaatggtcttttatcaatgtgattttttccttgtgtttctaatgatgacaatttgattgaatttgaccaaaggaaaaaaaataaaaagtacaacatctacttggccaaaggaagataaaagtgtggaaaatatatcatagcatttgaaattctgcagtatgggcaaatgcaagctaccagcaatttcttcaaattagcagcttaaatgtgctacagagacacaggaatcagagtagcagtgctaacctaggcagtcctcaaaatgatcaaattggagttcattttcaagaatcttatggaagtttttgctgctgttaaaaattttaaatatttgactttgtttgtttatactctgccttggtccagaaaggattaaagcatctaataccaaacagaagagggtcatattactggaagagtgagtgcttgagttcctcctcctcatattagaggaggagtgagggctccagttccatctgccatgcaaacgtcaagttggttccgaccgagacttggaccatgctgattcaaacccagaaaatgtttctaaaccagaacattctgattcaacacaaaattccccagctgtggagcaacaagggaagaactgtgaatccacttctagaggaaggctgggaaccaatgagctttatcagctgagcaaaattccagataaagaattcatgttctctgatttgttctccatgcccacatgtgacttgtttctgacctgaggatggtataaagtggcacagtgcagtgggaggcacaagccccactgcctggtttgcatttcagtttcaccacttgggcaagtcacctgagctttcattccctcagtttcctcattaccacagaggattactgtaaagactgaaagaattaatacatgaagacagtgcctggcacatatgaagtgctcaataaatgttagctgtaattatgattttctattcctctgttaagcacagagagaactacagaagtaaagacccctactttgtcatgttaagtatagtgaaccccaagtttctcttcaaagaatcagtatgtcagtatgttcagctctcttattctttgattttccattttaaagtttaacttcctggttctcttcgccctcttgcttctagtttcagtaaacaacatttttccaccagttttaatcagtagttcacatctgttcccctggtcacctgctttgacctcagtcatgcctggtcacctgctctgacctaagtcccctttagttatctattcctaactgtccttcccaccaaactattcaccctgccactctggttcatacccctgctctgtttaaaatagccaatcagaattagcttagactgagcagtccaaccctagccaatagaggaacgacacagcagtagggtcctgcatcaggaataagaactacttcccctcccctgtccaggtgtgctctcgccattgttccatctgcaaggggcaccctttctgcagaaagtaaaaattgacttgctgagagaattaaatttatgttcaagtgctatttctttgcagcactgggtaacaagcattttgcatttctaacagtctatagggaatttccagtcttgcttcatgtatgattgccaaaggagaatctgccaacggtgatcaagagaagggaattccaaagaaaattgggttaggactccaacagctcaagagagaggggtttatggcatattcagaatttcagaggaggtttcctaaaggagcatatctgggctgaatccaacaggtaggatgtaggcagatattgggcattttagataatggcaagcaataagcacagagatgtgaaaaaaggaatgaacactatttttagaagaggaaaaatgatacctcattatctgggaatggtggaaaattcataaaactgcgcaggggggcccatgcgggaggaatgtgaggacgagtctgaggtagttgaacctaatatggttggaaataaagaggaactgacaatgtgtcgccacgggagggacacagagaacgtggtgtttcaggaaggtgaacatggctggggcatgcagggtggatgggatgggaaagttctgagtcagggaaaccaccccagactggtgctgagaggacagagaggaagtggtggatgggagaggtgccctgtgggaagaacaggctggccttggccagtgactagacatgaggtgttaatgctcagggtctggagtctgacggcatgggtctgaggctcagctctgccactcagcagccttggctcggggcactgactcagtggaaacccagctttttcctctgcaaaatgggaataagtgtgctgacttcacctggatggaaagcacttagcacaaggtctgctcatcccaaagtggtcaataaatggtaaccatgtctgtggtgtcggtatgataaagaaaaaggaagaaaaaaaatgagaaaactgaggtttctacctggtcctgaagccactgaatgagacacagtcctggctggtccctagttccctcttccagagacctcattaacatttaatatcagccacttaatgcctgataaattaagatgtcagtgtaaatggaggcttgtttattatgtcccttttattacataccccatccatttccatctctccatggaaaccaagtctttccaaaaaggaaaatggtgataaccttgttttatttaaaagaaatagcttaggccaggcacggtggctcacgcctgtaatcccaacacttagggaggccgaggtaggcggatcacttgaggtcaggagttcgagatcagcctggcaacatggtgaaaccccatctctactaaaaatacaaaaattagccaggggtggtgatgcatgcctgtaatcccagctacttggaaggctgaggcaagagaatcgcttgaatctgagaggcagaggttgctgtgagcccagatcggaccactgcactcaagtatgggtggcacagtgagactccgactcaaaaaaagaaaaaaaaaaaaaaaagaaaagagaaagaaatagctaagttaaaaaaaaaaaagtaagtgcttttcactttatttcataagaagagggaggaggaggctgggcgtggtagctcacgcctgtaatcccagcactttgggaggccgaggctgatggatcatgaggtcaggagatcgagaccttcttggctaacatggtgaaaccccgtctctactaaaaatacaaaaaattagccgggcgtggtggcgggcgcctgtagtcccagctactcgggaggctgaggcaggagaatggcgtgaacctgggaggcggagtttgcagtgagccgagatcgcgccactgcactccagcctgggcgacagagcgagactccgtctcaaaaagaaaaaaaagaagagggaggaaaaaagatgacacattgtaccagtgattacctgcccattttaagccctgtcagcaacacaaagacttaaaccgaagtgaaatacagggcgcattatccctttaagcccttgagttaactcaaggggactgaaaggcatgtctgtatttctacaggaggtttgtggtgggttcagaaaacatttaaagaagtaccctattatctcaggtaggtgtgttccaaagaatctaaactgaatgtacgtctgttttggttcctgaaaaatgtttctcagctactttcgcttcccagagtccatcttgcacaatacaaattacagaagtgagttgcattttacctagtaagtctggaatgagcagctaaggaagtggtaacacagggaaatgtttctttagcatgcctttttgacctttgcagaactgtccttgatggccctgagcatgccagcctttacctcccagttaagcttgaggtatttggaaaacaagttttgaaaaaagccacacaatcaaaggaggtcaggcaaatgacttggtactgatcagcaccaatgattagccctggtggttactgatgtaaggaccccggatcctttaagaaaccagaaggagagaaatgatggagtaacttccctaagtccgctaaagcatatttgctgagaatatgctctccagtcagcctaggctctggaatccctgagcaattatcattttttccattctttacacatgcaactcattagcattacagcataaatgagttttactagccaggtctgcttatttactgaataaagcccaagccagtgattgcttttattacagaaggaaattcatggcttctcaccaatcctttggataaggtggcattggaaaagtaacctctaaccagacacatggtacagaagaattgctactgctcaccagagatataaaatccaaaaggaaatgactttacccaccatagaagctccacagtactcacaacttgtcatctgtgtataacagcacaggtcataggtcctctcagacctggagttccttcaacacgttcagagccaggtgaccctggacaagtaacatttctgagtctcagtttctagcctttaaaatggaaccaatatctactcacttcacaggacattgtacaggtcaaatggattagtgcatataaagtctttaggattatgcctggcctgtgggaatcatcccagaaatatctgctattgctattaatgtaaaatcaaaaaagcacaacctctatcccactgaacagtgttgtcattcagggctctgagtaaattattttcagtggataaatcatctctgaatgagacaggaacaaactgaaacttggcttcagctccacaaaactgttgggtccactctttcttcagaaatttcttcttttggccgggtgtggtggctcacgcctgtaatcccagcaatttaggaggccaaggcgggcagatcacctgaggtcaggagttcaagaccagcctggccaacatggtgaaaccccatctctacaaaaatacaaaattagtcaggcatgatggtgggtgactgtaatcccagctactcgggaggctgaggcaggagaatcgcttgaacccaggaggcagaggttgcagtgagctgagatcacgccattgtaccctagcctgggcgacagagcgagactccatctcaaaaaagaaaaaaaagaaaaaagaaaaaaagaaatttcttttttctctgggtctgtttaacaatcatttttagcagagcagatcagattggccatatgggtgagccaatatcgtcaccttaatatttagaagctaggcaagattaatgagaagatgagtgtcttaaagccacagaaacacaggaccatagagctgctcaggcccttgagaaccttttagtttaactctttcttgatagagacatcacaaaagaaagtgtctttccatgggccacaggtcatgaaagagacagaagcaggactgaaatcatcaatcaagggactttctgtgaccttccatttttaatttaaaatattagatgttccttggaattttaatagaacttggatgtaaaatcatctggactgggacttggtgcttttttttttttttttttttttgaagaaagggggcgggggtcatattttagctactgatttagtccttttagtggttactgatatatttaggttggctttctatttaattttgagtaagtttagaatttttttcagaaaattgtatctaatttttaaatatattggcacaaagttactcataatatcttttattgtaaaaagtctctttgtatctatagttatacccccatttttcttcccaaggaagcattttgtatcttttctccttcctttttcttgtttaacctggacaatgattagactacagaggagatgtcaacagaattttctgcaacaatggaaatctattatctacagtgtatgatatgaacagacctgcattgtccaatactgtagcactagccactagctcagtgtggctgttgagctccttgaaatatgactagtgtgactgagaaactgagttaaacattttgttgcattttaactaatttgaatgtaaattgtcatgttaccatattgtgtcatgcaggtctatgatatacatagggtcttttcaaagattcagcttttattttgaaaaccatctcatattatttttgttgttgctattttctatttacttatgcctttgccttaaacatttttccttccttctacttctttctgtttactctgactgtttttatgaagatcaatcagtagccaagaaatagactggcacagggttccatcgaggcccaaatcccttcttccttggattccagtcctaaaggctcagtaggaaaggcctgggaaaatgtcattgaaaaaagaagatgaaaagcggaaggcttctagatgaaggccaagccaggaacctggctattaagaatattttctctcctccccaaaatgagctggttgaatccaatgtgacactgaaagggaaatcaaaatgcctgaagaacaagttgtagatttgaattctcaagtacctgaattcctccttgggactgaagcctctgacatatgatactttgtagagagtgtcctgctagccatgccgaaatctggacaccaagaacctttcttatatgaatgaagttgagaaccaggagctttgctatccagggatttcaccatttgggactaagaagcagagatggaaggaaacagatgcagatgaactactgtaaagggacaagaagaaatctccctttgcctggagggagtctgtcttcagacttgaagatgagacccaccctccataaagcaaggattcattacacttgcagtctcctgggcctcgcggctcacttggagccactgagcaataaataccatgaagctcactatcatagggatgcctagggagtggggtggcagagatgccatggctcccagagatgatcggaagccagtacacgatgaactctagaaggcttaagctgcttctgctttgatgcctggggttgggaggaagccaaaaggcttatcccaaaaggactctcaaacactagaaataaaacacattgaaacttacagtgacttggagagcatgttaggtaaagttagcttatgacttccagttttcctggtgattttattacagtaattcaaggtttctcataatattccttgcttcttgttacttttgaattgtattctaaatgaccaaagtatcctaaacacctacattgcataattacctgtatactcagaaagagactagctgttccctgatcatgtatttccttaaacaaccagttgcagagctgggcactctgccagggctgggcttgcgatggtaaaccacatagataaggtacttctcatgaatagatgttctactgaagacaggcaaacatgttaacaaataaataacttaattcatatggtgacaagtattatcaacagtataaaacaggggaatgtgacagacaggacctggagggtgtgggagtcctcttcaggaggttacagataagctgagccccacatgatgagaaggagccagccttctaaccatagagcgggtgggctccaagcatatgagacagcagtctcagaggtcctgcgtggcaataagctagtcgtactggtggggaggggtagaaagaaagtggggtaccatgaatttggtaaatcagtgcaaggctctgtaacaggacggaagagaagacgggagccagactgggggagcccttgtgagccagtaaggacttcacattaattaaaggctcatgaaatatttgcagctactctcctaaagcatactatcagacaagacactttttgttttgttttgttctgtttttttgagacggagtttcgctcttgtcgcccagactggagtgcgatggcgcgatcttggctcacggcaacctctgcctcccaggttcaagtgattctcctgcctccgccgcctgagtagctggaattacaggcgtgcaccaccacaccaggctaattttgtatttttagtagagacggggtttctccatgttggtcaggctggtctcgaactcccaacctcaggtgattcacccgcctcgaccttccaaagtgctgggattacaggtgtgagccaccacgcccggccaataagacagtttttatacttccttactgactctcaaagcaaagtagaccctgactgtggggagaaaggggagattacactggtactttttgcagattatactggtactttttgctcaatgagttgggcaagaaaccaggtccttctgagacctcctcatgtgtctgcagccatcaaagacactactgtaggggcttcacagagctcacgggcctccctggtggacacaccgtcaacttggataggcccaaattccttggcagtcatccctgcttccgcctctaggttttacacaaagatttttttctttttttcctgccactgggaaaagtacataaaaataggtgtgccacttgaaaattaaacagagagtaaatacccagagtatccgggctgtgatctagataacactggagaatctaagagtgggaagtcacgtaacataaaaataagaaagaaggaatcatggcagtaatgatcagtttggaaaaaaaaaaatagatggaaagaatttggaaggtaacaacttccagatggtcctggtggtgaagatagctatatatagagaaagagaggctaattagttcccaggctgaggccctagtttctgttaagtaagtgattgtctcatggtggtttagttcaatactaggggacacacaccacattgcgagtaaattaagtatttggggttttttttttccccaagcaatgggaattgcccaaccttaatacaattaattaagactcaatgaatgtttaattgagttctggtgcttgtaccagggacacaatgggctctttgttttggccaagctcctaaatattgggaaaaggaagaaaggctgaaaaagagcaagggttagtcaatagctttcccctaaatgctcagatgcacaagttggtttccaaacataacagccaattcagtgaaatccaggagattgcccttggaggaggttgtggaccttccaggaagaaaggaaaaatattgcctgacacctccaggttggcactgaaagttacaagctagtttcaaactcctcctccaaaactctagctctgccaactaaatggaccatctttacagtgtacactcaactaaactcccacttggtttcttcctattgtggagtcaggggctctcagcagtgaaaagaaggttgagaaaatttaggaggtgggaagagtcattggaatgctctttccagaatactgtgaccaaatggacagcttttggccagccaccaaccatcacctgacaggtggctggataaagatgtggggatttttatcactctcaaatccacactgttggcttctaagagaattccacaaagagcaacaataacaattaaaaagtgcttccatttgtttaccatgtatctattctatcagccctgtgtgtggcattccacttctattatctcattcaactttcacaacaatattgagtggtcagccctcttatcatctcccctggaacatatgcagaaactgatgctttgagatattaagtcctttgcccaaggtctcatagctaataaatggaggaactgcgattgcaaccaaggatgcttgaccttggagtctgcactgagtcttgctcacacctgatactgtgctgagttactctctgaatgaactcccactgggcagatgagctggaggaactgccaaacagctggttccctctatgcacaccagcaggggaagtcttgatcctttggccaaacaggaaatatgtgatgtgtgcccatatacataccaacctgcagagctgccaagtggcaattaacactgtggatccctatagaacatcagcttctcatcttggtccagttgtacctgagaactaactgattggagaagagaagcaaggaggcccagggtaccagggtatggatgaccatgaggttcaagctcatatttttttttccaggaatctggtcttaattcactgctggaaggctgtcaggctctgggaaaccaggtgagatggagacaaggaggcaaggacttttgcccccaatatccagctctctattctcttaagtttggtttcagtggaagcccaaggggtggcccaaagacatctggcttggccatgtgttatgtcccacccccactccatcctataggatctttagcagcctgagatgattgcagtcctaatctagaactttgggatgactcaaaagaagatgtaactcacctaaaccatcattacatcataatatttagagctggtaggattcttggggataatttagaccaatatcatctctcaccccaattaacaccaagatcctcaatataattctgtgaaagaaaggaagagaagatagaaggagtgaagagaagaaagaagaaagaaaggaagttggttagtcagctagctgtttctgagaggctaaagggtcccaaattagtttcgccaggactaaaccacaagtgttcaaattcctagtatgtgatcttcccattttatgaccttgtcactattttttccagagtacccattgtccacctgtctatttatccatctaatcaagagaagccttattgcctattatctcctaggcatagggaagtgcacacatgagtaacctccctctttggtgggcttttgtgagctctaggataagtaaccaatgtctagtactgtgcctgaccgatatcagcacacaataaatatttgctgaaaagatgcaagaaagcacccagataacataatccagggtagaacataaggacctaggaacacccccagcaactgaaagagtacctgacatagagaatgcattccataatgtctgctgaatgaatgagtgagtgaatgaacaaacagaattgagtccagcaaaacctgcactgtgggctttaagaacactaggcagtagggtctctggagggatgactccctcacatgaccttttctagggggtctaggattttataaaataactctatatcccttccccacgaaggttctgaaaaggtggaaaaacactgagtggcatatctgtctccctctactgggctgtaagcttctcggggactgctccttatttcaagggcctggcatataatagatgtttatttaacaggtattgagaaagcagatacatacatgaacactcaatggcctttcattaattcagcaaatacttatagagtgcctgctatttgcaaacactggcctagactctggagctgcagcagtgaggataatgggtgaaatgtttgcctttatggagcttacattctgctgagtccaggaagagtgaatatatttctcctttcatatttcattcaaagcaaaactaaaccttaaatgatttcatccttcattctttttaatcaacacaaagctgactgatgcacatccctccagtccccttcgtttctcatcacaaaacacaccatgcctgggagtcaagggtcccgggtgggaaatgccacatattctgcccacctcccacatggcctctatagagacttcatttgtgttccaagatcaggggacttgccactccaaagcagccccttcagatgtggtcagtttgtcagcacatatcaaatgcagcagagacctctgcattagggcagcttagcacaaaagggtctggttccctcctcttcctatgtatgtggttttcaggcagctctgaaggggtggtgaggaatgcaggtcacagaatgccccagacacgaagacagtttataagaatctgcccatgccataagtactagacaaaagttgagtttattttccttgaatattacactttatgtatccatgcattcccccaggatatccaatgcacagactgccttgaagctacttgggatgtatgtaaaccatacattcatgctcctactatttattgggaccagcctgctctatttctacgatcttggccaaattctacctattgaatattgtcagtcccggctgtaacataatcctggctgagattcacatgaaagatgtaatcttgacaagccatttagaatctcttctaaaaaaacgtaaaagccagcattcttccagaggaatgaatcagtctgataaaaatgtctacgggggaagcctaatcagttcatacgagaacctgtcagtagaacctctacttagactgtaagattaaaccatcttcatagtcattagaaggaagtgtggtccattcggctaagatggtcttctcctatttccaattagaaactctggtttgcatttatcacatggagatgctggcaaaagctgtgtctagaatgagcattaaaaggataacgcaatctcacttttgctcactaatagtggttcatttttaacctgttaaagcaggagggcaactcttccctttcccatagcacttcagagttctcaaagggaaaacctgtctcactttattatttcttttttttttttgacgagtctcactctctagccaggctggagtatggtggcacgatctcggcttactgcaacctccgcctactgggttcaagcaattatcctgcctcagcctcttgagtagctgggactacaggtgcatgccaccacacccagctaattttttatttttagtagagacggggtttcaccttgttggccaggatggtcttgatctcgtgacctcgtgatctgcctgcctgcctcagcctaccaaagtgctgggattacaggcgtgagccaccgtgcccggcctattatttcttttttctacaaatcctttttttgacctcttatccagacagtcatctgctgattattttaaaggtatgcgaatatttagacaaatcctccaagatctctgtcaggttggaacaggaaatgcttcctgtcattttaatgtttataaacattagtggtgaaatcatatcattatgagggaaaacattttcagatgattttttttctttcttttttttttgtctctttgtctcgctctgtcacccaggctggagtgcagtggctcgatctcagctcactgcaacctctgcctcctaggttcaagcaattcttgtacctcagcctcccaagtagctgggactatagacgtccgccaccactcctggctaatttttgcatttgtaatagagacggggttttatcatgttggccaagctggtcttgaactcttggcctcaagtgatccatctgtcttggcctcccaaagtgctgggattacaggtgtgagccactgcgcccagcctcagatgattttctgatatcatttaaagcaactagagttcaagtttagaaacacgcataatgaagaatcatctcaacccagcagaggctctcccaaataagtggcaacttcactcatccatcactttaaatagcaatcgttcccatcagagattttttaatttttatttttattttattttattttattttattttgttttattttttgagatggagtctctctgtctcctaggctggagtacagtggtgtgatcggctcactgcaacctccgcctctgggttcaagctattctcctgcctcagcctcccaagtagctgggattacaggactgtgccaccatgcccggctaatttttatatctttagtagaggcggggtttcaccatactggcaaggctggtcttgaactcctgacctcaggtgatccgcccacctcggcctcccaaagtgctgggattacaggcatgagccactgcacccagcctccatcagagatttataaaaatgtattttcaacattttaatctttcttcctttctcacagtaatccatattcacagggcagaataaggacaaacatggaacacactgtcaaagagtaaggctgacagtgcagagtctggagactaacaagcctggttccagtccttgttctgctccttgctgttgtaaccttggggaaatcattcacgttccctcagcctccatttccccacctgcaaaatggggtaataacatcatcgcctcacacagctgttataagattgagcacagcacctgggacactttgtgggcttggcacagtgcatagagcaccttagatgatcaataattacatgtgttcaatgaacaaatgagtgcatcgatgactgaatctcttcctacccaaactataatacactaaatcaggggtcagcaaacttttcctgtaaggagccagcaagtaaatatcttaagctttgcaggcaatatggtttctgtcgcaactatttacctgtgttgtgacatgaaaccagccacagaaaataaacgaagaggtgtggctgtgctccaacaaaactttatttacaaaaacaggcagggcactgaatctggcccgcagccctacggtttgcagacctctgttctaaaggcctaccttgctaatgacaaaccagacctgatttgcaaaataagtgctcagtcatgacttataagcctagtgttagaccaaatcactccaagggaagctaggaggccatgagaagtcagtccctcctagcttctctccaatcattcactgtgccctgtcacacacttcccgaccattgccaggacctgttgtggtctcacaggtgtgcccgttcactcctgtcttcctgtccctctcctggggactggcccatccagtataacagcctgttgcacccagttcctcctgggatcaggcctgtggctgaggccctgacaggacaaaggtcctcctggaatgctccccttcttttctttctcaaaccaatgatagcactcctttgtccaaatcctcagagttggggatagaaactttctcatctatgtctaggcagaaaaatagaaatgtaattccttctcattctccctttcacctggagagtacagaaacacactgtggaatatggaaaggcatgaaccagagctgctcaaaggatgggtgggagtgcgcttaggtagcatctctacctgctgaggactcatcaggttccaagcactgccagggaccaggcccatgtgcagagggagaagtggagttcagaaggcatgaggggcttgtgtgaaggcacagactgggagcagagactggcatccaggctgggctgaccggggtctcctcaactctaaaacccaagttactgcaaactctaaaatccaagtctctgcccctgggtgcaaatggcagcttgaatgcattgagtactcactggagccagctttcaaatgcagtacaatttgcaagcattttacttattgatatgtttagttttttttgttaactccctactagacaatcaagtcaaaagaacctgctctctctatcgagcatcgtcactggcacactgtaggtgtttattacatatttgtagaatttgttaataaagaaaaataatgtgaatactagatagtagtagctatctacatgggctaagaatttgacatgcattttctcactgacccctctgactcaagttagctactgttatttttcccattttattgatgataaaactaaggatctgaaaggttaacacttttagcccaaggtcagaaagctaacaaatggcaaaagcaataattgaacccaattctgttaggctcttaagccagattcctcttactccattcatttctccccacacaatgatttcccttgtcccaaaccagacagtgagcccgctggcccagggccccattcctcccacaacaaaaagtcatcttttctctttccccctgaccatgttcattcctagtgtctggaaactgccctcacctataaaatcaggataattttccattgtcaacacacatcccaacctcctccatggggtttttgtgagaattaaccccatttgcagccattaattaagctgttaaaagcacaagtagctttttctccatttttacatggcttctcaaatggttaatgtcgagttctttcttggtgcaagcacaaggagctcataacttttcaatggattatgaaagttattccccgaggggctcggcaaagcagtcatcgttgtgcatagctttggcattacgtcagtgaatttagtccttcctgagctaatggtggttcttaataatattattggaattattattaccttcaattaaaatgttggccatgaatgacttactacttcagagagattccccaaagagtcacgttagagtctgtagtctttctgctaaagggcaccataagaacaggaaccagagtccttgcccatcccccaagtaaatacattaattaataaatacacagcattcaaatacttttatgttgttggctggttaccaggttttaaattgacttccttaagggtggatagggctggctaatcactaccactttgttctaaaaactaaaaggaaatcaggaaaactttacgcattgttctttatttctactcaccaaactacattagaatagtattattggtacagctacaaccttcacagaatgacctccatcttatcttagtggagatggtggacagcacagggtttggtttcaaagacaataagatgaatggtacctggtaaaagcactacctatgacatctcccttgacaatacctgagcgttgagaacaccctatagaaatggcttcaaaaccaggcaaattgctcattggattcagggtcggtgagctatctaactctgcatatgtgcatagaggtggaggaagttctcaaacaaagagttgaaagaagtgtgtaggctgggtcaaagaggactttggctgtgtccagaatctgatactcagacagtatgaaaatgtgtcaccacttctagggagaccaggtaggagaagagcactaccttcatccacagggaaagtagtgctagcatgtcccaaccccaaatggacagagagagaactatctcaagggtgtggtgatgcgtcttggaaatccaggtgctgaactgcaggggaggaatatctgaggccagcgaagacaatgtattcacaatcaggagactggggaccaggacatgagccacagagaagcctggggagcctacaggagggagagaaagtataggctggagacaaagaggaagaagagtctgggacacactgtctggcacaaaatagacacagaaatagttgttgaatcaatgaacaaacaagtgaataactgggggagatctaacatcctagcttggcctgaaagctctgttgcttaaatctacgtcagtcaggaaagatttcctgtgtaaataccttggctgatttcgatccttatatttagaaaacctgtctcttgcttttaacccaaccaaacctaattcaatctacttgcctgaatgtgtgatactttggtttttgtggggtatgtgtgcgtgtgggcacacgcacatgtgcatgcacacatgtttaattttcatttctaataaaattaacttaaacccctgtgttgccgatgagtttatcaagggcaggaagcagatgttttcacacttggaccaaggctgagggagaagaggtggtgcgacactcaaagtctcaccgttgcctctaataagaaggaggcagatccacacagggcaggagccccagggaaagctatgtcaatgtcggagggagcagcttaacgagcgctgcctggggaagcttgctctgcatgatattgaaagatgccacaattcacacgtcctgtggctgcacttcacctcccccgcagagaagtctgtggctgtgttagtgcagccacacccttgccttgattttctgtcatcctctttggtaactaacttggacttcctgcttccttgatagcccattcttggtccatctgtctttgtcaaggaatgagattccaggtttttctacaaggctcacattccaagaatggccttgtagcctgattctgcccaagtttttgcctgttcttgacatatattattgccttctctgccacacctttctaacgatcctaccttatgcacagccctggaaagagaaaccccacagacagcttgatctgccctaacttgtacagagttgactgtaccaagttaggactcctgcttcaggcaaatacatctataaggctggccagtgccatgtagcaggtgacctggttctgagatggattaatgagcttcctcccctagagattgagaaagagggattccaagagactgaaccagtccatgataaggttgtgggaacacggaggctgtggtaagggcatgaggaaggtaaagaacattgaatgagaggggacagaagaccatatgagaaagtagaagacaaacatcctgattttccactccccagatggagtcctgtgtagctcagctacccctctagcccttcaactccacaacagtccctgcaggtcttcaacaagccctgtaggagacgttctttttgcctgttcattactcagtacaatttatttttgtaacagtactttgatttttcttttggggactcacacttctctcattctcagactgtggggagcgaacacgacataggactagtcaattaaaataacttatttcttagccatatagtaattggttcatggataggaacgcgacaaaagttgatacaatgacaatccatcggaggggagaaagaggcttccatacatctggggtgtccatactgctatataagcatctggggctgtcagcagctgtttttctattttatggggaatcttacaatagaagtctgctagagaatgaaatccccttgggggaaaacaaagccaaaagatggtgaaagacagagacccaatgccattgtttttagcccctagatgcagccatacctgaagtcattataccctgacttttcagatataagagccaatataggccaggcatggtggctcacgtctgtaatgccagcactttgggaggccaaggcaggcagacctcctgaggtaaggagttcgagaccagccatgccaatgtggcaaaacctcatctctactaaaaataataaaattagctgggcatggtggcgtgcacctgtaatccaagctactcagtaggctgaggcaggaaaattgcttgaacctcggaggcagaggttgcagtgagccaggatcccgccattgcactatagcctgggtgacagagcaagattctatctcaaaaaaaaaaaaaaaaaaaaaaaaaaaaaagccaatatacactccttcccttttaaaaaatagtttgaattgatgcaagactcttgactattatgtatccttttaggatccagatagcctgtataggttcctatttcttgcagcacaggaaccttccctactgatgcctctctccttttccttctactgttttggttatcatgaataaggtgttaaaagaagagcagaaatttcaactttaggtgccttagtgcctttgtaaactgcatactcaaccatctagccatcttttccatccatcttactagcccattacgtttctcagtttgatccaagtagtcttaaatgtcttcagagggcacaaggaagattacaaagactattttaaggtgaagagtagcccattacttccactcaaattctattggccagaaatcatttgcatggtggagacatgcaatgttcccttactcccaggaaggaggaaccctagtgagtagacactgtgtgctgcactaacatagtactggcccaagataggcactcaatatttgctgaatgaataaacaatgaggaatgtatagagttggggattgtaagtaattcagagattcctccttacactatcaggcaaagaggaaaagccatatcccactgtcattcatgagtgagcatgttctctctccccagggaaataggctaagttcagtctctctgcacattcgcccagattttctctctggctcctacgctttccacagatcacagcttttttttttttcttttctttttttttttcttttttgacagagtcttgctctgtcgcccaggctggagtacagtggcatgatctcagctcactgcaacctctgcccctggggttcaagcaattcttgtgcctcagcctcccaagtagctgggactacagcatgcaccatcatacccagctaattttttgtatttttagtagagatggggtttcgtcatgttggccagtctggtctcgaactcctggcctcaagtgatctgcctgcctaccaaagtgctgggattacaggtgtgatccactgtgcccaaccagatcgcagctttaattgaccaattttgttttctacactgatttgctctctccacataatgatactgtgccattcctatgtcatcccaaagtgtgccaaatatctcatcaggtggggtgaagggagaggaatggaggagtttgcttgttaaattcacattgtatatggatttagaagtgttttactctcaagactaagcagttcagaaatagatgaggggcaatattttcctttactggaaaaaaaatatttttacactgaaagtcacatatatacaagtgtatgtatgcatctatctgcctaaagaggaaatcattatgaaatcttgttaccactttatttacctggttttatattttcatgggcaaatatagcacggaaatttactaaatttactcttgagtattttagaggcagtggctacccagtctggagaaacttttctgcaggacccagctgtggatggggctctgggagccagtcttcctgacactgcttggtaggatcaaagtgttttgtttaaaggaatattttcagagaattataatgtaaatttaaaaatgggattggcaatcatcatagatttagaatgcaacttaaaattttttttaaaaatctaggctcacctttccttgaatacttctttgatactgatatttccttgattgtggggaagatttttcaaaatcttattctgccttgaggtaatcattatgagcatcaatcatcatcatgtggatatagagcactggcaaggccaatgttagataaaagagagtttctaatgcctcctctagggtgtggttctgttttcaagggacttgccattacatccttgaactgaattttactggacttgaaaaaaatttgcatgcaaattccttattagggttacaatcttgggcaagccactcaatctgtctgtacgtcactttcctcgtctgtaagatggagataatgataattcctacctcatagggttatcatgaagattaaatgagttaatgcacataaaacattcaatagagtttctggcacagagaaaactttagctattattattttctcattatttttaaacatatgtattactgaacaagcatacctttggagaaatttatggtttccatttgtagtaaaatcagatgtaagttggcatctaatgttgaagataaaatatttagagaaaaaatattaaaatttaaatactattcagactctgaattattaatgcaaagcagctttcactataaatatttggtctctgagtttcaagataaatggaaaaaataatgaaaaccaaactcacaaatgccctccagacatggggatgctagggctagttaaaatatgactgtggatgcataatgatttgggggtctttacggacaggatgaaaggggtcaagcagatgctgaggagggcagggtgtgagagggcagcctggctctatccgcaggcccagtggccggccagtccacccaagttagagcatcaatgagctgtcaactagttggttgatctcagcaagtcactgaagtcccagtacctcccttttaccatctgtaaaatgagaataataataatagtcgcactctcttcaacttaaaaagaaaacaagggagagagaatagaaaacacgtcaaaagttaagggttagaacatgtaattcttctaccacaaacaagcatttctatgggaataaagaaagactttgtgaaagttatttattaagaaaaaaatgtggcatggtatatggacatataaagttgacctgatgtcatagaaaaagtgtggacgtaagccttagaaaacccaagtgtctgaaaagtaggaccaagcacttattaaccttgggcaagtcacctaactttactcaagctcagttcctctattagtaaaattaggacaatattacatgccccatatggtcactgtcagggacaaaaaaggctgaaaatatataaagtcatctggcaattaataggtacttaaatgtatgtgcataagtgtatgtatgagtgtgtatgtatatatgatctatatgatgaataaataatatataatttggagtttggtgtagatttggggttatttatatctatgatctagtatctgtgatccccttggatagatatcaagagggtatgtgaatcccttgaaatttactttatgcttgtgcattttctggggagagagtcctctgttatcatcatgttttccatccaaggagcccatgaccttgaaaaagattaagcatcaccagtgtagacagagagatggtgagagtgatgggtagctttgcttccatattgctcactacccataattcagcatatctatgcagtggtcatctagcgtgagaacttcccccgtttaaatacacaaggttctccttaccggagaaaaactggaacctggaagagggtacttgtctttgacagggaccaaaatttcaaagtaaatagtgggaaagagatctgggactttatctttaaaaatgagaccaaaatttttggaaatgagtatatgtatattatttttaataaattttaaactgtaatttcaacaacttgccagttttataaagaacaaagaataaaatatgggttgatttatttggcccatgtcttcccaatcaggttgtgtgagggcaccacgtgacctcctttactttcatcagtacagttgttaacagtcttatttttttaagagtctgcaaaaaaatatttgagacatgtgccactttcccaagaacctgtcataagcctctaacatccaatccctcactttgaagcccttgggctgtcatcatgcttattggcttttctttttaattgataacaagttatcttcttttgttaaggaatttgtatgtgacacaaagctggcttccaaaatccctttcatcagcttgataaagccttgcatcttttgaaaaatgtgctgcttcaattggcaagtgttgtgcaatctattttcactgtgtttcttgatgctggaaacatctggatgatccaggaaagacagatgtacatagagttgactctcgacacagtggggggcccaccgttaaaacgggaaggatgtctgagtggggctaatttgataagtggtccattaattcatgaatgtttcaatgttatgacaactttggctttcctgctaccttttaaccatcaacgttggataatgaattttcggataagggaaaaccaaggtgaatccctctacggttagtacaaactggtaccagcttggcgcaaggagaagagggccctttcagtgcattcttccaaaaaagccatgttgcacatagtggctggtgagggggaaataatacatttcaggcaagtgtaggttaaataagcccttgagaattagtctatgaactctactctagtggaaaatgaggcccacattccaaaccaatttcacaacgcccccatccccctttttaataacagcccatttttacatagggggttgcctattctgcaattctgtaatagtgaatttttgcttattgtgtttctggataacaaggtgtgcctgtgtttctttcttgcatatcggtttgcagaaagtaattgccctgcaattcttaatccaacctgttcacgcattcctttctgcattgttcttgttcgtcatgtctgagctgtcacctgagagctgatcttcctttgctaaaatccattcaagaagcatctttacccttcaagatgtctggtggaaagatacactgttttgactgatgtagcaaaacatttacagagcatctttttccaaagtattatactcttgtgttacttcccaagaaaaaatctgtttgtagaataaaatggtggaatttagatgaatgattgtctttttgggagagtgttagagggttgtcacttagtaaatataacctaaagaataataatgctaatatttgttcctttttcaccgaaaatcttattatgtgtgctagacactgtgctaggcattttgtatgcacaatctattttaaccctacttattactgtccctgtaaggctttttcccccagtggaatgtaagctccatgtagacaaggatttttgtctttttatttattgctacaaccctggtgtctagaacagtgcccggaatagactagatactcaacaaatattttctgaataataaatgaatccccattttacagataggaaagctaaggcacagagaggccagttatatacaatttacataaggtcacaacggtaataagtgaaaaatcagatttcgaacaatatttactagcaaaaaacctacagtcctaaaagatatgctccctttttccatccaacacacacacacaaacacacacaggtgcacaaccactctcagacgcatgcacaaagaagcctgcccagttcacctgcttcttcagctcaccacaggccgactgctgaaggacacatttttgttacccatcctcctcctcaaactgtcctctttgaacaaaaatcctctgtaggttcctctgctggcagtcttcattagtatttagtgacctcccctgcccagttctcgtttcctgcactacaatccccgcctcccgatgaactgttaattataactactacaaagtctacactcgcctgggagacaggctgtttggcagcagctgtgaaagccgaactaagttctttggggattaatccgccgctgcatgtagtcttacaagtacagctttggaggaaaggaaaggaagataaaatgagctaatgctgttcgtataaatgtgaacttctacataacacacacaggcgcacccacaaatacgttgactgaaagttaaaatatgattatcaaaggataagaaagacttacaactgtaatgtaaaacattaagaaatataccctggctttctgtgttctgcagggatacaagtgtgctctgagccaaggaaaattaaaaaaagagagagagagagacagagatagcacattgaaatatctttacgtagacttaaatatagcttcagagattataattcagatcaaggctagagctccatttcaacattccttaactgctggtaatataacaaaggtctgcaaattgggaggtacgtctgcttgggaagggatgcttatctgatctaggcccatctttcttcatgtttcaatcccagaacagctgcccttcccttggtgagaaactcagcgatgaaggcacaaacccagcaagctgaaagcgcagctggctgtggtcctgctgcagccgcctcgccctgtggagagtgtgcgttggcgggtggagcagaagtgggctacttgggggagtccttggtggctgctggcaggcagctgcatgccccgcaatagggtagtgcccatttgtaacccagcggggggtggtggtggaatacagcaagacgatggggccataagaaggaggcagggccagctgagcttcctgaagctggggataggttggaagggttattcttccctttcgttcattccctcactcgttccttcattcattcactccttttatcttcatttattttactccttttatctttctttactttcccccaaattattcattcaaatattagtagagcaatgcagtattaaaatcaaacgcatggacttgggggacagacttgggtgggacttccagtcccctcaatgtgccagctgtgagacttttggggaattattcaacctggatgagcttcagtgtcctcatctgattagcagacatcttaacagtgccacatctcctaagactgctgcaggacactatgattcagtgataaaggactttacgtgctgcctggcacatgctaagtgctcaataaacagcaggcattaggatgaggatgacagttctgtgggagccacagagatgtgtctcgcaggcggctgcctccaagggccacttgaaagatacccagtctgcatggttgtccctgagcagaggagtcatacatgagtaacaagataaaaagttaaaaaagtaagagagtcccaagaggaaggtgcaaagaaagccccatggagaaagaccatcagatccagagtctgtctattagaagagtatccctttgccctggttcagagacatggctgccgaggactgagccccaggcaggagaaatggtatgttaaggggctggcacacacaaagctctgagccgaccccagactgagagatgctgcttctgcttctgttatgctccctcagaagacagcttttttgtgacaagggggagcggcagagagagggtacaagtgggaccagggaggggacacacaccacggacacactggacaatttgccactctgtagcagttgaacaaggccgggcagggacatgaatgaagattccctttcatcccccatctcagaacctggggcttatcccacagaccagctccccgagtgtcctgaggaacaaaagttctacaagtcatccttccccaaacattccagagacacctgcataaatacacctgtgacaggcataagacttcacttccctctaggagtcacactgtgctcattagcacatcaaaagctctgagaagtcctgcatagacaatctgtttaacttgattctttcaaagttatccaacgctgaattttttttttttttttttttgagagagaggctcactctgtctcccaggctggagtgcagtggtgcaatcttggctcactgcaacctctgcctcccaggttcaagcaattctcctgcctcagcctcccgagtagctgggactacaggcgcgcaccaccaggtctggctaatttttgtattttctactagagatggggtttcaccatattggacaggctggtttcaaactcctgacctcatgatccatccgccttggcctcccaaagtgctgggattacaggtgtgagccaccgcacctggccaataattttttaaaataatgcctttgtcccaatccaatgtatgcgttttatacataaagaagtgcaggtgcagggtgaagaagatgagactctctcgaggccacacagtcagtgaggagctatgctgaacctgaatgctagctctggtgaacagctctttgccctcctcctcatttccccatggagccagggcacccccgtcatgtgccagtgctccttggaataggtggtgacaatgctgacacttctgtcaagcagaagtcattcaaggtgactgccttttaacacacttctaaaaacaaactgtaaaagcctctctgaaatgtctgatggggaacggatttttaaatccacgtcgctggaagacatgcaggtgggccaggaggcagaggggccggcagggaggggcacaaggctctgggtcccaggtcctgaatcccggctcagcccttccactgcccttgctggccatgtgcctccaaccctccaagcctgattcctcactgtgaaacagaggattgtgttgtcttttggtcctggctatttatgactggaaagagaaaggcttgtcagaattcaggttgactacttggcatttgagagagccccacatccaccactgaaacgcccaccccaccacggtgattgtcatgcttctctgcctccttattcatagagcgttccctgcaaaaagagtcctcgcaaggctccccagttctcctagaacattcagtctactgactctcacttaaggctcagtgcacactggataccacccacctctccaatttcatctaccatctctccccccatctcacttgatgatcaccaccctggcctgcttcatgctggctccttctcatccgagggtcaccttctcacatcagcccttcaaactatttcgtctgaggcaacatcctcccctcttggtctcttccccttcatttccttctttgtacttaccactgtctaaaatcatcttacttatttgttcatttatctgcttaatttctgactctccctgagagaaggtaatctatgagggcagagtattgtttattgcttcatatttactgcttgtttacctggcacaaagactggcaaaaagtaggtgcttattaaacttcaattaaatgaatgaagaaattctcttccagaaaaaaagcctgcttaccccttcaaagtccatgtcaaataaagccttctatgaatcacctaggcaaaattgaaaagccaccttttttgtattcctacggcctttgtgtctgcctctcatagggtgttttttttttctttttttttttagatggagtctctggctctgtcacctgggctggagtgcggtggcgcgatctcagctcactgcaaccttcacctcccgggttcaaccaattctccctgcctcagcctcccaagtagctgggattacaggcatccgccatcacacccagctaattttttttttttttttttttttttgtagtagacacagagtttcaccatgttggccaggctggtcacaaattcctgacctcatgtgatcctcccacctcaggctcccaaagtactgggattacaggcgtgagccactgcacctggcctgcctctcataggatgttatatgccagtctgccctcactgctgtgagggcagggacctgtgcatgtcattctgcaagtccacagcctccgccagaggctagccctctgtaggtcttccacagtgcttaaagaattaaggaattgctcgtctagaaccaaactctctctggactcatacaatcagggctttgtttgctctccaggaaagttcagccataagagttttaaagcttacattaaattgtctacatcttcctgtccatgggccttccccaagagaaacatcatctggaagccatgtgatcgagcggacactgattttgtgtaagccccacatcctgggttctagtctcaggcttcagctgggggatcttgaactgggtctttcgcttctctgaacctttatctctttagtttatgaaagagattgaaaaacctctgaagactgccccacccagcccttactggttttgaatatgtggctcagtctttcatattctccctctagcagtccatacatgtggtttgataaggagtaagtctactaggtatagccaaacaagtattttgtcaatgaaatcttaccctcagagaaacaggggatcatccattattctctgattggtgtttttaattagactcattctgccacacacaggcttataccaaatgaggggatttttatatctgttaaaggtccaaggcttttcacagattgcaaaaaaggcaaaatcccagcagctcggaatgctgttgcatttcattttacccagccttgtagattagctccaaagcctgcttggtcagcaaacatttctgctgtcccagaaaagctcttcagttcttcccaatccctatcaagactgtgccaccacagcaatgaggagcgggataagccattttcctttcctgcgaacatttctgggctctgaggcctgccttttttcagattctgtgggcctttgctaatttgtgtgacagcttaaatgtaaataggacacatctgcatgggttaaaaaaatagctgctcgttgtaaagggcagtgcactgtgtttatttatcatctacaactggaaagcaggttctgtttctagtctgtaatagctgatggtttgcgacaacctgaggcattctggaacagttttagttgactattgacttttgacattagtctacattcattttattttattttttttcccccaactacttggctgggagaagagagtgagcacctataaaggtggacatttacagaccaggtccttgaggcacacacacctgaccagatgcctgctgtctgctggtgatcacatacctcttcctaactctactaaccactatttgctgggcaggtacttcatgccaggtaagggcttcatatgcattctctcttttgctcctgtcaaccacccaaagaagtgcacgttggccgggtgaggtggctcatgcctgtaatcccagcactttgggaggccgaggcaggtggatcataaggtcatgagttcgagaccaacctggccaacatagtgaaaccccatctctcttaaaaatataaaaaaagtagctgggcgtgatggcaggtgcctgtaatctcctgaggcaggagaatcgtttgaacccgggaggcagaggtcgaagtgagccaagatcacgccattgccctccagcccgggcgacaatgcaagactctgtctcaaaaaaaaaaaaaaaaaaaaaaaaccaatacatgttattgttctgttttgagaaatgtagaaactgaggcacagacagttgagcgcactgactgtgtactgaaaagtatcagaattggtgtctgagttcatggcttagattattcttaaccatctatatagtatctttcagaagtctcacactcatctaccaagttgggctgccagtcaagggacacacacaagcctcaaactaaatcttggtggtaggtgaaggaattcattcaagaaaaataactcacatatagaagtgacatctttagttttattcagacagcccaatatctctcttgaatttcattacaccatacatatatattttatgtgtgtaagtgcatattcaaaatcatcatttctgtaatcacttttttcatgaatttttccatagttcactttaattctattgcattcaacaggtaagataataaaagattactcttacttgcaatagtgatcacagcaacaactgcaaacaccataggctggcaatttggaaagcaatctgagaagtcacctcaaaaattttaacaaagtattataatctatcaaaagagcaccacaaagcaatgacagattataccgatgtggaaagaagtccacaatacacaaagtgcaaaagagggagttgtggaataatttgtatagaacaatctcaaacctggtaaaagtgtgtgtgtgtgtgtgtgtgtgtgtgtgtgtgtgtgtgtgtgtgtgtgtaagcctggaagaatctctggaatgacagagtgcatagatgtggggatgttgcagaagggactttcacttttcactatatgcatcttctagactgtttaactttttatgcatatgcatttttaatttaaaaagtgataaaaatgacatttaaaagtgttcccagccagctgtcccaggcagtccaagtcactattggtgcgctctctatggtgattactgccatcaaggccatatttgttcctcagatcatctacctgctggccccagctctttcttggaatgcccgctccatctcatggctggctaagccagctaaaccatgcccagctgattttgagctatctagttctccctcctcttcctcctcattcctggttacatattgtcatgcccttgctctttgcatccaagaaggcccagatagctgggaaaacagtttgcactccagaaaaggatgctgaactcagccttcttgatgaggaaggcttgccccaacccagctggtaaagaggagatcaaaagaaacacacaggtctcagctcctcagctaagtcatcctccaaacttgattcctctttcattccaggctgtctagcagggccacccatgctaagcatgaacaccagcaaactgtatcacctcacatgctcagcatttcagaaggtgcactgtctgtcctatcagcaggacacaaatccagtgttgggtggtagcacctgccaatcaaatggcttttctgtgtgtacttctcctgagctttgaggatgtggtttccagtctgactttcttgtttcagagctgaagtttcaagcatgcatctggacaaaatatgctttccatataggccaacaatttatttatttattgcttatgacattgtacttggcagctaaggagatataaaacaatttgaaccactctgcagaaaacggttgcagagttgccactggagactgcggtggaagataacagaggagaatggagtctcgcagatctttctgtaattgacaggcagagcctctagaggcaagcgcggccagcagacattcctgcaaggagctcacatctctttccagcctcaactcctgctttggcacgagaaggagaccggaggcatgtgttggaagcctcctctgacaggacagatggagccagtatgaggacctttgccatccatccctaattgccaggttagatggatgttttggacatttattaatgcagtgggtggtggtgacctgcttccttcctctgcctgtctctcattgacactgtgggtgccccttccatggcctgctaggctcgaccatttcagtgtatgcagcccaacctctaactgcccattcttgcatgcctttgcctgagggcttccctggcctctaaggctcaccctatacaggcctgtggcaggtgaggagtgtgagggtattgatgccccttggagcagccctcggccgatgaccgtcaggaatgaagacacacatatcacagctccctcacccctaaagtgggatgactcaggttccacactagcctccagcattccacagcaggactaagctgcagtcaccagttgcccacagtggtggcttgacaactccccctttattggcttgccttcccattgccttattgatgtttcctgggaacacatcccccaaggacagcttgtactacatccttgtcatgtagtacaaagaagagtctgcttccaggaacccaaactcagaaaactcctacctatttctgcccagcccttagattatggatcaaaattagaggagccccaagattgtttcctgcacttgggctggttgttgggcctgcagagtgtttaaaagaattgaaataagttgctatcataaataaatctagattcttggattctattgaaaaatggcacagatatggctatactgagcttgcattcccttatggcatgtggggctgaagctgacttgtgatgcccctctaaccaagcctccctggcccatttccctcattgacatttccagactggaccctatggatagttgctgggtcagccaggccacctataaggccaggtgccttctttctccaagactccctgccttcctgagggtctgagtcactgtatggaacactcaggcctagatcatacatagaaaagtatgtggatagggatgtgtgttcatcccaggatgcaaaaatatcagcaagaagagagccactaacagctaatgagtgcaaccacgtcaggtgccctgctaaaccctttgcattcttttcttttccattttagtcttctagccactctgggaggcagatcctattattttcttcatgttttatctgaggaaactgagccttaaagagttggaaaacttatccacttagctagtaatgaagctgggactccagtttaaatttgtggtgttctttctgtctgcaaagctgcttggcccctctcatccagggcacaggtatatccatggaatgcactttatttatttatttatttatttatttttctgagttttgatttaaagaattttttttagaagaaaaagtctcactctgtcacccaggctgaaatgcagtggtgcaatcatagctcatgcagccttgaactcctggtctcaagtgatcttcctgcctcagccttctgagtagcttggactacaggagtacacccccacttccaactattttttttgttttgtttttactttttattttttgtagagctgggagtctcactatgttgcccaggctagtcttgaactcctggctcaagtaatcctcccaccttggcctcacaaagcattgggattaacaagcatgagccaccattcctggtggagaatgcactttacatggtagctatgccatcacccaggcctggccttgagtccgggaggctctgaaaccttccttgtcaggccacagaagaagtacatctccaaaaaggcagcctccagagtagccagctcctgtctccttagcattacaaaatagagaccttgtgattatcttataaggagaactctgaaagatgtatagaccaaaagattcattagcttctgaccaactcagtctcttcttgtaggaagtcacaggggaaaccaagttagactccgaaggccagctgaatttacaatgatatgaaactatcactgcagaacctggaatgtccaactgtggcaagcacagtccccttcccatagacacggcctctagggaagaagaggcctagaaataattttaaaagagagtagaaggggtcacgatgaagagaagaatggcatcctcaaaactagggatgttggttgaagtagtcatgtaagggcatcaggctaagaggccctggggaactattccacagcaggatggtggctttgatggaaagagtgactgctggattcctggccccaccttccctctcatctccccctagagatggcctggccactgggaagctccgtggctatgacacccatctcctggatagtggtatgaagggcatccccaagatcctcctctttcactcccccgcttttgcctccatggttggctgacacctctcctgacataccctttttcattttgtttttttttttgctgtcaatacattcaggcagctagatctagcctggctggctggaagctgtcctggctctgtaaggcaacttggcagatctctactccgatctattccattttgctttcttgggtgtacagtcttatttcccttacttccaagtccttgagatgggaggaagtaacctcttttgcctgccagtgtgtagacgataactcacatcctctgtcactattattactatattagacatatttctttttttctttcttttttgagacagggtctcactctgtcgcctaggctggaatgcagtggcatgatctcaactcactggaatctctgcttcctgggctcaggtaattctcccacctcagcctcctaagtagctgggactacaagcacacaccaccatgcccggctaatttttgtattttttgaaaatagagagaggattttgccatgtttcccaggctggccttcaactcctaggctcaagcaatcctcccaccttggcctcgcaaagtgttgggattacaggtgtaagccaccgcacccacccctggatgtatttcttaacttctctggtctaggtttctttccctgtaaagtgtagataacaatttttaattaaaggatgtgctcaaagggtgaaatgaaataatgtgtgtaaagtgctgaggagtgtctgaaatgtctaataaatggaataataacaatactggcaatggctgtgattgtagcacacctcctgtgctccctggagctctgaggtatagctcccaccgtggatcttaacaaatgcttgctaaattgacttgagccaggactcaataagggatgcaatttctattcatctggcctcaaactgacttatggaaaaaggcatttattagttcttgtaactaaatcattcaggactagtctggctttgggcacaggtgaattcgggatcttaaatgatgtcttcagggatctgtctctgcctctctctccatcattcttgtctactttccttttccttctgacttcattttcaggtagggttctcttctcactatggccctgtcgctcccggtaccccaaatttcatcactccagcttctatttccatagagtaaacagttctttttccaagcaatcttaactcaaaatttcagaactgagactcattggtctagtttgattatgtgcccatttctgaaccaatcactgtggcctaagggatagctccctctgagtgaccaagtctagggaaagtgaactctgattggctggcttgagtcatgtgcccatattgacatagtgctgggtgaagggtaactgtcccagaactgcaaaaactgaaaggaattccccagagaaacttggcccctggtatcaaaagatagggagacagacactgggcagaccaaagcaatggatggctgtacaccattagcaggcattaaatgcattttgcacacttgctcatgaatatctccctctccctgttgcagagccacataatcagaagactgaaggaccattgctgtgcaagtgaatctgagtagttctgacttgccagcctgtgacagggaaatagcagccacagatgtttaactaagcaagtactaccaggccccaggcccacaagctcttccccaagcccagtcccagctgacaggcaggcgtgacaggacatgtcaaggccaagagtcaggacacctgtcaagatgtcacagtgcctcaggacacgtgggttgggcaggtgacagctgcagtgaaccttcccgaggcccacagagcaacctgcatctgccaccttcaacaggcaaggcatctttcttctcagaaaacaaggaaagcaagcaagcatttgaaactgtatatcctttcctgtttcattaaggggttgggctttgttttcctgaaagcttttgttcttctgtcagcatattcaaaacaaccaaaaggcgttacctgctctgaaatccctgagatgcctatcctcagaggtgcttttggctgtcttatgcagcagaaggaagatttgcttcctagctgattctccagtcctcaggacattcacaaatggcaaattataagcccgtgttgcctctgctgactgcaacttgggcctgtcagcccagaataatatttgcatgatgatttggccaaatcaggcctggctgtctgtcatcctgggctcccttctctccctccaccagacgaacaaaccccgtggcccctcctcctcagatagctctggaatcccgctgcttttccccatccctgatctccccacccttcctttctaccccctaccacctctctcaggtcccaatagtctctgtgctccactcactcccctccatcaattcttggctcttccaccagaggggtccttctaaagcacccacatccgtccatgccactgctcagccttttctttcaatggtttccaagtccccttataattaagttcaatctcttcaaaaaactagcagaaaggctttctgacctcagtctcaaccgatagcctgtttgcctcctatactccagatgtatttatggacataggtaggctcccagatcagatctacatcatgacatcccctggggctgggctattctcctctgccgcctctgtacctggccaactcctacttatccgtgaggccacagctcaagggtcactacttctggcttctgaatctcggtatggcgtctctcccatatttgctctaggcatctagtgcctcctccactacagcacttattatactatcctgaaattgcttgcttttctgtgcttccttcattagcctggagtaatggagcctggaagatctatgagtatggaactcaccttattcattactgcatcattagcttctcatgcaaaccccatcacattatggaagctcagttcatatttgttaaatgtctgaacaatgtgaatgttcatactcagactttccattggctgaatttgaggtcacaatttctgtacatgcaactgagagcaaattggcacatcaacccgcacccccacctccagataaaatgtaagcaatagcatttgttccacctgatattccttttggctcctgatctttatgtccaagttataaaaatgtctccatcacaacttccacccctggaattgagtgcctggtgcagggaaggggcacaatctttgacacaatctagagcaagtgagacctccaaggatttgaagagaaatgtaagagtgtgctctgagctttggcttgcagaacctggggggtggggcgggggtggcgtgggagtctcctatttccttgaccatccaaatttgattttttttctccttgctcagcacctagtggtgtagtattccaagggcattaaaacaaggttaaagggctttatgtgatgaaaggcattcttagttgtgagtgtttagcaggagtttaaatatcagcaattttgtatatggaaacatattagcttcatatttaattggggtcgtggtgcactgtgaagtacagcacttatgtgcacagacttgggtatgatgtcccacagacatgggtttgagtcccagccctgccattaataagccatgtgacacctgcccaggtagctaacctctgtgagcctcaatcaggtccctcacctataaaacagggataataacaataaaagcataaatccttgtagggctgttgtgaagaacaaggtaagaaatgcacataaagtaccgtgcacagcacctaaaatgaggtaagcacctagaaaatgcaagctggtcttcttcatattataacattgggcccttaccctgctccagttgctagaaagtaaaaaatgcaccagcttgtcctgtgggccaagtctcacacacagatgttggttcaactcgtctgtgcattagttttctactgctatcctaacacattaccacacacttagtgactttaaaaaatatctatttattatctcacagttccgtaggtcagaattttggcacaacacggctcagttcattctctgctgagtttcatgaggccaaaatcaccaggtgtcaacagggctgcaatcttttttgcagctctgaggctgaatttactttccagctcattcaggtcactggcagaattcagctccgtctggttgtgggactttcctggctggcagttggctaagcatcattctcagcttctagaggccacctgcaatccctggctcatagcccctttccttttatcacagcctcgtctctcctctcctcccccttgggacctctctgcctcttctgctgcctaatctctccccttccctcttccactgcaccactctgactcttagactttctttctcgacttttaagggctaatgtcatgacattgggtccgtttacataatccaggatactctctctattttaagataagctgcaaagtcccttcgtccagtacctggttagtgtttgaataaagcatgggcatcttggaaaggcatctttagattctgcctatcacatcttatttgctgcattttaaaatctgaaacaaaacacatctcaacacagcacagtcattacgtgtttagtttgggctatttgtggagttggcttagctgagaagaaaaacgtgaaaaggttatttaaaaaaaaaaagtgggcccacctcctttcctgggagactaatgctttgttaaatatggacttttcaatccatttatcagggaaattcccttagattttccctttttcactttctgtttaataaagtccataccattttagggtatttaagaatttaaatattgcaaagctaaggtttttatatatgaagctgaactccagatttcaaactgtcagccagcagggtctgaacagggaggactcttgggggcaatcctgcattaacacaaacaggacagcgtgggctgggaaactcaagactcagattggaatgtatttgccaattggcaaccaatcctgttcttatcagcttatcagatttatttcatgtagaaaattaaaattctgggtctctattgtgcagaaatacttgcacatacgcccaaaggcatatacacaaaattatttactgcagtcttgtttgtgatagcaaaacatggcaaactatctaaatgcccattaactgtgagtggctaaaataaaccttggcaggggaattccatgaaatacttctgtcgctattagaaaataaggtaggtctatatatattgaaacggaaagtttaccaagacatactgttaagtgaaaaatgcaaatcacagaagaagctgaataatataatctaatttgtgttaaatgaattatgtgtgcattatttgtaaatgcagacaaaggacatatctaccaattaattggggtctattgcttctggggagaagtgtagagttgggggacagagtgaaggagacattcaggttttaagttgtctacttcaatatagcttaaatattttataatgagaattgagtcatgaatgtagattattttaaagaattgggtgaaaaataccatgttagacatattactaagggtaggggcatataggttatctatcaatgggacttgaaatatgatgttatttgatgtttcagaaattaaggccggccaaacagctaaaatgactaacctctgagcaattcagcttaaattccatgcttattcattgctacagtagagccaagtcctgatgagacatgctgaatgagagagggctatttaacttctagtttctggatggctgtgaccttccacagacctcgcacatagaaggtactcaataaatacttgaataataaaacaaatggcactattaaatttgggaaaagtctggtatctgcctttgattaaataaatcaagcctactaaaatcacaggagacatatatacaagattcaacccactgtcaagaatggatgaacggaagggagatggtttccattacagaatacaggcaagtaagatttggaattagacaatcgttctttactttcaaacagaaccaaacaaaaaaattccccaaaaaacagaccttaaaaactaaatcctaaccctacacagcccctggaataaagcttttccaatgtacctgccagagcagccagtagaggagaaaggggctcggaggaggaggaacttgctgtctgcagcgctgccccttcatcagtgaagtggggctagaatcgatgatggctaagctccctttcagtgccaactttctggcaatctgtaagtggccactctggttgcccagtatcctcaaaggagctagaatcagttctttcagcttcaaagaaacagacccttgggtttgcatgtcaaatgtcattgtaaacctatgccccagcccccacctcgtctgcagatcacctatcagggttgagctgcaggaggaattacagtggccccttcctttcggagggcaagttggaaagggaggcagaatgtggcaaaatgccttcttcaaggccctcaacattaaactttgcattgtttttagctctttaaaaaaatctttttttacttttatagttctaaatttactttggatttaccaatattaactaagtggctaagtaaataaatatataaagcaaacatgagtaccacactgtcccccaggactctaagcctaggaatgcaaggaaccctgtttctaaccatgtacacacactctttgctgctattggtttgtctctgcctatagccaagtcacattttgcagtgcgactattctgtaaactacgcgcttgtttgtaaattgtaccagatgctcagccactaactcagccttatactttcatcaggtttttatgtctttatgatgtacatctttgccactcaaagggtggttcacacaccagcagcattaacattgcctgggagaagagttgccagataaaatataggaaattcaaattttactggatgtcaagccttttatttttttcccccctctaaatctgataaccctacctgggagtctgttagaaacgtaaaatctcaggctccacccagacctaatggaatcagaatctgtatttaacaagtttataggtggttgcaaaatcgacttgagtctacttaattcctgtgatacaaaccttctaagttccactggcaaattctgatctcactctgcatcaaatgtagatgaaaagagtaagctgtcaacaagcttggtttctgtgttttccccatttcgtcatacattctgttcgcaaatgcgcacatttttcaacctgggcacagagggcacccccactttcaaccactcctgagcccgagctcacgaaccgccatcgctgcagaggagacgccaggcggtgttaattgcttgctgggtggtggggaggaggggctgggttaccatctcgcctttgatcaggaggtagaagtaatggttttacttacatcctgctttgtctctgcacaggctgagagccaaggatccatttcaggctctctctttcttcctagtattctgttactgcctacataccgcggcccagagcttcaggcgaggttgtggggaaaccaaacgctctttgtggtacacccacatgacaggcttcaaaatggaaacaatatttaagtttaacctggaagatcaagtttgctcaaatctcgcaacgcagggagcttttgaaaactttagcagtaggtctgcatttgatggagagaggcaagcagtgatggagaaatgaggccttgttaacagacactgaatccccacacgggagtcaacatttcgccttattccttataaataatggggataataataacacactgagacagagccttgaaagcttcaaggtgtctttacagccacattcttctgcagtctgcagaataattttgggaagagggtgcgcggtgaaggtgtagaaggtagccgtcatcagccccacaggacagagaagacacataatcaagtaaactgattttaaaagtcaaaaaaatcaagacactttcctcaagtagcacatttcctgactcttcaagcagcgctctttccactgttctcagggttccattatttggttgccccaagctactcagatctcagccattccgcaaggaatttcagggctggaagaaacctttaaatgattcatagaatcttgttatggattgagttgtgccccctcagaattcatgtgttgaaatcctaatccctagtacttgagaatgtgaccttatttgaaaacagggttgttgcagatctcatttgttaagatgaggtcatcttggatcctgatcttaggtgactgttgtccttataagaaggggaaatttggacacaaggagacacatgcactcaacaacgccgggagaaaatgaagacagagatcagagtgatgcatctacaagccaaggaacaccagagattgccaccaaaccaccagaaactaaaggagaggcatggaatagattgtccctcacagccccagaaggaagtgcgcctgcctacaccttgaacaaagcctgcagaaccttgttatggcagccctagaaaggaaagacaaatcataaggtgggaagtgtcatcatggtgctaatgctgatgagagtttgctgggctccagaactgggcaagggttcactgcatcatctcatagcttccatacatggactctgctaggtaggcactagaaatgagggctttgaggctcacagaggctgagctactcagtcaagatcacacagctagcatgtggccaagatggatttagacttgggcagtctgagtccagactctgttgcattatcccttaaacatcacagcctcaggtggggtggccaggacaactgattagcatctatgaagccctttctcatgtagaacctgtaaggggctcacaccaccaccatgaggtagacactattgcctaggttttgtaggggaggaaacaggcactcagattaaatcactgacccaaggtcacagagctcatcagcggtggagcggggatttgaatcaagtctgttgactccagcaggagctctcaatcactgcgcaggagaccagcaagttcagatttgctgggttctcagtggcaagtatgtcaccctttccaaatcaccatctcctccctctgtacctccacctgccatgcacaccttgactgttggtcccctcttccatgtcgtaacacacacatggacattttcaatgttcacttcccttccctccctctgtgagaaagctctgcttcctctgagtagtgtcaaaggtaactttcagactgtaaagtctgtgaggttccttcagtctgcgggtcaaactctgataatgttcaaagtcaaatccaggaatgacatgtaggggaaaagcagtggttcccaaccaaccaggagccatgttgccccccaggggacattcagcaatctctggaatcatttttggttgttacaactaggggctgggggtggggtggcagggatgctattggcatccagtaggtagaggccagggacgctgctaagtatcctacaacagacaggatgcaagacaaagaagtatccagccctagattcaatagtgctgaagctgagaaatcctggcatagagcgtgttctccagaggcaaactgcccacttctcaattccagctccatcactcactagttccgcaacttggaggcaactttcgtaaactctctagggtccagttttcttctctttaacatgtaactaataatagcacacgcctattaatatacataatattagttattatgtaacgaataatagcacataccaatatcttatatgtatacattattacataacacatgttgtatattatatgttaaacattgtgttagtttcccaggctaatccacaaaaacctatatcatgttgtcatgttgctaaaattcctatgcttgtggagagggttggggaggataatggaagataatataacagctaaaacataatacgaaaaacaatactgaatgaaaacttaacagcattgattgatctcagggccacatacttcaggagaagtggccttgtttagaaagaacaagggaagatagtgctcatcttatgatgctgttttgagaattaaatctgttaaaccatgtaaaccgtctagcacattgtaaaagtgatgtaaatgctagttgcatagataaatggagacctttaaaaagattccagagggaatttctgaactcttttaaagtgaaacctttagagagtgatcgcctaaattatttatacttaatttcactttaaaacaagagtttccttctacattgcacctggctatttgtgcacatgctaagtgcctgagtctgccattcatcatcctgagactgcatgctgcagctaagattgccagctagtgcagctgagaatcagctatggaagccccacagtcagatgcttaccttccagttttggaaataataagggtgcctctcctaagcaattacaccgtgcccagcacttcacttagtgcctggccatacactaactcactttgccccccaacaaatccaggaggcgtgtgctattattagttacatgttaaagagaagaaaactggaccctagagagtttacgaaagttgcctccaagttgcagaactagtgagtgatggagctggaattgagaagtgggcagtttgcccctggagaacatgctctatgccaggatttctcagcttcagcactattgaatctagggctggatacttctttgtcttgcatcctgtctgttgtaggatacttagcagagtccctggcctctacctactggatgccaatagcatccctgccaccccacccccagcccctagttgtgacaaccaaaaatgattccagagattgctgaatgcataataaattatatatctctctcactatatacatataagatatataatgcataataaattttatatatatatatgtatctcactatttgatttcccaaccatgagttagctggctcataaactcatctggggagagactttggcatgtggtttaaggagctgggtctgaataaccccttgctatatcagatagctagcggtggccacataatactgaacaaagaacacggaatgtgatggggaatgacaactgggttacagtctgggttcttctacctctgagttgtgtgaccaagatgtaatttagcctctcctctgtaaaatggggcaacctaagacccacatggtggggcagagaaagactaagtagagttacacatggacaaaggaagccttccttaacggttgtgctccactccaggacaagttatgctcatcgtcatgacttggattccatggctacaagtctcacaggactccattggggtctgccggctgatgacaacacctcattccaatgtggtagtatcactttcctatcttctttttagtgcctttgtgtgttgcccctcttgacctctgggactggtgttcaggccacaccacacagctctcaatgccagcctgttgaatcgcccatgctaatctatatctatacagaattgatggcaattatagattatgcaatataaagttaccctgtgctaacctccagagtccttgaattcttcttatgaccagaacctcacattgagagatgagtaagaatatacttaacttgagtaaaactactcaaggagagcaggaacttgaatatttagcttctgttgaggtgcacatagcaggtactcaataaatatttattgaactaactgctaaacaggtaagtattagttaagtgctacatagcatagtatgcaacggttatccctcccagtgtcttctttcatttcttttcaaataatctgaataatttgtaggcaggagcacaagagcttagtttttcatcttatcaacaaagaaccctccaaagaggagacattcctttggccttggttgttggcatttcaggtataattatatttttcaccctaaaatttcccaacaagattaagagttacacacaaagtctccttaacctttggctcggaagtttgcacaaggagctctgcccacttttcatgtgatttctgaaagatgccagctgctggcagccatgaaacatgaaacacaaagaacccataatctgctagaacataccctgcttgcacaattccttgaagcctctctaagaatacaccaaagcctgcaagtgtgtacatgcttttctccaggcaaggaagatgcaacattgctttctcaacaagctgtttccaatattttaagtaactattctggctcggccaagataagagagtacaaagatctagggaaaagacaactttcacattttctttgtaatttcacttggttgtggcctctgttgaagtttcccctacttcaaaacatgattgtatttcttgtaatggctgaaaagttttaagcttcttcatgtacctaattccaatgggctattaactgggctagtttattggcactgtggatggagggcttttgaacttgcaggcatatattttttattggctggacagtttgcttgactcttcgagagctatatccaacccatcccagccaggtggtttttggtgcatagcatgaagtctccagggagaatggttccatttgttcccttggccgtgtgtgccaatgcaaagcccagcactcaatgctcaacctgattcaggagacatggagcaagtaaacttttaaagctttataacacatagtagatacttgataaataattacagagatattgacgtggcaagcctgtgagaggtgatcaatgtagagtaggtagtggtagggaagaaaataaaaacaacaaggctagtatttatggagtgccttactatgtactagcactgagctcgcattttacaccactattacgtttgatcttcacaagaactccatgagggaggaaaatgtaagaaatcgctttccccattttccagatgaggacattggaaattcagagagattaaatattgtgcccaaggtcacacagctttcagggacagatctggaatgcagagctcacactcttaccccatgagatcctatatgcagactggacattctactcatgaaaaaagggaagaacaaaaggaggaagaggtggtgaaataagatgtgagaagaaagcagagaagtggtcaatggagaaaacccctaaggtggagaggatgaaaatggacagagcccttgttggctgtcttcacgattcttaaagaaatgggcccatcttccccttcccatgaggggagtttgttggggagcttgaagactacagcagagattgaaaagggtcaccatggggaatgcaatgtgagtcagtgcagacaagcaaccgccctgcagctctggagtcagacatacctgggttcggatcctagctctgagattttggagctttgtgactttgggcaaagagctttccctctctgtgtctgaatttcctcatcttgaagacaggatcatagtggtacataccacatacggagacatcaggatgaacaagatgaccaatgtgaaagcacttagaatggggtggcaaataatggcccaataggtcaaattcagctagccactggtttttgtgtggtctgcaagtcgaaaatgggttttacctttttcaacagttgggggggaatttttttaaaacgaatattttgtgacacatggaaatgatatgaaattcaaatttcactgtccataaatatagtttacagtggaacacagccatgcccactcgtatggtctctggctgcttttgcatggcaatggcagggttatggagttgcagccaagaccacacgtggcacactcatggctttgcactgctgttcacacactacaaatggcagcaaggttgctctaacttgaccagactttgagtgtcatgcatatcacctatctgtatggacagatatttttaaagatgaaatacataaaataccattacagatcatcattaacagatgaacatttgcaatatattttgataacagagaatactaattttgatccccaataaagtgacatgttatcccctaaaagaaacccactctcttctcattagtagaggtatattacaaaaaattatactcattatattttgaatttcttcaataaaaaaatctatgaacatttgttttctttcttgttatataaacatctatatctggattttgcccacagattttggaccacaaaacctaaaatatttactatctggacattgcaaagttttctagtaagccctaacttgggacagtggtgggcacgtggtcatcggcacaggagaggaaatgctagcctctcctttgccgacatcctttgagaaaggccccaagttcctttttatttgtctcagtcttcttgaacagtgaatatatatgcccattaagctccacataagtaagcacttggcaaaacatagttgccaaacatagaaaaagaaaagcctaatggtggtgctaggctatcggccttctccttttcaggccaattcatcatttttggcatgcggttgtccaggcttcgtgttaaccacctcagtcagtggtggtagctccacctgcttggaaaatggctcatcctatagtccaagagaagtcaggctgcagcaaaactttccccagatatattctgtgcaccctaattctacatgagggtgtgagaagaaaaggggctgtgagcaataagcacagcaaacgctgtctctctggagtgtgacagctgactggaggaccctggcctattgaaggctctgagaaggcctgcagtggagaaacctattaatgctgtttaatccagctttgctcaaacttatttgaacaccatatgcctttatgactattttttaaaatagtggccaggtcgggtagctcattcctgtaatctcagcaccttgggagctgaggtggatcacctgagtccagaagtttgagaccaacctggacaacatggcaagatgccatctctaggccccccacccctacacaaatagccaagtatggtggtgtgtgcctcctagctacatgggaggctgatgtggaggatctcgcttgaacccacaagtctgagactgccgagagccatgatcacaccattgcactccagcctcggtgacagaggaggaccctatctcaaaaaaaaaaaaaaaaaagtcttttaatatccaacaccatcagtgcactgaggaacaccttagggaattactactatagtggaaggagtagctggccaagagtcacatgtttgaagttcacgtactagttcccctgtgtctcatctgtatagccctggacaaacctccttttcttactctataaaatgggcatggtgtcacctgtctgccctcctcgtagagctgatgggagatcagatgaaaatcagggacacagggcattttctctaaactggcaagggtgctatgtgagtgagacagaagtagaagaaatggcagtgtcagctcttggaactttaaggtgttttccctaagatgagtgaactaggcagaaagccactgtgctgaaggccccctcagtgtttgtcaggacagcagtgacctacagaggggcaaacgccagagtccatccttccctgtccccagtccctgccatggaaatgcaacccagctacataaagctcctgcaggcttcggggcgtaggagtctcttgcatggagtcaggccctcacatgaaaaaatggctcaacagtccgggctccatcagcatgttggtgcattcataatttttaaaaataataacatggagaaaattcatctggtgcatcttagctggcaccctcacacatcgtcacctccttatctgatatattagatttccctgtgtcccaagcctgttatataatgagggacaaagattgctctctggctctagaagacttcctcattctccctttctcattccacattccgtgagggggaaggacaattctttgcagtggccaattgtactgagcccaaatcatgtttcggatcagctgggggaaacactgttagccctgcaagcccttcctctctgagaagaaaacaggcttgccatgagtttcccaatgtgtcacctgccttcagacaaaggggagcagaggccgggcacggtggcttacgcctgtaatcccagcactttgggaggccgaggtgggcagatcacgaggtcgagagattgagaccatcctggccaacatggtgaaaccccgtctctactaaaaatacaaaaactagctgggcatggtggcgcacgcctgtactcccagctactcgggaggctgaggcaggagaatcacttgaacctgggagacggaggttgcagtcagccaagatcacaccactgcactctagcccggtgacaaagcaagactccgtctcaaaaaaataaaaaataaaaaaaaagaggagcagagaggtttcttcgataacatgatttttatcatgctcccaagctagtgccccagcaccaggggagacaagtacaaaaaaataagtaaaaccacaaacccaacacaaaacagcagccagagtcccacacactgaatccgtttacaatccagtgccgtgggccaatggggagactccctttttaattaccaagtttttttttttttttttttttttagtagagtgatttgtacagaaactcctttcaaataacacagtgacttcagggatcaaggtgcacagaaagaagaacagcagaggctgggggatcagcaaggttgctaattccatcacacgctgactcagggcaatcagaggcactcctctgacacgtgagcagggaacaatgaagcctcatgccactgccaagaacaaacccaatgggcaacagtgtactcttcccagcctctgcatccaaagggctctagtgtgcgtggccactccagcctgccctgacctcccgactgcccgatgcagagcatatcttaaaattataaacagatgtgaaaaacagtcatgtaatgccaagtaaatgataacaccaccaaaaacagtcttagctacctttaaaggcttaatccatcaggtgggagtggtggaaccagtatttgaacttggtctgtgaggctctagagcctgggtactgcccaaccactctgcgccaaagattatgcaaagacagagattcccatctccatcaagtacatatttacaagaccatctgcataggaaaaatatggcaagatatatactgaaaagttaaaaatgatgctttctctgaatgaggattttgagaaaatttttttcctgatatacttattaaatttcctaagttttgtaaaatgagcataaaagtaatacatgaggaaaatgaattggtggctgtaggaagctcagatttcccagtgaaagcaatctgcgattattatttcagggcctcgtcttatgtttgccctctgatggacaaagatacaatgtgcagcgaggggtctttcgccacatatgggagtctgcctttttattctggatctaataggtttaactgagaaatcttctctcgaagagattataacaatctttcttcttcaaacttccaggggctctgtttctacctctctgcatatacacagtgactgaggaactaaggaaatgtttggggactggcagattttaaagctacccttgcccttcaaccacccacacaaacctaaaagaagggacctgatttattaaggtgcacagcagaagggcacacggtgaggttgcaaacgctgactcttaggctgaaagaaatggcaaggagtctccttataaaggctcagcatctcagtgattttgtcaccatgggaacaaccctgtgagctgcaaggcatgcatggacccatgtttacaagtgcaggatctgcttcagagggatgggggcctgacatcccaattttactccactcaagattgaacacacgagcaccttagatcctgacctggcacagtggaagttctcagttgctgtgtgctgttgttctcagcatttacattatatttcccagaaaacaaagctagaggacatgtatattcccagaatacattcccatctcaaagtctctgacaaacatgttcatggggaagccacaatgagggttgcagtaagagtttcataagaacaccaggtagccaccagatggtggactagcaattttcctgcagagatcatgtgactctggagaaggaatatatgggggaggcctgaggacagagttaaggtacgtcttggtaaggctaatgacctccagccaatggatgctccaatagcagaaaggaatctagccattctgattgatacacctagtggtggccataatatgtgctctgattttagatgtcgtcttggttttcccctttggttggggctgtggagatggttggaaagaggtggggctggagttgctttccctgaaccaacaagacaattctgactcagagcattacgttggccaccaattggatggctccccaaagaggcctctgagaagtatctattctcaggctacaagtctcaaaatgaaacctgtgagccttctcaaccccacatttgcatgttctagagcaataccttctggtctccctgaaagtgccattatggccattttcaaatgttattaataattcttttagaagctttggttctgcctccaacattaaatgatgccctgcatcgtttaaaaaccctttccatctttctttctcttttctttcttttttttttttttttttttttttttttttttttgagagagagtttcgctcttgtcgtccagactggagtgcaatggcacggtctctgctcactgcaacctctgcctcccaggttcaagcaattctcctgcctcagcttcccaggtagctgggaatacaggcatgtgccactacgcccaactaatttttttgcatttttagtagagacagggtttctccatgttggccaggctggtcttgaactcctgacctcaagtgatctgtccgccttggcctcccaaagtgcttggattacaggtgtgagccagcgtgcacagcctttctttccatctttctgataacttgggtgatcctctgagataaagcatgtataatattgtgatgtcccaggtgtaagacaattgtcacataagatcacgcatgtctctctggcacctgctaacactgacagtgctaactaccaaaggcacctctctccctactctcacccatagcagacttttgggctggctggtttcgctgacgtttactgagctgcttattattattattattattattattattattattattttagcattcagcttttcatatccctcccacccattggtatctgtgtctcagattaattttcaccagatgtgagtgtctggacttctccaagatttgttattttccctccatgttcctaaccttcttcaggccatttgtgtgatttctctgacctcaactagtgtttccaacaccttccaaattagtgtcatctgtgactttccttcacatgctcttttctcccctttacagatcattaataaagaggttaaacaagaccagaccaacagcatactctaaagcaaatgacaaaagggtgggagagccagcatgctccctgtgcgccagccctggcacaggaaggatgtaatgtaatgtaacaacactctgctagacgcctcccgcctctggcccagtggtaatttatcaccactgtttgtttatgatttctcagccagatttcaggtcctcagagtgtggtcatatctaagccaacatgcattgctctgccaggtaacccttatgagctccagagaaacccacaagaacttatttactgccctccaatctccttaaaagcttctaccttggcccccaagtccatcacccttgagagcagaaagaggtggactgagacattattatccttttctctcttccaattcattagctcgcaattaattatttgttaaatattcattggctttcatgttactcattagatttttctttaagccgaaagaaaccctctgctataaacagggactaattcatactctccaacaatcaaactttcctttgctatacccaagtgttataaaaatcaaaggtaactggagagggtatgtttatagggtaaacatgctttaagtaaggcctgctatgtaggtggcttgggtgtagctatggccataggaatagattacctttcttttgccttttcttttacctcccaaattcaacaaccccagtatcaaccactttcctctgtttatggatacagtacactttcctgagcccagaagtaacaataatagtgatatactgatattctacccagggttgaatactcactgtgcaccaggcatgacttggcatcttactcagctcatcacagccctgggggtgtcacaaccttcctcaaagagaaaatggaggggagagacggaaggtgacttacccacgatcatccaaacctaggtctatctgaatccagagaccacactgttagccaccccaccatagatgagggtcttcttcactttttctgagtcactggcccctctatctgctgaggaacataaataaatactctctttgtggggatgtgcatacatccacattgaagcctattaaccatgtcaggggatttgcagagcctccagggcttatggacgcctgcttgagaatctatgtactactctaagctcctcgagggtaggaatcacactttgttcactaccttgactcagtactgagatgtatatccagtacatctccagtactaagatgaagaaatattttttgaataaattactaattgcaaagactgtgaataggatattcaagttgaagctctaaacagcagctttgtaagcctgaatagaagatataaatatacagacaccttccagaggagtagaagagcaaaataaaaggaggaagtggggacagagataaagcaaaaacatcttactttgcccaggaatcgattttgcaattggaagtaggcagagacattgtcatggtggttctaaaacacctcgtagctacttctggttagttctcatattaactcctgaaaagagattattgaaagcttcttctgcagaaaaataatatacttagaatttcaagatgagaagtcaattatcaagagcaatcaaaatctcatgttgtaccccttaactgacagaattcttgatccctggagatctcagggggaactacaagagccaatggcaacttccttctctctaggtccctctagtccctaggtccctttcaacctcctacaactctggggtttttgtttttccacagattgctaccccttacatgtcttcttattctataactactgattttgctttgcaatctccttttcttcaagagttggaggagccacccactcttgaagttagacttcagacgtgctttaaacttgtcagcctgcacattactgcaataagaggccagagattcccctgctgatatgcaggaacatggaaaacagccaaggtcaaaagcctgcccttcccttggccagagcgactggacatctggggaaaccagaactctgagttccctctcagtgcccccaccaccaccaataatggcctgctccagctttgacacccaaggtagaaatctggaggcattctcaattttgtcctttgtcttacctccccatccaagtcctcctggcttcaccttcctagtcttatctccaatttatccacttgtctgcatctccactactgctgccctgggtcagtgccatcaattctctcacagatcatggaacagcctctacttctgctcttcctgccacgacaattcatcctctacacagcagccagggttgttctacaacataaatcaaatcatgtcatgtccctgcttaaactcctctgatgtctgctcagttttcttaggcttaaaatctaaactctctacctcgccataaaaggccctacgttttctggtcccttccttcttctccatcctcatctcactgttttgtgctctacccagagttatggtcttcaagcctcttcagcttataaactccttcccacctccagcttttgcatgcctcccgggaccacctcccaaatgcacgccttggcatggatacctcctgactctccccttttaagacttggcttaaaacttacttccttggagagatgcttgctgaacatccttccttaagtaggttcctcaagttaatctcagtatctttctggtttccatcaaagccatgaccaaaacgtgcaaggtttctattgagatgtctaattatttatattctgtcccttgactagatggcaagatccacaggggagcaaccatggcaatcttattcgtcactggtttcctagcatctaactgagaacttaaccgtttggtgaaagaatggacaaatgagtgaataataaatgaatgaatgaataaatgaaagtcttagtagccaatggcacaagaaagagatatatcagatcctcagttatacaaaatctaaattgcattaaaagcagcagtagctacccctgtacaggcggtgtgaaagaaaacctgcactttgcatagaaaccaccactttgtatagaaacctctgctttgtgtagagctcagagctctttccttgattttctttttgcagccattaaatttctctagttccaggacaagcacaggcctagtgtccagaccctgtccgctaaaagaaggcaagtcagacctgaacttcctagccacaataaaacatctccttcctccttctttcattcttccagaggggaggcatggcagggagttccactgggccatccagcactgcttttatttgtaaaacaccacttcctcgtgtctaaatgttctgggattcatatttttactcaccataacattgtccatgagctggtggcagacagctacaattcttcattttgaacaggctgcatctactagcatcacagcctcatgccaaaacttgttaatgccacatctgtatttttatgaatcgggtcctaaaaatttgcatatgttttcaatcaaaaaagactaattcctttctagtggtttaagaaataaaaacttgtgttctatctttgctcaattacaagagttcacagtaagagctcaaacattcaaatgtcgaggcagaggtggcactaaatctcacaaggtgcctcgatttgctcctccattgcctacctcattgatgttcgcaaacccgaatgcctcttgggggatccatggaaagcaccttcattcaatgtaaatgaagaagtatttgctgacacaaatgatacctacattaagtggattttcctgaagaacaattatggagaattgaggagctgctttttctgcattttgcaaggcaagatagggaatacagttaggcctccaagagcacattttcacaattgaaagtatgtgtgagtgtggggtttggggggttggtggtgagaggacagtggttgaatatgctttgccagggatgcctatgatggcaagaacttgctggaaaagtgatcccgtggagtctctagaagaaacccagaacaatgaggctggccacaggtaaatcttaggcataagaaaacaagagtgtggatgatccaacagggagggggagtataaagagaattgggaagcagaatataggaatatatgtttggtgtaggcagcatagactacataattagtggcgctgagggcaaatgaacatgtgaggccccttctttgaaaaacattaggaatttcaagacagtgacagcagagttttaacctaagagtgaagcccttccaagtgtagggcctgtggactgcacaggccatacgctgataaatccaggcctgggtgtgaggtttaagaggggaaaggctagctctagggggtgtcaaaactctttagaaaagtaaactttccccggtccaccgtgtgctcggaaaataccactcttgaatgaccatagtgagacaaataaatcatgtctggacttagcctccagaagtggcaaaaaagggaggagctgatggggttgttatgctaattccaatttgttgtaatttttagagtgactttttctaaattatgttcatttcagcaccaaaactccagattcaagtcagagccttccgatgctattatgagcatattactgatgtctagtaaaataacatcttgtgatgtttcttttataggggccataaatcaaaacattgaaaacagttaatttttaatgtaccactattatccatctttagttataaatttaatgtctcctaaggcctcatggattgtaatgcaactcaaaacatgcaacggctgctcaaaaacagaaggttcccccagtatctcattatttaaatccttaaagatatggttttaaaagcctgaggatatctaagcaaacttgtttaaaggagtcataaagaaagataagtagttttcctctgaagcatatgaaatttattacagcatactaaagtaggattatatattgactaaatttctaaaaacatttattttctggtgtgcatggcatttggggaaattcacgaagaaataaaggggatagggcttaatacaatcgtctgcatttgccttaagcaaagcaagatttcctacgggtcttggagccaattccatcctgaggataacaacactgttcatatctcagggtgtcatgaatcttgtgaaagagcaatacaaaatcttcactattcaggaggaaacacaagtgcagcctagcgccctgatactcatgatggcagaagtagcttcacagaagagccccaagtaggatctacacttttcaagacaactgccaaactcttagaactttcctttacctacctcttccatgcatgtttgaggcaggcttcatgtgtttgctttttaacgctataaaacgctttcttctcatttcatatgactttaggtcaattgccacttttattagcttttctctgtgagtaaatgtgacatttctcttaatattttccctacatagggagagagttgctcccatagacatccagaacttctctgatttccccacttcctcatactgacaagctttcctgcagaatgactttgcatctggaagtgttaattccagtgccgttttcccctttgccaagaaaagggagaagagatgagatacttctgtattaacatgaagcaggttttactggcagcaaatggatccaggaggcattacatctttactatgtagaaagatgtcgtacctgaaaaccaccatcctgtgaactgccccctcagtaccaaaaaaagcaaactgacccattagtgggacatgtaacaggttcaactaagaagtaaaacacaacaatgaaacgtcacccacaggccaaacgtaccagctcttggttaaacttcacctgaagcactacctgccatgctatttgaaggcaagactcggggaaagacatacatgctaagttatcccaaagaattgtcccacacctgttgaatctccagcactgtgtcatttcatgcttgtcccagaataaagagctatagattgaatactttctgatcagaaaaaaatcaccatggcacacaatcaaccacattccttgttctgaataaaacatcatatgcaatgttatcaagtttaataccatattccatgtaaccatgtgtatattcaactccagggagtttgtgacttggtgttaaacagcctgcagtatagaggagaggtgtaattcccagcagcaaaagttgctagacttcagtattccattcataaccatgtggtaattacatgtgtcactattcaatcgtaatgcagacaggatgtaaataaagggtggattctcaatagctaaagatcagcttttaaaatacaaaaccctctgataaatacaatgtgtataatttctaatgcaaagcctcatagaagtataatttttaaaaagcaacagataaaatgtcactaataagacctgctaatatgaatgtttctattctaattcatttaaagagttacagttacccattcaccattactatgccttgatccttgtgttttcttcagaactgccatagaagagatagcacaatccattaaacggccttcttagagatgatagtttcagctccatgaagatacatattttattttccttattccttgccaaacatttgacacaaccagaaggacgtgagagtcacaccacactggcatatctggtgaaagcaagcagtcggctgaaaaccacgactggagaattgcgacaatttctgagtccacaatcatgccttaaaaagtgtgtataaatcctagtaagggcacagtttacatcttaaataacacagaaacatttgaatcgtgctaaacccagccccaacaaggcagagcagtaatgtggttgtggggtggggaggtgaggtaggatggagggggctcttgggaagggtcagggcacgcggacattctgcgctcacagaacacagtagcaaacacagggcacaattcacaaacatcagcgagcacaatcgagcacgcacacaatacaacactagaatgcaattttttaataaaaatgatataaaagatggtttctcacccctcaaaacaaaactggaactttggtttacaggcccggctatgcccatatgccctcctcgtcatcctgcggccggcccgaggtggggaggtgcacagagaggaggggagcaccagaatgaaagaagagaaggttagttacaccgagatgcactggaaaggcacactaatcttcactttgttttttaatcttcaagactgaagaaaaaaatccatagtaacttaaattccacatcaccgacttgtcaaatacataaccgggttttgtatctatggcaacccacacacaaaaacattccacccacccagctctgagtctgtgtcaaaatcggattagaagattaaaattagtctacattagcagatgattatttttttggaaagcatgcaatctgaattgcatatgcctaaggagtagattaaaccttttaagtaagcagagaagtaattatagtaatcaaatacccttaatttctcttaagcttaaagtatcaataaaggctgaagaattaaaaacacacacacacacgcacacacacacacacacaactccatctactggggtggaacaaactttttcagcatgcgataattcatattggttattccacaaaggctcaaacatgctgcgatcttcttagttgacagattctattttgctctcagcatgaaagaggatgcactggcgatggtatgattatacagttgcatggaatgattatacatttgcaatcaaataagtttcaaagaaaagagaggtaaactttcaattcagtagaatgcttgtagaaagaaagttttgcttaacttaaaattgtgttcaattatggataaactgaaacttctttggttggaattcttgttgaaaagtgtttcgaaaatagctctggtgactttcctcacttagtgaagtggctaatatagagggaaatggaatctttgaagacagaagtatatccccaaagcaaagtcccttttttgaacaattctcacagtttactgcaaggattgaaacataccctggtgtcacacatagtttgagagctgtgccttttaataggtctccagtgaagtcagatttttccataatttgcttcttgttttgaaaatcaggaatagaagaaaaaaaataacctggaacattttctcattatttgactccttattggttaagttgttacactcttaggttgaatcctatgaaaatgccaatatttggccatttttacctagaaaaatagcagtttcatacagttccacctaatccggccaataggcctagtcatttttatctactcaaagatttatttttcaactgactttcaatacagtttatttcctttgtatttctatgtattttattttatgcattgaaaaaagtattctgagaagagatccagagagttcatcatactgccaaagggatccacggcccacgaaggttacaaatccctgactgacttgagtcaatggaatgatttgcacagagtctgaactggacaactcagtatgaattttcacttgacagcttaggtaggaatattctggcaaacaataaaacacattgatcattttagctgggccttcttatgtaaaaattatctgtgtttatttattattaaacagtctaataattgctcttgccaagaaacttcccttttccctatgtgacttaggaaaaatgtatttttacattcatttaacttcctctctgtccctggagaaaagaaactttgatgctccttttcatcttcatgaaggagggaagtttacaccatgagaccctaggccattcataaatgggtttcaaggggcctagcaaccccttgaaattcaatgaagaatgttgttgagtatgtgtgcaaatatatgtctctggatggaggccctagctttcatcatatgattcttgacccccagaatcgctgctgtagaaaaactccaagcatagaaggatgctatgatttgccaaagtcacaaagcaaaataggaggctttctctaaaacacagcctacggccactgccgacttcttcctaaatagctataaaataacttgcagagcagtttatttcatttcacatttaaaacccaacatatatacattcattttgttccaaatccattcctatcaggttttaatttttaaaagagaagaaagtaagcaaaaagaaaagccactgccaccaaaacctactactattttcttaacagtggaatgtggtctaatgcaaatcacttttagcaaattaaatatattaaaaagtggtaattaattatgattgaaacagacaggagttgtagtttgaaagtacacgctgccaatatcactactactgttcctcgtccaccataggaataaaaaggggctcccagatgtcgagggttattaaaaaccagatgttcagatcgacatcttgtatgctagtgaataaagtaaagaaatatgacagtccaatgtaaactttgctaacatttaatgtggcagaaatgtggataaattcctttcatgaactcagaatattatgcatttttaaaagtttttagttttttaaagtttaaagtttttaaaagaaaatagagaagtggtggctctttctggtctctctaaccttcaaagcttaaacatgaattgaccctcatcgccaaatgatctgggtcagagtgagtgtccgtttggggaataaaaaacaaaaatgcaggagctaatcagtgcgggagctccaagtctttccaaacatatgcagctgtttcactgctgcgctgcctgcatctctgtatgcaaatattaatttgttcagcaaccttactgcacagaaatgtaaatttggggacccaaaaataagaaacagacaagtatcacttgatccttaacttcatgctaagttgttgagaaatacttggcattttaaaatgcatctatcaggcctgggagagtctgtttcctttccttgtttttctgtttccaaatctactttgcagtggctgttctgaatgctgctcggtgtttgatcccttgtgtgtcctttgtgagtgattgttctgccaccagttgccaaaatatctggatgggaagaaagactctagtccatcagtcatctgcatgcttttgttcatctggggatgggaacatccaaggtggaccgaagcccagagagcacagtgaccacaaaacccagcaaattctgaaggggaggaggtttaactatcaaataacctcaggacacatctacagttccagggatgacgtgacagacaagggggtcttgatggaaatcctgtagtcccagatgctgcgccctaatgggattctgtaaatattgagataaaacaaaattcctcaccgatgggctgctcacagcggctatgttgatgacaagctctaaaggcaaagggactgagtcatcgttgacaagacaagagacttgttgttgtgggggggcatttattagctccagcaaagaggctctgagaagaaactctataatctgacatgataaatgaatggcccagtgtaaacctttaattggtctctattttgaagtattaggtatagccagcaggcaaacctgaggccaccaccggattttttttttttttaaaacacctgaaattctctttgagttgatagctggctttttttcttgaaatcaaagaattaagttcctaatggggatcttactgtcactcctgtcctagaaaggaaagcaagtagaaccagcgaagtatcactttcaaatagcctactgcctttgtgggaactcagccacggtctctgcctggaaggtccacctggctaccttgctggaaggggtgcaaggagatgatcctggttataactaggtctggtgtgggcagtcttcagactcgcctccacccctaattcattcatggcttctctaaagcttctgaaacttcaagccccaggactttgcaacgtttggctgcacaagtcatgaaagcaagatcacagtgtggaatttatgatgtgccctgagcctgggctcaaccaaagcagatgctgttagcatttccaactgcaggcttggccagagccgggaaaaacagacacatctgtaaaggaaaacaataggcttaggcatgagcctgcaaatgtggggcaccgagcctcatcagggtactagtaggttttctgctaaggtcaagtccaaaccttccctctggagaccattcattctgtcttttatttctcctgcttcctggaatgcttagtccatggatgaatgtctctgttcaggtgatggggtcaggtatggctataaactcttacatgacttgtatttattataatctctggggcccatttgcaggtaagatcccccgccaaaacaggaaagtcctagccaggttcagaaatctgcttcctgctcttttaaaaataagcgttagcttatttctgagctgggatagaaaagagccagtatgtatttgcacctcctccaggttagaaagagtgctgacggcttctgtgtttcctccctgaggctcaccaaggcccagtgacacaggtgtcaggaggttctttgtgcagatatggaaaggaaggctcagggagggaggtcaggtagctcaccaaaggacacctggccagcagctggggagccagggtcaaattccagcctgtctaaccacaaaagtacacccttctgactccaccatatgagccgagaagccacaaaaagaagagttcactttgaccccagaagacatttgttggttctgcttagctcagctctagagtacgttgaacttggtcctgccttctttccaagctgttgaagaccatggttggaactagaagctacaatttagttgggtccctctggctcttggaagaaaggggtcttcatatgcaagtggaagctatttacgtggacatatcagcagcaccccaacacattttaagatctctgaggggaaaggcagcaccttcacctccttcatactgtgccatgattctcagatgtgggaacttagatatttctaaatgagtaattatggaaggctcagttctcactgttttgaatgactggattcctctgaaggaatatgcttcctggattcccagagttccttacgattgccaagattgtgttgacttgtgtcttctcagaatgactcttcccctcttctatcgcacgagccacatctctggtttattcttctacaccccagtggtgaaagcgaaacttcattggctgagggggatcacagtaggagatgtccatattttaaaagacacactggggtgtctctcaagggagaggcaggtactggagaatctgtgcagcctggattggttcttctcagcaagttcacctcactaggacacgctgaggcagggcagccacctgagaccactttgtcaagccatcaagaacgttatagaagtttgggtggccttttcctccacttctaatataacatctttaagtgcttcctcaattttttttttttgcatcgtcattatagggcaaattgaagaaactagttttctatttccttcaagcaaaatagctgtgacaaactagtctttggtgcactgtgccagttcattcagctcaaggacatcagatacccagctgaagatgagaatggtcgaagcctctatgtcggccaacaatattgtttgggagcttaaaatcaacatctgctaaaagcggaaccattgccagataaccataaaaaagggtgggagtgaagacaggctttattttcgctccttcatcgatcagtcattaacacttggctttgttaaacaaagtgaaaattgtgtttttaacatgactctggttctgccatttccttcatggtaggcaatcaaatttccttttgactcttcatttcctcagctgcttaaaaaagaaaatgaggggaggctgaggcaggagaatcgcttgaacctgggagatggaggttgcggtgagccgagatcgcgccattgcactcactccagcctgggcaacaagagcgagactccgtctcaaaaaaaaaaaagaaaaaaaaaagaaaagaaaagaaaatgggactaccatatcctggccctgatgcttcataggtttgctgtgcaaattaaacccaagaatgtaaattaaaccactttgtggatgttacagacttagaccaatataactagacatatcatccctgttggtagcattaagagttgattactagtaaaacaaattatttgatattacactaaagctgaaggcaaaatggtgtgtctaaaaaggatctgatggggtacaaaatgattcttaaatattttagagtctctgggctgttcaaaattgacattattaagatcattaatagatggatgcccaaatccgaatttttaaaatgctattggtctgtaaggtggtttcctgcaataacagactttgtgagtgtgtgcagggtatgtttaaaggatgcttcctactccctttcctctgctggtcccttatctttggagtgctgcaagtgcctggagtgttgtaagtcaaacatgatccctattacatcagttatagaaaaaaagagaggcaatggtgtttagcaatataaaatggatttccctgcttcccgacatttcaaggttggccaccccctctcaatgggggagctaaagtgctgcctcttagacaaatgcgactggattaaagcagcaagttgaaaagaaatcaaccctccaatgttgccaagatgcgttgcatctgtaagctggagagtgcaggctatgtctgaaaaacccctgttgactcaaaggatactgcaacaaatctcttaatgtaaccctaatactgcaaacaaggtgtaaaacctagacaaatcagtaaaagaaaaaaaaaacactctaccccaaatagcataagactgaatgaaatcttcagtaggctcaaacctcctttaaggaaaaatccttttctaacaggaggatcctgatgcattaagcagctctgcatttttcccatactcagtgaagaccctacctggcagggcttattaatcatgccctcatgtgctcacatgcagggaattagcatcgcacccagattaaagggctttgacaataacctgctcatctgcaaagccagcttcccaactgctgcgtaactccgcctccctccctctcctgtagctcttaatggttgggtgagcatgtaactgctggtagaggaaggaggcagttaaatacctcccacaacaacagttcagacatttgtccccatttccttctttacctgtggcctcacagagagccactgcagggttactctacagcttctgctcttaaaaacaagcaaacaaataaactgccccttttatttcccaagggtgggaaatcacatatgccgtctggctcactttctagtagttttggggatttttagtagtctctgagggataaagaaaaaagagacatctgcgatatctttctatttcttaacctgctaaacacagtatcctccaatctacttgtgagaaaagaagtattgggaaagaggcaagtggctctcaagagctatttcaaaatgcatgccaggatatccttggctacagttctgaaaggactggcccaggagtggcaacggtcaaaacttctgaacccttctcccatgcaatacacatcagcaccaataagaggtttcttcatgggttgttgaatctgaaggcttcatccccacgtgaaacaaaactcaaggctccttccaagaagtgggccatgacattagatttgcaatgcaaaaaaaaaaaaaaaaaaaaaaaaaaaaaatatatatatatatatatatatatatatactgtctcttatctgggcaagctttagacatactagcttggttggaaactgatattaaaagcctaaaacatgtaacttttcttatcaggttactatcatggggaactaaagattcctggttttttgtatgttccataactatactttagtaagccctgatatacggtgttaatttttcttcagtgaaggaaacatgaagatatatttatgtgcacacatacatatatatgtatatataacgtatattcaaacatgcactcagaggaagttagggagagaagtttctagctaaacatgatcttgtgaaattcttccatatgtggaaaagtcgtcagttcatctgacatagagcaatacatacatatatacacacaggatgctatgtatacatttatcccacattcatttaacctcaaaacataaaataaattctttttattcctccctaagcaaaagctaggaataacaactctatatacagaattcatcttctgggggcaacagagcaggttggaccccttgcctgtctgtcagagttcaaagggctgcacattgactaatctgttggtgaaagtgcaagggaagcagagcatcaatcagaaaagctggccctgcattcacagagaggggctcagtgggagtacgggatcccacggcctcaagctggtgccccaggaggggctgctgtgactgcttcattcttctgttggactgtgaggccccaccaacttcttgtggactaagcataaaatgcagaaggaggacaaaagcaggtgggttttatgaaaaaagaactagggccaggaaacacatgggcctggagctgtcacctgcctccagccacaacatcgatgaggacataattgcagggatggctggaaattcccctctttaaggaatgctcttataggatgctgactaattctacctgagagcagtacccaaggctcaggtgtatgcagaatggacagaggtaggaggtgagagagcaaaagccctgcttttcttttctgagccaactctaccttatggctcttttgcctgtagaaagaggggagaagggacatatttagggaccagaaatctcaaaaccaaggcagtgagtgctgcagcctctctgaagcagagtataggttcagtactgtaagcatctgcctatatgcaagaatccagaatccaaacacagaaaggaaaagcagattcctatcaaccattataaattaggtcactgggatcattttactgtatcttaaaatacaatctgtgtatcagttctgtgaccagagtttgaagagaaggccaaatctaggcatgggttctttagtaaccaagaaatttgatggcttatggcaaaacaacatgtgtcccaagtagaattctatgggaattttcagcagaaaatggaagtgaacattcaatgctctgaaatatgtccaatggtacaaacacgcactttggctgagagccaacacatgctgggaccacacagtcatcaggagcagcagagaaagcaccaaggattactatttatatccacagacagattctggaaattaccaagtagagtggataatatttaggattagggcaatcaatttcctaggacaagatccatagaatggacagacaccttaaagttcagaatgcaatagggaaaacctagcttctaccacagaaaagtcactctctgaaagtacccctagcaccctggctgatctgacagcagcccttagcagaataaagcatcctctgttttgctctgggggcatggtttgctccagatccttacatgttcagaggctcaggggagagtgagcaagggaatgtgagtcttggcaatccactgccaagaaccctctgtgacccagagcagttcccctccctccccgggccagtctctccactacttgaggatctcattctggtgattccatagaagcaggagagtttgcaattggcacagggacagcaggaatagagaagagtaaaagggaacaggtaaaatggggggaaatggaaggaataaactcacaaaacagaagaatggaaataaagacaatgaaagctggggcaaatggaaagagaatggatgagactacatattttttcttcttttttttttttgagacgaagtttcactcttgttgcccaggctggagtgcaatggcgcgatctcagctcactgccacctccacctcccaggttcaagtgattctcctgcctcagcctcccaaatagctgggattacaggcactcaccaccacacccggctaatttttgtatttttagtagagatggggtttcagcacattggccaggctcgtctcgaactcctgacatcaggtgatctgactgcctcagcctcccaatgtgttgggattacaggtgtgagtcactgcgcccggcaaagatgacatttaattcaattttggaaaataaacaaaataggataaaatttactacaattccatgggaaagggaaaaagcacatttgcactcaagaataagtggatccatcatagttgtgcaatcataaatacacgtggttgcatagatgtatccaaggggtttgccaccaatgtatagtactcagagactcaggatttcatctggggcctgttgactttcagttttgtgactctggatcattaacaacctctgagtttctttatttatgcaatggggatacttccatctgcccttcctacttcccgaagctactatgggagcagttcattcaacagacatttacagagtacctcgtaagggccagacatgtgtgaacatgggacaaagaatctgaatataaaatgtgaaattcaaccaaatttttctgtaactgatcacataagtatcatgtctccatgctcctaaactcatagccctcatttagaagttggttttctgtaagtaaaatgtgaaatttaaaatttaaatactatcagaaagtctcaaaggtggtcaaaatccctcgagctctccaacacctatgagcgagtatttgcattcaatgaaggaggaagaggagagaagagttttctcttgggctttcaaaagtggccacctattctgaggtttccagccccaaaatatttaggttctttgccatttaggcccttcccaactagaatcagagcggcaagtgctttaacacatagaagtacattttgcacaaacaagcagtgagatcagggtccttgaagacctaacacccaacccaagacccgggaagagaaatgtgagtcctagatgcacaaagggtagcctgcatggtgcctggcattttaagttggctggggtgtggacctcatgctgatgctgtgcttttcttattcaccaggttagtctatacctgggagccaatggaatgagcttaataaaatatgacttttactgggacagtaaaacttgtatgatgcctagaaaaaggaaagtagaaagacttggtatcactgatatgttttaaggcagagaaggagatgctatttaaagaaaatgacagatgagactgatgacaacagatacagagaacatttaggaaaagctgaatttctacttggctttgtgaaatcaatcttggtaacctaagaaaaatctctaatgtgtctccagcatgtttcatttactctttggactttattgtttctcaaaacacaccagcagcttgtgtcatgggaaatatttgttgtctgcccccatggccacttcttgctttgaaggatttcccaagtcattactgggatttgtctagatattctacttggacatattcaatggctgtgaccatcctgggggtcacagcccaccagctattaaaagcttctctctcaggtagggggctagattcttgagctgccacactgcactgacttctcttacatcttctccaaatcttcccaccccctcagtaatccctcaagggctgtgtatttatgactattcttgatatcctgggtcctcaaccttaatgactcccttagtttagatctactgggttattggtgggatcactctttctcagatattattgcctttaagaaggtatcccaggaaatgaatggaagaggcacttccattttcggttgtgcaaagcaagaagctgccggaaaatcccaccttctgataaaaaatactgctggaaactggatcagtcatgttataaaatgggtagtctcttttttcacctgatactctgagaacaatatttcttacagcacagatgttacttgaaagaaaaaagaaatctacaatcaaataagtctgggaaatactggattaaattaaattggggagctttctttcttatatgactttttagatcctttgatctactaattgccccaggacgctcgaagatagagttgtaatatggagcactttcacaaaatactttgcccagagaatctttgtttcaaggctttcctcatgggactaatgttctaaaagttactttgggaaatgctagtctagacttataatacttggattcagtttctcttaaggagcaagaaaaatcatagtgaaggagaaagaaacatggaagaaatggaaaaagaatataattctgtaagtacctggcaatactcacgtaattgaattacctaaggtaaaacgagtttttctggaaaagtaacaaggcaaatgatttttcatatttctccattttcatgtgttctgatctcttaataaagttcaagaggcaatatcaacattttgtagcccttcttccataagtcattgttggtcaagcctttaaggccacaggaaggccagggctggaagattcacagaaagggaatcaggaatccctgaaagagacctttcccctttaagtcaggtcagctaacattatgtacattatgaacatttagttaaaatctcatccacatcaccccattattaggactctcatgctttcatatggctgtcatttttctcctaagaagaaacatatactcatatgtaccctgtatctattagtgtatgtggtctacacaattaagtgtagggtttgtaatcaattgggaaagataactattgataactattatccattgataacgactttattctgggacttagatttataacagtacatatactgatatattagttattggttaccaaatctcaaatctccagtataggacaaggtatcattccactagacctgggatgcccagtcaaaaggggcatccagctcaggagatatagccatctccagcactggtgccaacctactctcacactagggttccttgcttaatctctccttctctaattaaaaaagtctagcaaaggagccttactgacttgatgacttcaatttaaaaccacaaaaatatccttgtggtcaagggtattttactttcacagtgacccccactgcagaataagtttctaaggtatgggcccctaattaagttggagctaccttttatctgccttgttctgattgacatgaaccagaaaagaattgaacaagacatcagacaacctggattcttattctagggctagacagcaaatgccttgaagacaggggttctgtccatcatgctcttccccaagtgccacatagtggctgccatggaattaggttaggaactcggaacaggattccagcctattcacccacttcccgggctccagatttctcatctggagaaggcgatgaggttaactgcctctatgtccatgggttgcttagagtgttcactgagatggtggatgtgaaagtgaaagaccatcaccatcttcctaacagtagcagtgagaaacatgtgccaaaggtctcaacaacgtggcttagccagacactcttcaaggaatgctaactcttctgggaaggacaccaccctatgacaaactctagtgtcagtggacaaacataagagtcagtcaagtggacaagacaccctagtttgtgattacacctctctggaaaagtagcaggagcctagcttttgtaagaaataccattcacaaagcagatagatgtgctctagtgcctcattcccagtagaacatatgagcatatgtgtctctgtgatgagacaagctggtttgttatctcagcaggtccctggatgacctactcccctgacttggctccaaatccttctttctactcttatggtactctctgtttttgtctctctgttggggtttgagtgggggaactcaggatggtcttctagcatgtgtggctcagaatgaatggccaaagtggggactgcaggctcccaccaataaaacctcatactcaccctatctgggagaatgccaaggagaaaaaggcagggaccaggaatgagaacgagttggtttagttagcaggatgccaggtctactggagcaggcagaggtggggaggtggtagtggtggtggtggtgatggtgaagggtggtaattgaataaataaaaccaaaacacagacatacaagataatgacatgaaattgacacctctctccacatttcagatctccaaatcaagagcaatattttgggagctaaaacatgaaatcatgccctgtctgtacttggcttcggaaatctagatttttttctgtgtgaacaccttcagcaatgttggggtctcggagggcaaaagcttccaggtacaaaggtcaggtcaagctcaggggctggggagcctcctggtgctggctgcctcactgcacagctcccaggagaacttctaatgctgtgttctatataaacagctcccccaggacttgtactccaggtaaaacatcttggaaacttcaaatcttaacctctttgggatgctagcaacaggaggtgaaaaggaaacagagccacgtgaaaagttttcggagcatcacaagtacctcctcccccagcaaacaattaaactgcctcttcacacaggtaattctgacaacccctcaccctgccatatccaaaggagtgcatacttatccagatggttctattttgttacctattgctcccatctatggaaatgtatcagttacactaggatcaccaaaaacgggggcagggggaggcaggaatcttagtacaacaaagtaagaaatattgctcatattgactatattatcctgctagtttgcatttaatttcctaatttccataaaattcaccttcaagagttttaatactaaacattgtaaatagtttttgcatttggtgggtgaatgtaaatattgctgtaaaaccacaggcggtttttgtttttgtcaatccatcttttcacatgcgttacttagtcaagggaggagatagggtccaaatcaaataaaccagactccttgacttcactggctaaaacgcaggcaaaacggatttctctccttgttgttttacctcaccattaatttgcatcactaaagaattttctaggaaagtgctcagcgaactcaaggcttctctggttgccaagctcatggaaacaaagtgctttctcttaaaactctgaaagagacattccaaagtaacccgccatgagataccgagccagcaatagactacatatctatgaaagaagaaaggaggggaggaaagaaaatgcataacataaacaagaaaagacaaaaccttaaagaggaaggagaaagaaaaacatttagattccttgactgatggaaataaataccaaagctattagtttcagttcaaagaacgtatcactttatgatgtttattatttcttgaggattatttattttatcttaaaatatctaaagggtaaaaggggtcttggaggtaagcagcgatgaaactgacctggtccggagagggcctgtgattggaatgttgcgacctcccaggagatcgatggtggtggtgatggtggtggtggtggtaatggtgatggtcatcatcatagttgtctgccatcaacttcattctgttctgggtctgtgcagaacaaaaaccaaggaagattccatcaggagccagaagatcagtcaaagagattcagggcataattacagtacctatagggatccctttgttcctaattcaggaattttcactgttagtcaagttgaaacttaataaagaaagcaccatgacattaactttggtgaaaaaagctctgtcacatccttaaagctattatgttacatctgtaaatgttaatgtacttccttcttgtgatttaaaagggaaaaaatggacatactctaaggtgctttgctttacattatcaagcaatcacagagatccaaggtgagcttgcaattgcaacaattatgactgagactctagaccaacactctagagcaagctggagatggaagtcctgtatggaaagatgggaagggctgggtagaaacacagaactacagataaacaatggtctcacaagacaaggcagaaaaatccacttgaacgctgccaaatgcaaaaatactgatggagatggtttactgctatgatgacttcttgggaaatggctctctacggacattttaaccgattttgttccttaagggaactgagcaaaaggtacaaagtcaatgggaaaagaactgaccactctaatttacaatccacgatgcctgtcacatgaggcaacttggagtcatggttaaacccccaatgcaatagaagtgtactgctttattatgcagggcaagaaatggaccagtgatgagttggcctgacaggctctcagaatctagaaaaatgcctaaagaccacgggaaaaaagcagacaaaattatccagctcagaaagtcaggaaatgagggtttgaggacagacctgcctggattcaagtcctggctccacctctttgctggttatgtgaacctaagagagtaaactatttataaaccttaatttcctcaactctaaaatgagaggaatagtgcctctttcctcggggttgccgctaggagcgaatgatacgatggacttcaagtgtcagtccagtaactggcaatgaaagtcaaatgctgtcattactatagttactgctgttgttgtttgctgtaagacatttttcctcctttgtatgtgctgcttcctttgcttgcaatgcctccctagccccctttcttcacctttaacttctatgtctggctaactcaaactatttaatctaggagccttttcctcaccctgtcctggaggctgggtgacacgtgcctcctgcataccatggctctataaccacagatttatccgtccgtatgtctgtagaccttgaagctatttctttcatctgcctctccctagaatctcgcatagggcctagcagatgtagatatataatacatgctgctgtaatgagtgaccaaaagaatgaaggggccatgattttgagggatgctgccatcctagagacaagctacatgtttgttttcagcagggaaggtcacggagagttgaggacatttcatgagttgccataacaatcccactggtggctcaagatgacaatgaaccaacaatactttcagagagccagaagtcagtggttggcagagcctccaaccagttggagttttattatgtaatataaataatacactgacaataaagaaaagtctggacctaacattgtgcattcttaatagtatttttcacatacaatctaacttattctcaatactttcccaggagcaattattactatcctcatttggcagctagaaaagtaaggtgtagatttcagccccaagagtctctttcttgacatagaacatggagattttctgggtcatccaattctcaatctctaggcttttttccttgtcttgctgctagcagaaaaggcaaacagctaaacaggtagaaagaactttcccataaaatgctttgattctgttaagttttggaaacacctcacatcccaattctatctgccagaggatgtcttatgatttactcactccatttttaaaaatgtgtacaatatttgaaaggccccaaagtgaatgttaaaaaaaaactgtctatatgaataaaaacaataaaaatagagggaaagagccacttaaaattaaataaaaaatcccaggcaacctctggcagctgagagcatttccatccttcacttgtccacttaaagtgtcagaagacccaatgggcaagttatgccttgtgagaaagagcaggtcagtggagctgctgcagactaagtactgagattcccctcagccagcctgccattgcacatgagattctgaaatttggcgtttacacctaaaattccagtattgtcaggatcctgtacttttgaactcatgaactaataaatctggaattgtttcttctaaatagaattctgagagcctgaggggagctgtaagatctgctgtgggcaagaaggaagggactcgctcaagaatgaaggatggagcctaaatgaacaaataataattctgctattgtaaacatcgtaatatcctcatcctttggggaagctcctgtgattttatgagattattttcttaccagcaacaagcctaaagttccctacctttgaactgtatcccataaaagaatgtacaagctaaacaagatgctatatgcagtcctaaatgtgtctgctaaaatgaggtgttggagagtaggcatgtcatgggataaagactgtaaatgaatgatgtcatctttccaatttggtgctgaaatataaataaaccacgttgttcatgtgaataccagatctgggggaaatgtacacagagcaattgtgagcggaagaggcttcttttgattagtctgggctggaagagaagagtgtgaaacagagatgaaaaatgagagtttggtctgatactctagaccgtttttatttatcttgcttgtaacatatcccctaaactgtgaccgatttcttaccggctagttgctggtgttctctcctataaaaacagtttgaccaatcttgatcctttaattgtcaaatttaaaatggatctcttttaaattttttttttttaagtctgcactatctagcttcatccccacccaattataccggtttacacatagacaagggtctggaaggacaggaagtcacaaataacactccctaacagtcaatgaaagaaaaactacagaaatttgtaacaaggattggacagggatactgtttgttcaaataactctaggccaacttaccaggtgatcccatacataatggtccacagccctgtagcctcagatgcttgaggtgcccgctgaaaagcctgaagcagcaaatcttctgggcaggcaaaactaaacacccaggaaaactaatatagagttggagagggattgctttccacagcatagcacttaggaactcagggactcatttagcgattcactgaggcccatttttatttcctttgcggtgtctaccaaactgctgaccagacacctttgcctttggctaactgtgttatactctttttactatattacgtcatgactgtggagacaaatctaatcagatttcattttctacttcctctttcttcaaggcgccaccttatttctctggggccatcgcctcctaacagctctcctgctgcactctcacctcccattgaacacattccatagccagagtgacatcagatttctgttcctccctggattcaagttcttgggaggctcccgccacactcaggaaaacagcctgggtctttgacatgcttaggcatctcttgctaggtgactgctagttacttccagagttacacctcccagtctccttgtcccagccttgggacatgctgttctctctctcggtcctgctcttcatgctctaccccttaaacctgagttatatccattagttctctggtcttagcttcaatgccatcatctccagagacaactttcctaagcccgcctcttccactgctttcagcagaatcctgtagccacccccctgggtctctgccatcacagaacttatctgaaccaatggtaactaactgcaggttcacttggctttctccaccactaggttgaaaatctcttgagggaaatactatgtgtggattgcccttgcactctccatctagtgcagagtctcatgtcttagctgtaagtaaaagtgtgtcaaagtatatgagtgtaaaaatggatggatggagagggcacacaggctactgtggaacacataagagggaagatgggagtctaggatgagccagttgagtatttaacttttgatgtggcagtttaacttttcctgtttatttgtttttgtttgttgtaattcttgggagtggcgaaggaagagtatgtgcatagctttggagctgttaggcaagtcgaattggtcttcttcaagaaatatgccattccttagctaattggacccagtgcaatactctaccacctccctgattacttacctcactaagaataaggggtgttggggtgttattagtttcatttcttactatcccctagcgtttgggggagcaggagcctttagaaaacctctgttagtgccaaaagtcaaacatggaaaactgaaactttatccattaactaaaatatctgatgagcaccatctgtgaaaaggtgccagatactccaactcttttgacatttctgaagagtttatccaaggagctcttgaaacaaaatgaaaatccttgatcgactagtaatagactcaatagcctaatggcaatatggagtgataaacacattgaattaaaactgcttttaaaaatattttagtaaggtggcaataacaaactttgctttgatcagtcatctggatcaagttaacgataaaaccttcatgaatacggtttaaatagaaaaaaatataataagatctgttgctatgggatatggagataatactgtacaatagcaattactgttttattctatcaggctttcttttctgtccctttttcccactagggaaatcccaaacgttcaggaactcttctactgtcttgtttccacctaatcagagcaaggtgaacagctcttgtctccaagtaaaagatgagcaaaccagacaagaatgggatggctaggagaggagagatttcctgaccatccactagactcacatagcaatgaatcataattgagtagaatctaagttgcagcactcaggtcacagttggaggacaaaatgaagtcagaggatgcagaagctattaaaggaatgtgccgcattggggaactttctgggagtatgtaagaataaatgatgtaaaggcttctactgtggacactgcactgaaattcactcaacacttactgaacatctgcaactgcaatgatgccaagaataattatgtgccaggctaagtgtttggccagcattctcctgctgaatcctcactcctgagatggctattcttggggccctcttttacagatgaggaaactaagcccataactattcagctagtgagtagaagaacagaactcaaacccagatgtctgactccagagtcctacagcagtgtcatgaagggtaaggtccactccaggtgcaggggtgaggcaaagatgaataggacatgaggaaatagaagcctgactataaaaccgtataagaagaggaggaggagagaagggtatggtttaaatggatgttcagaggcaacagatcccctccagctgagggcagaggcatcaaataaggctccatgggtcaaacgccccttgagttaagatttgaaagttggcttggctataggtataaggagagtacactggggagatcgcacagtaaagtggccctccaatcaccttgagaggaaagcaggtcaatgaggggaactagaacaccaaatgtgagatatgcaagtgtgtgtatgtgtgcgggcttccttcattcctttactggatgtggaaagagcaggaaatgtatgtgagatgaaaattcaccaccttatttttcaaaataacatcaacctgtggcatttggaaggaatttaagacagagccacagccatatactcacccatgtcacactgtaacatctctgggaaaatgggccaggctcttggcatctgtgtgtttacagatatctacacaatccactgctatagcatcagtccttccctgagcactggtctgatctccccaaattcattcagctgatccatccttcctgcccctcctctatagcagaacagaacactggtcggactctccctcccaactttgttaaaggtggctctctctctcggtccctatttacagacagaaatttagtagatcatcatgaaggtttggctggtgtttttatacctactcattaagcacttttattttattttattttatttttaattgttgcagagaatgtcagggtccctcctatattctcttgttccacaccagatcttgtctgcagcttggatggacagtcctggatgtgctgctgtcttcccaccaggagcccgtgcatcttcctcggcttgaggtcttgctttggccacaggtgcacacttggccagggaatggggcagatgggaagtgttagggagctcacgcccctgaaacaactctaaatctgtgagggaaggagatggtacataaatagccagcatcctggcccctcagtggacaaccctacagtgtgctccagaatctttcactaggtcctcagcagtgggagccctgtttgactatagcagaaaactgcccattgatgcaccctttgttggccttttcccttccctgtatcactgccccattctctcaccatgtttctggagatcacttctcaaataaactacctgcagtaaaagcttgtcttgggatctgttttgtttgtttctgtttttttttgtttttgtttttgttgttgtttgtttttttgagacagagtcttgcctgtcacccaggctggagtgcagtggtgcaatctcggctcactgtaacctctacttcccgggttcaagtgattaccccacctcagcctccagagtagctgggattccaggtgccttccaccactcccagttattttattttattttattttttgtatttttagtagagatagggtttcaccatgtcagccaggctggtcttgaactcctgacctcaggtgatccacccacctcagcctcccaaagcaatggaattacaggcgtgagctacctcacccagcttggggtctgtttttgcaagaatctcagctaaaaccctaatcatagttgaataattaacaagcctgcacttaatttttgcacaggactaacacacctgtgactcctaggctcttttccatggatacttcttgagagttctcatcacttagcgtgacagaactctcaccttccttagggaagtaacacctgcctagcactaattcagtttcggccaaacattcatattgagactcagactgaatcaggattccttgagtctcatttcctatatctaaaaaatgggcaagagagggaagaatgtcttcagcataaaccaaacaccatagatagacagacagatgctgatctactgctcctattgcatattttgtgcagtttttcttttcttttttcctgctaaagtcaggggagggaaattatgttgctaagttgctttctgtggccaggcgcagtggctcatgcctgaaatctcagcactttgggaggcagaggcagccgggtggcttgagctcgggagttagaaaccagcttgggcaacatagtgaaaccccacgtctacaaaaacaaaatacaaaaaataagctaagtgtggtggtgcatgcctgtagtcccagctacttgggaggctgaagtgggaggatcacctgagcacagaaggttgaggctgcaataagctgtgatcatgccaatgcactccagcctaggcaacagaatgagatcttgtctcaaaaaaaaacattgctttctgctgccaccttaggaacctggggaatcccctgaagggttatggacagtgactgtagccagaagcagcatctcccctgttctactgtcagccagtacagcccatgaggaaggattatttataaagaaagagttctatgtgctctgctcataatgttaggatcctaaccgacattgtgagatggagcctcctgttaacataaaaaataataaccaatgcctgcttggcccttgctgtgtgaacaacactgtgttggcatcatctcattaagtcagtctgacatcaaccctgcgatgcaggcaggggtggggattgtatttaaaatctttaatagctgctatgacagatgcagaaacccatgagaaccaagagtgacacagttgcacatgccctgaatatttgccttggttgaagcttcttattactcccactttacagatgaagaagatgaggcttagggattaagcaactaatcagagctcaaataactggtagatctgaggctctgactgtgcagcctcctttgtaaccagtgcatcccactgctcagatccttaaggaccagccccttcataaacaaatcaagactgacctgggaatgggctctgatcacccactccaatcatagctttaaagaaaagcagctcacttttgattttaaaattccctctgaaaacgatggaactcagacacattagaaaatcttaatggagccccaaagaagtccatgttactgaccatcccctaatataaattcaaaagtcattatgcacagtccacactagcgtttaatgcttcaaccaatgagacagctaacagctaggctaacacattagcaactccagacaaccaaggaatttctaacatcctgagcaccattgctagtggcagagtctgggggaagggaaaggccctagatgtttccaccacaaagttacttagttaagcgcaggtctgtttaattaagtcgtgggcagcacatgctatacttagcttttaaacacttgtaaagtcctcttcattcatttatcttacttgtcactgacaagctcttcaaggactgtaacagtatgcagagcatgaagagcctgggtaaacaacacatattttatgtggagtctaaactgtttcaactcagaaagtcaatagagggtctctgaaaaaaactccagactcttctactacagtgtggaaacattctgtgcatggtctgttaggagtttctttagaaagtgaactccaaataaaatcctaattttttaacccaaaggtaaaaagacaaaaataaataaataaataaataaatggaggagtggaagaagaaaggtgggagagaatgaaggagactgggaataaataaaggaaggaagaaaggagggagagagtgagggagggaagagaaagaggagagagagagagaagaggagaggtaaggagaagagagggaagagaagacaagagaagagagaaaaagaaaggaaggagagaggaaagacagtgtttgcaggtattgagattcggactctagaattgtgctgacaagtgaagacaacattttcattccattcataatccaacaaatatttattatcactggtttagggagaactggcatcatcaaaacagctccctaactaatgaatgggcaaaacagcctcggggtatcgcctaacagaattggccaataggctagaaactggagcgtgaacattctagtagaactctaggagcatgtgagattctaggagaatgtgaggttgagtaaaagccagcagcgccctccgaaagaggccgtgagagtcttaaacagggctatgaagagaggggttcacatacccttggaggcaagataattcacagggagtaaatgaactgctcaacagttacatatttactctaaaatatattaaaataaattataacaagcacatcaaagagaggtttcatagaaattatgtcttaggatgtggaaaacactgtgaaggtaatcctcaaaatgtctgaagcttgagacaccaccatcagaagggaagggtaaagcaaaggagaacggactgggcaagcagaggagactagaaactcaggtcagcccagagagaatgaacatgtcctgagaactgtgggaggacggaaggacgctctccttcaagggctttgaccttcgcgcagaagtggaagcaaatgcaatctgggcctgctcccagttctaaagcagaatggaagggcataaacctcccagcacctcacctccttcaaaacaaaacaaatgaccccccaaagggggagagaagggatggggtgagccatgcaaaacatgtggtggggctgtgttggccagcaccgagcacagttttgactccaggaggtgtggagacagccaggagaggcttggcagctgggagggagaacgagacagggagaggcagccaggcccttggagggggaacaaatccctctccccagctggtctcacgcttgggtgagacaactggagaaaatgtaaacatgctcattagcagttttccaatcagttgaaaaacaaatgggaagagaaaaatggcaggcgattgttccaaataccaactctctgccacatctcctcaggtgtttatcagagttgcccgctgtgctgtcctccctttcgtctggatcacaacacctttactagctttacacggaacacttggagctcaccctaactagggtcgatttagttctatgaggagtcacatactccactcaggatagaaggtctctgtggacacccccagagatgcacaaacaagacagggacatcatttgcaggtctccccacagcctcatccaagctgatattctctcagtacatgaacatgaaaactcatcaataacccctacctcttctcctgcgataacttacccccccaaagaagaggcaaagtggaaattttgtgaatctgtgtgtgaatctgacagaaatccaatttccagaaaggatgaagttatactcaaatttcatctggaaatgtctactgtgttgagtcatatggttgttttttttttcctaacacatcaacttgaattcattgaatgggtacatttcaaaaaacactttctcttagtcacctatttaaggtggaatccaaaaagcctggttgtctgtgaccctgaagttgaaatagcttaagtacaaaatgtccaaatgtatttaaacttgaatctgaacaaaaatagatactaaagtacataactgatgtttcttgatagtactaggaaaaggcgggtaacttgaaagttggggagaccgtctcgtagactagagaattttagggctatttcaaatctctcccctacaaataaggacttgccagaacaacccaaattcataaaatgttaatactgggccacatcttcaattagtgaatccaagcttactactttacagaggggagactgaggctccaagagggggaaggttagttgctgatgggcccaggagaaacccccagaatacttgacagctggaacctggccctgtccttgcccctggccgtcttctcatttgatttgcaactgcagatgagtccaccatgtccatgacctgtaacaccacaggcccgactcatgtcattggttttgcgttccaaagtactatggtattaatttccattctttcagtctaaacagcatcaaacacctaatcattttgttcttgatggctacagataggttaaggaattttccatttcctttgagataggagcctcacttctctagcagaactactgattaggctttataatttttcttttttaaataacatctgtaagtttttattatgtaaatcatacatgctagttatgaaaaattaaagagtacaaaagagtttataaaaagaaaagtaatgttctccctccctctgctccaatatttattcccgctgttaaggtttttctgccaatctttctaaaaaattttgtgcttaatgcaagcacagacacacatacttaccctttacaaacaatatctccaatattgttcttccacatcaagaacatagagagcttcctcatcattaatggttgcatgttattccactctatgcgtatacttttgtttaccagtcctctattgatgtgttcaaatagagactccaaaagggaagatatctttttttcattttattccaagatgcatcccaagcacctaaagcactgcctggcacatatggacatataataagtgtttgttgaatgaataagtgatgggcatttgggtcatttccagcttttcattttttccaacaatgcttaaaacaatatttttgcaaaggaacagctttgcttgtcctaatgtgtttgtttccaacaaagacggatgcttaaacatatcatagctgtttctataatgtgctaggaaaaaacaagttcaagagagaaccctaaaatagaatatacacattttaaacttggaaggatatcaccaaattcccttcaaaactgtcaatcaacatccagcctgtacctctttctctatgctgtgctaacatggagtttctccaaactctttaatcttcaaaaatatgataggtaaaatattgtatcccatgtgttccctaattataatttgaagctgagcataatttcattcatttagtgtctatttctacttcattatctgtgagcccccttttaatgtccttttttcccacgtttcttcttgatcatttgggaactatcttcttatttgttgtgagaataattgtatatctaaagaaaattagttggggctgatttcaggaagagaagagcataagtgaaggtgggaagagggcacataaaagcaggccatgcagggaagggaattgtgcagacaggtgagaggcgaggatgcccaggagcccagtcatttgaacactttaggtgttctcttgagtagaagagaaaaggggggaaagtggtaggtagttgatatgctgggatgtgaacagagttggcctctgttgaaccattagcaggaataaatgttagcagttgatatggggctttacttctctgcagaagattgttgggttttttgagtgttaagcatgcaaatgccactcatgcttgtgttggtagaaacaatctaatacaacctgctttcccaaacaagacttctctttgtagccatcctggtggatggtggtccagtcttcattccttatcactggagatgggagactcaatagctatttgataatgtattaagcagcttaaataggatgctccctgcctcctacactcatattttgagctttgtacctgcagttgtaccctacttctgcctttttgggcagctcacgtcttcagatatttgaatacagttatgcccattatctatttgttgttctctcaactagtcactccccacttctcctagtcctctctctgtaccccattgcacaaggtgctactacatgcatcaaggctcctttgagagaattctttgaataaagcctgaaactaagtcttcacatgtgtccttacatctgctaagcatgatttaaaaataagtaatatactcttaggttccattgatttttaccatctgctgtgcaatgctaatgctctaatttacaattgattaaactcatatcctggttgttagttcctctgccattctctctctctctctctctctctctctctctgtctcacacacacacacacacacacacacacacaaaccccagaattttaattctaagtatatacttcattcttttccttattaaaaaaaaatttttttttgagatggagtttcactcttgttgcccaggctggagtgcaatggggcagtcttggctcactgcaacctctacctcccaggttcaagcaattctcctgcctcagcctcccaagtagctaggattaccagcgcccgccaccatgcctggttaatttttgtatttttagtagagatggtgggggagtttcaccatgttggccaggctggtctcgaactcctgacctcaggtgattggcccacctcggcctcccaaagtgctgggattacaggcatgagccaccgctcctgtcccttactaaatattttgtttagacttatactgactaaatttgggtctatagtttcatctcgctgagatgtttctcaagtctgattttgtctgccattgtttttggtaagctacatggctttgatgcatcctattttcaccaaaaagcatgttttcaaaggctttgtataattagttccttgtacatgctggcaggtcacagcctagctcctctggcaacctccctatagaggtgacaggattccctaatcaacctgcctattataaagctgttcaatcaactataaatccatccatccagtccttatttctccatgtggtaaaaaagctattcatatacatataagtttgtcctgttgtattcctagctgaaatcttggtaccctggtaccctgcgactatgccattcccttgacttgtctttctatcaaccttatcaaaaaccaaagtgacgttagcattacttaatcttcaggaacaaataaatcttagtgattgctgattttattctcatttcataagacatcaatttaaagacttattttgcaatctaggtgaggaccaatattgaacctatagaacttaatcaacatgacatttgtcttttaggcatttagtggtaaagttctggaggtgggtaaaattcagaaaagcctaaaaaaatggaaagttaatttctgtcttctttgggtgctttcatccactgttggcaggattttaagttggcataaactttctcaagggcaatttggcactaggtatcaaaatttaacatatgtctaccctgtggtccaatagtctcttcctgaaaaaaatgttggagaagaacacagggatgaatacaaaagggtatcacagggatggcaatcataggagcagttaatgagaagtaaccaaaatgtccatatattaggctttggtttatcaaatcattaaatagctgttattcctataatgaaatattcagaagccagtcaaaagagtgatacgtatttgtattcaccagaaggaaagtgcatcacaacatataattaaatggaaataaaagcaggctgtgaaacaacatgttcatataaaatagtatataaaagtctacatttaaatatatatatgggtttgtatatatgtgtgtgtgtgtgtgtgtgtgtgtgtgtatatatatatatatatatatatatatatatatatatatatatatatgaaaagtacagaaagatgagcaccaaccatttataattattgctgggtatttggattttagggaattaattttctcctttattcctttctatattatttaaatattcaatcaggtacaagaaataataaaacaataaaaaaaaaaaggtttctctgctccctatacaaaaatgcagagatataaattacatctcatattagggggagatactgttgaaatcattttagttctggggaaaagactcctgagactgagaattttgactttggagaattgagactcctgttgccttctattttagtgaactacaacagtccattcaatggagcaccctaacttactggccacagctttcctccttccaccttaatcttttaaaattccaatttctcctaacaaccagcatcaccaatctctcttaagtttagcaaactgcaatgacaggcatggttgtgtctatgcacaaacagctggatgggaaaggaaaggttcccaagaccctgtcaggctctgaaccaagacactagtgccaaattcaagtcctcccccaagaatccaggggacctcggctggatcaagtcactgtctatctgaatgtcacatcatgggcctaagattgggagtatctctttgctgggtcttttcaagttgagagagttaatagtatagctctaagttcagaaaatatcttttaataatacagcgatgcaacaatgtataggctaaagtcatgcaaaaaaatttttctcattcccacacactgaacttggtaattatatagaagcttggacattaaggacccagacataaaggagtggattaaaaagcataattatggctcagaaacagcatgtgcctggggacactgccagccaagtcctaccctacaaaacaaaacaaaaaaaggtatgctgtggggtgttttttttcctctctgccattttgggaaataacccattaaaagaataaagcaccataatgattatttaggaacagacatgatttggaaactggtagaaaaataggtctttagttctggaattttaaggttaatggcccaaggatctctcagactctgaagctttataggacattttatttgaaatctgtgctcaagggaatatacttcaaatttccatgtctcaaaagctgtacaatggaaggaagctgttattttactcttggagtggtggttgggggatgcattaatgaaagacccaaatcataacctactaaccacagctaagtatgcagaaaataagaacatgccctagaaggcacccaaccttcatcaaacccagggcaagctttcatgagcagaatgacccagcaatctaatctcagcagccattttatcattaattgaaaatgctggttccaagctgactttgtgttgacagttttcatatcacactctttcttaagaatacacagtggctccctatgtcatgtgcatcagatagaaacagttcagttactgggcaaagccaacctctcactttccttctttaacaatccacctcctcccagcttcccccacagaaactctcccaaagattgtctgtctctaattacaagcacacagactgatctcaactcttgtgcttcccttgctagaaataacttctccctacaaaaccaggtacttcagcctccataacagttgggttcaaaatgtaccttattaagaaaatttccataactagcagggtcctggagagtaaagaaaaccacaagtgggatcagaaggcctgagccaaatggtcaaagttaagccacttaacagctgtgaaactacctgcaagttatttaacctctccaattatgtgcaaaaggcatcagcaagccgcttgatatcaaggaagctgctctagatacctgagctaagtctgtggcttctgattcccttttatagcccttgaaattctggaacaaggtccagaccctctctgtgctcaataaactctgtggatcaactgtctgtcttacccatcatcatgtgccctgagcaaacaggcttatctccacctccaccctgactcctgtgacacagtcctataccagtctccagttatacctttcctggtgacaattacagcccagagtgatccaaaatcttgccatttattttacatttccagtaggtgaatttgcaaggctatctatatatggagaccaagtgtttaggggcccagggattcccacatttaggggttactgactcatttcattagatcaatgcctctcaaatgctgatctgtcaaccagatctatcagcttcttggtgactctcccctgagattttgagtgtgtaggtgtgaaagtggccctagagtaggtattcagtgaaggaggaaaaaaagcttgctgggcgatgttaaaacagagtcaggttttaggaactgctgctgcaggtaatctaactattttaaacattgaggctcacggaccttgtttttaaagactgtgccttgagacagccagaaataacccagagaaccagaagttaaaataatcatctgtatcatttttataattatttcctctaatttccaactttaatttgacactgtccttctttacctgtcagtctatggggcacaacgttaagcctcttgggagttccaagctgggaattactgcatgctagaaaaggtccaatgctgttcactatctcttcttagcatgtccctgccaaggaataatcagaaaaggcttctttaaccttctccttcaagttttctcctttctccctcagggatgcctctctggggtccagggaagctttcatgcccgtaaagaccttggtgttgttggacatgaaaaccagcaggcacatatactaactttgtccctgaataagtatgtggtttctgtttggtttgttcgagaagctcttttttggatttgcacttcaacaccgtaagagatctgagaaacatcctaacatcctggcaaactgtcaggagaacaatcgtttgactggagaatgaggcctctcctttcccagaactatcctttgcattctctgagtttgagaataaatataataacaaccaaacaaccataaaagttagacccaagccttgacttcagatggctcaaggtgaggataataatctacaaatcaatccacagatcgtgcagaagggaggaaagatgttgtgctggttccctgatccctatctggggtcccagagttccatggaacattccagaagtaatttggctttgtgctcagtgcacagggactaatgtttttcaacaaaatttcataaggagatgtcgggataattttgggtcctgctctcaacagaagctgaaaattaggtgtggctaagaagacaggatcaggcttttttatgtgaccgctgttctgacaaagtacccaagcagtgaaaaattgtctgccttatcaccacagagaatttatgatggatttgtccaagaggagtcctgctcataaaagcctgcaaaacagatctattaaaacaaacctctaattatgaacagaacaagaatcccactgagataattttgcagctataatatcaagaaattcaataatcccaaagcccagtcacagaatcatccgacttgagaagatttgagtccgttaagggtgattactgggcacgcatgactgaccaccaaactaggtgagatgctgctgataaaagaaaaaagaacaggacaacagctttcaactcaagccatttaaaatatccaacaatggcttacaagataaaactgtttggcagcagaaagggggaacctattatcaagtatattttctggaccaaataccagaaatgtaagtaagatgacaggatgtgccagaggtcatgtaaatgtgggtgacctggtaaaggaatgtggaatgcctgacttccagccagcacttagctccttccactgtggaggaagtaaggaccaaggtcagaaggatgctctgcctgcccctcacagactctctccatgctcagcggagttattattagactcaagcatcacacatcactctaacattttcctcagagagaaatcttaggtttcttctacttcctcaattcttctggtcttggtcaggacattaatatttgttgaacagcatgtttttaaagtggaaagatatttcaaaaatcaaatattctggtttgtttcaaagaacatgttctcagctaaagcctgattctttcttcctgtgggggtgagccacagttggcaatgattcaccgaaatttccaccagctaacaataaaaaattatgtcccattctgaagaaacaaaagaaaaattgtagtgaagtcgtacatttcctttccagtccccaaagacaatctgaagaactgattcaacatgccgaattaagccctgagaatttatccatatctaataaggattagcaaatgttacaacactgaacatggcttggacataatttatattccaacttctaagccattgggtttagtatggtctcattccagccgtgacataggaggatacagagagcagtcatgctgtgtcctctgagaatccctgcatgacaagcaggagggctctttatgtgaaaaaaggtttctttacacaggaccagtacccacagaaccagaatgtgataactaagtctaaagaaccactgaggggagatgtgcagcttccctcaagcctaagaacattgttctagaagcagaaaacctagtgatagaacccactctgcctcttgccaaagctgggtgtccacctgcaacttggaaaatgttggaaacaattctaaattacatattgggagtgaggaagattaagactcctaaacttggggctagcagctctggttgggtctgctccattccatttttcatccatacttgccaaaagcacaaagaggcaactgggacatttgctcatactatctgctattaagataaatcagcaacacttaagtgtctggttcataaaaaataaacccccagagattgctcttcccccaccaatatatcaactttttgtttccctgccttagcaaggattgcatcagtagaaagctcaggaacacacaggcttttcctggaagccaaaccacatctcaagaagcctcagaagaccctggccccagcagaccccccagaagcctagacatgcaaacatcattgttggatgggtataaacacccctttcctggagggaaaaattctggaacccatcctgaactgggttctttcattcctttctttcctttctttccttctctccctccctctctccctccctctctctcctcccttctttccctccctccctccttcccttgcctccccacctcacctccccatcccctctcctcccctcttctctcccctcccccttcccctccccctcccatccccctcctcctcctcctccttcttcttcctcttcttcttcctcttcttcttcttcttcttcttcttcttcttcttcttcttcttcttcttcttcttcttcttcttcttcttcttcttcttcttcttcttcttcttcttctctctctctctctctctctctgtctatctctctgcccctccctccctccctctctttctttatgagacagggtctcactctgttgctcaagctgagtgcagtgacgcaaccatggctcactgcagccttgacctcccaggctcaagcaattctcctgcctcagtctcccgagtagctgagactacaggcacatgccactgcgtccagctaatttttgagtttttgtggaaatgaggtctcactatgttggccaggctggtctcaaactcctggactcaagcaatctttccgccttggcctcccaaagtgttgggattacaggtgtgagccaccgcacccagctaacagggttctttgaagacaatgtttgctcattctgttctatttgtttttcttcacagataaatgagtacctggctcccaaaaaagcagaagaggggaccctatgtttgaacactgccactcaagttctttcttccttggtcagtgaacaagtcatgtagatcctagtttatgttgagagattgtcaccagagatggtatgggaccaccattccttgaagcacagtgctaccctgtggggaagaataagatagccccatctttccacctcacaactaagatcagcatcttgtacatttctttaatccttaggggttttaaagaccttgccccagagaagatgcttcaagataatgcttctctgtgagttaggtaggaaacaatgtacccattttataggaaggtaagttgacctgctcagcatcatacaactagtgagtggaggtgagtcaatgagcaatctttggagctttccttcttcactgttgcctttgaaatctagaatcccccaatatttcctgatggggaaaatggcaattgtatcttgatgggaaagcaaatgggcagagtgctgcctttacgtgcagattagctgagtgtgtgtcctggcccaaccacttatcagctctgtgacttggtttccccatctgcaaagtgggcataatgatggtactgcctcttcaagtttttgtggggactataataaaacaaaggcacaacactgtgcctagtataccatttcttgaagaagtgttagctgtgttaatgttctactgaacaatgcatcttctctactcaactgtaggctctgcaaaagcgaatcctgccaattgcctgtgcatcctcaaaggccttgtcatagatcaagtacttaacgtactatgtgtgaatgcactggaataatctcagacaatcaaaactacaagggcttagaggtctgttagcttctctcttttactttacagatgggggaactgagcctgtgagagagaagcaaaatgagctgcccaaggtttctcagtgcattgggaccagagctgggctagaactcttgggtccattctcagaccctgaaccttctactgcctgccagggctcccctggggaggtgggttgccttgctttgtttaaacttttaacattacactttaaggtggcctttgcatcagacatctcagcgagcattagacccccaaaccaggaagactgacaacagaaactctgcctggctttgtgatccacatacctccttcctaccccagcaccctaagtggcttcatcacacccaaggtggcccagagccacctttctggttggcttctgagctgtgtttgtaattctaggagtgctgggccatgagaaagaggaaataagccagctgcaagataatcagttaattgtagtttctggggcgtaagaacagccttggatttagaccttctgagttgccattcttgtgggttttcactgttttctgggatgaccacctctctatctgatctaaagttatagtctttttgcccaattccattcccaggctgtgtcaaagatcatttgaatgaagattttttggttgtgcccaacggggtcatgtctcagtggctatatcagggcagagataagagaatggggttgggttgttgtatgcatattaaaaaaaaataataatgtcatctaaacactagtgttgtggggttctggctcccccaccttgtcaacttagcaactgcacgtggggagctggcccagaggaacagattccaactttcctggctgcagtttgtcctcactgaggtctcccctccatgcacagggcttccacatggctcaccccccacttggctggaaaactctagtgctttcccgggcagggtatctgtggaacaccctattcaaaatcagctccccaaatccctcatagagcatcatctttggtttttcccatagtatttattatcgtgcaacatgccctacatttgatgtctttattttgtttcttgtttcttcactggaatagttggggcagggaattgtctgttttgttcactgttgtgtctccggtgtccagatagtatctggaacgtagtacatgctcaacaaatatttgctggataaactgcctacttctttccatgcccacctaagttttgaaaatctctctctgcctcttgttgtctctgtttactgatcacttgcacttcctgtagtaggattctgccccaaatctatgagtggcatgttttcagaatgtagcctgaaaaatttaacacgaacagttgacatttatttaaatatttacgaatgtcaagtccactgtaggagacggccatttcttaatgctctaaaatcttaaaactacccacaagtctaataattcaactcttgggcattaatcctaaagaaaataacataaaaaataaaagacttatgtactaagatgttcatcacagtgtgattataaaagtgaaaagctagaaacaaatcaaaatccccaaaacagaatggtaaaattaatgactgcaaaatgatggaaatcataaaccaagaaatatgttttcgaaggcttttaaggacatgggaaaatgcacaaaatattaaatgtttaaaaggctaaacaaactttattatgtagtatgtcatgtctttgttcaaatatatatgtagacaatggaatgtaggaaactataaatcttagtgacagttatttctgagtagtgggattatgggtaactttagttttttatttacattttttgaagtttctattatgagcaaatattatttctatgataaaagatgtatctctatgctttcaactatggaaaagctcatttacatagaaagaatgctacaaaatcaaatccttattaccttttaatctagtgcattattaaggggtaacattgaaaaaaaacaataaacaagggagattctggaacttttagtgtgttgcagagaatcaaaagaagaaagtgacatcttccccaaaagaatataaagttgagaaagattaaaggcaaactactggaaattttaaattccaagtctgataaatgtcttcctgtaatcatgagaggagagggtgaaaaatccttttccttaattttcaggaaaaaaatcctgatactattatttgaaaaagctgaaaaagaagaagttctgaagccaggaaaggacagacctggtgtgcaccacaatggtgatcaatgacaaaatcaatatcactttaacacagcttttcaaggggcagtatgaagcaaaaaggaagtgaaaaggggcttttctttcattttgaaatccagcatcaggaggacacaagggcaggaagtgggatcttttttcaatgtatttgaaatgataaggtgaagacaggctgaaaggacttttaattatatgatgagaggaaggaacggagggagagagagaaagggaccaggaaaaacctggttttatatgttaaatgatgaaaaagaaaatgtaaaactaaagagaaaaaggctttccaacagataccttgagaatgaaacacaaaggctgcaggaggtaagtgccaacatttcttgcaagaaaaccaaaatgacagcacacttgattgagcctgcagccttctcccctagtggcaaccggtgatgtctggtgatgcaggaagagataagtcgcccttcccagcctgcacatggtggcctcaggtcatggcgggagccagcaggggccaggcgagaagggtcaggaggggtggggagtggttgctcagggtcacagaataaagccttctttattctgctttttagcctcaagtttacaggggctaagacctaactgaagtattgcaccaattcagggatagctcctgggaagagcatggaaaagcttcaatgtgagtcccatttgggctctggttccaccccttaccagctgtggcatctctgcatagttcctgaacccaagtttcctcatctgtaaaacagaattattaacatctggtttttagggttgtcatgaggattaaatgagataatatatttaaaatccctagcccaatgccaagtatacaataagagctcaaaaactgttggttcctcacattctaaaatgtgaatagaaaaacaatgatgaaaagcaaggtctctgcacacattatacccactcctaagcctcactgaagcaatgtcagtctaataactcccaaaatccacacagtctaacagctggattcctccccacaaagcctaatggctccctggtggccaacatcttgggaagtttctcctgtacacactctactttggtggtggatctgaatgttctctgaggcggtaatgaacaggttaaagttgaagggatttcaaacatgtctaatccaataagaggcttggtaaaacatgcgttatcacttaaagaataaatgtttaaaaatagagcacagatgtgaaatttgaataaaaagagagagagagcacagtgagagatcttcttggcatttgcatgctattccctgttttggtcaccttcagctaagcctgttattctgatatgctctgccaactgctcagtgctgtggggtgcttcaagttactgaagcaaagttggcaaatcactctgaaatttaaaaatcagagccacctccccctttatgcatttctaaaagccagggaacacaatggtaaagttgatcttttcaagtttttctaaactaatacttaaaaagcaaagagtgagtttctccactcctcctaaaactagcaatacttgtactgggatccttaaaaccctaagagaaagtatcatggttaaataggcatttgtcacaaaaggtgggctacagattgccaatcacagaattcatgggaatttctacttatgtagaaagcattctctgattcctccagcaggcaaaggtttttgaacttcagtaacatctctgcaacaaaaaaaaatagcactttgtcctattttatctttcatgagctagtatctatgatactgctagtagagatgataaaactccaaggcttaaggacaaaatcaacacctcctatagccaaagagtgcccataagtgctccatgcatgtttagggagatgaactaaaatatgtttaaaacagagctttcacccaaggaagacactcaagtgagagactcacacagttggccatcaggtcagcttgatgctctgggaagatgcccttctgatagggatttgaaaaatgcatgaaatcagagaaaatactttgcctccatattcactgagtgctattttttgttgcaagggcaaactgagtggattccctgagtactggggttgaggcaccagctgcctaggataaagaatgtttccaggctaagagagcagatgagtgtcttacccaattgcttggacattaagaggaaattgtttacagtaacactgagcagttcaggctttacctccataagaataacctgccagatctgagtatttctttttttattaaaaggggttctctagaatagactgtaaagacactttgcactgaagtcaaaaataaatagagatgtggctagattctaccggtgggacacaaacagcttaacccaaagtgggtctgctgtaaaaaccaatacatttgcattttagcaatttgatctggaccaagtctgtgatgcattacaatgctgggatcaaatcaagcttttctggaggtaatccaaacacaacaggaggctatgggaaccctactgcatggggttcctctactgctgtttaactgtgctaacctcctgaaccataaagggtaattaaaagtcatctgcacatgaagcactgaaagtgtaaatgggaagcacaaccgtggcttctagcagaggggagaagaaatgtctggctaaacactccactcaggtgcttcttactttcctggacaggacgggtctacctctgctgagatccaattttgactaggattccatccttgtaggtggctctcctgaacacattccagggcagcctctgccttctcccattttttaccacatctgcgactaatccttgtagactaatccttgtagacagtcctatgattttcggacaacacagggcagagaggctctacctaaatagattacattacatgcaacttgttatggcctccagaatgtttacctagacatgggacttttttttctgcaaaccccatgggagggggatcacagagaaccaggggactagtctcctggtcttaatgccttcctgctctagctgacctatgtgtttcctggtggccaaaagcaatgcccagaactggtaggaaaaggaaaagaaaaccaagtacaatttatctctgatctcaaaaatagtctaactagttctgagaaataagctggttctcattttaactaaacaataatgtctggccctcattttaaaaaggcatgttcatcaaggatgtgtgtatcactacttcagcacacaggggagcatttgagaatacggcttacggggtaagatttagttttaagctttcttcaaaaaccccttagtagcaggcaaatccagtgatttcagaattaattattttgatgtcagtccttttttcaagggtgaagaaaaagagttggggagattggctccaagacaccaaaaaaggaaaggtggtaattttcttatattttttagaactggcctccatagaaaaagaaccaaatcaaaatttaactgattcccaattgaggccctctctcaaaactgcacaaatctgcaagcaagattatttttaaaaagaagcgaagtaaaagtatcagaggtatgtgcctgtaaagaaacagaagtgaaaggaatacaaaagttggatagttttagatatctactctaccaaactagaatcaatcctttatctttttttaatgcaacaagtagcagaaagttaatttgtactgctcttttacctttataccatgctcagcctagaactaacccaaatgtcaacacctgaagagcatcacaaagattcttttattgttaagcacaattggaatttctgaactcatttcatatcacttttagctttattgacagatgtttaacaagagttaaaacatttctaggcaaattgatttatgagatactcaggagttttcagggatgaaatggacggattcccttcataacagcaagcaatctctgctacttctgagaactcagtgacattttactcaaaaagagcccaagaaattggaggagatttgaactagaagaaggtaaaaaaatttggaataaaagtccaaaattgccgccaccccaattagttcaaccatggagaaagtcactctgtaaaagtgtcttgcaatgtggcaagaaagggcgtggtgccattttgtggtcatcagttgacacacaggcctcatcttctctatcaagccctacagactggtggtggctgcctagaatattggggtgagaattatgaggctaagtcttacctacagggaacaaggatcatgattgatcaatgatgtttcttttcttgccatcatgatttattcattcattcatacattcaacaaatatttgctgaatgcctactagcattcagcaaatgtgctagcaattgtgttagcaaaagataacacaattatctcttagagatcaatgatgagcaaaaactcatgttaccatattctcagtccttatggagctcaaaaactagcaaggcagatagctattattaaaatcatcacaaaacaaatggaaaattatatctgttacaagtgctataaaatggataatacatgtgctcaaaaatgtcagcttggcagatttgacccaattgagcaagtcccagaaggcttccctggagaagtgatgttggactgagattgaatggatgagtaggcattaactaggtaaagaaaagagggaaaaacattccaggcaaagggaagggtacatgcaagatacagagcacattggtttgagtttgtatttatcctaacccctagaggagcctgggaagggttttcagcagtaaggactggggggtgatgagtgtaacctgagatttatctttagaaaggattatgtttctgcccactgaagtttgaaaacagctggcctggcctggaggccagatgtacttcttctcctaggcacaggcaacccccagtgcaggccaagagttggggaatggctactcttgtctacctgcatgcctcttgacagcaaggaaggtcaagacttgtactctgacggcgtgttgttgagactgccataaagtcacggagggtattttgtcatcagccctactcccacactacttaaaaatctcgtcaggtgtgacaggcaaattctggcatgagttctcttttgtggccccaacggaagcagcagtgtttcctaaaaaggcaagccaagcaccttgagactccatggaggctggagctaggggatgtggagagtgagctcactagggtagccttaaacaggccagtccatagtagtgatgaggggagccctccctgttctgaggctgcagagctagtgtattctgcttcctaactgcacagaagttctgcctcagaatacaccactcttagcagatcctgcacaggagtcctacagtctattccacccattcccactctgacaactcacttccttgcctccttgctcactctacgccagccatattgggctccttgctatcccccaaacacacacgtacacttctgcttcattccgtctgctggaaaatccttcccctagacatctaaatggctcattccctcaccaccttcaagtccttgctccaatgtctccttcccaatgacacccatcctgtctaccctattttaaattgtcaccagatccctgatcctaccctggaactcctgttttgccttatactagtctgtatttttcttcttttctaccatacaatttatgtattatgtccgttgtttattgcctttctccccctattaaaaagtaagcctgtctgggtgtggtggctcatgcctaacaatccccacaatttgggaggccaaggtgggaggattgcttgagtctcggagttcaagaccagcctgacctagcgagaccttgtctcttctaaaaaataataataaaacaagctaggcatggttgtgcacagctgtagtcccagctactggggaggctgaggtgggagtatcgctagagcccaggagttggagcttgcagtgagctatgatcgcgccactgcagtccagccagggtaatgcagtgagactctatcgcaaaaaaaaaaaaaaaaaaaaaaaaaaaattgtaagctacacaaggaagcggtctttatgtattttggtcactgatgtattccatgcctagcactgtaacacagagcaggcagtcaatgaatactcgttaagttgaattccaatgtggcaaacatagcacttggtctcaccaagctgcacactcctattaattcccatcaccctggacaggttgggagtcacaagctgaaccactggaactgggtttctctgatgacagctgtgaggtatgggggctgatcatggctcacaacattgctttagggagtcagtgttcagcctagccacaagcaaggtcttagcactcctgcagcaccagggccaacgctgcaccagatatgagtggtttgatggtgattaagtcatatagtctcttggactttggtttaatcaactcaaaaataagggtgatgctttccttattgggccagacaaaatatctgttatagatgattccccagcactgccagagagtctggcagagtaggtaggcaataagttggttgattataaggaaaaaatgagatgatgtttgtaaacttaggttaccataaagcatttggcatagagcctggaaagtggtaatcatgcattcattcatacaacaaatatttactgagcacctactatgtgcctggcaataactcagtcacttgtggtggtctgggaaggggagagattttctgtatacgttgagctcaaaaggctacctgggctaggcagtgtggctcacacccgtaatcccagcactttgggaggccgaggtgggaagactgcttgagcccaggagtttgagacctgcctaggcaatgtagtgaaaccccatttctacaaaaaaatacaaaaatgagctaggaaaggtggggcatgcctgctgaggtgggaggatcacttgagttcaggaggtagtggccgaagtgagctgtgattataccactgtactctagcctgggtgacagtgagaccatgtcttgaaaaaagaaggcagtctgaagagggtggcatctctcatgagccagtctgcctcaacatctgcacagaagactgagcaggccagaagggtggccttcccctttcattggcctggtccctgaaagagctctgctcttccaagtcagccatgcaggtcaagacaattgagatctgggactcacccttccaggactgccctccttcactgatatctatgtgtgctgcatatacaaaccaagtacatgcgcaagtacaggcgctatgggcctcttcagtgcaggctgggacctggggtccagggtttctgacatgtctgctcactgctccacaagtgctttggctttaggagaggaggaccaggaagcttaggtgtcaacatctatctgctctttctgccacagttgccacagctcaacaatgtgttctcaacatgtgcccagctgtttgcaaagcagtaatgatgaaatcaaaattaaactacctctgagggttggcagtgataatgtcaattagtagtagtagcaataatagtaacattaatagtaatagtagttgcaatagcagcttacacatatgaagcacctattatgtgccaggcatatgcaaagcacttggtttacctttcacctcacaataactctttgaattgttagcccaatttacagatgaggaaactgaggttgaagaaggtttagtatcttgcctgtaatcactcagataataaatgttagaaacaggattcaccttaaacagcttaactttggatgtcatcttttatgatcatttggcaaagggtctccttaagcattatggtatatccaactgtgaggctgagcaagatacccaacctctatgggcctctggcttcttctctataagagtatcaaaccctcagtcttgttgggaggtgatgagttgatgtatgtaaagcccttatacccatgcctagtacatgatgagagctcaaaagtattagtaattgttgttgatgtgatcaaataacctaagcctaaggactccaggcagaacccactgtttatgaacagctggagaacattcttaaatggtttttttggcatctactttacgtttatgaagataaggaggcctcacaatttctgggaataccattctgcttgacactctgaatttctccctgaacctgatggggtatgtgtggaatccggtagactatctaaagcctgaaccccatcacttacaagctgtgagtcgttggactggttattccacaccctgagcctcagttatgctccctagaaaagggagataatcctgcacacactcacatggttgctgtgaggactatgggacaacatctctgagggacactggatacaagacccagcatggagtaaatgctcaataacagggggttattttgatagcacattaatcattgttcttagagtcattatcattggcaataaggatactgaaattcaggtgatttttcctgctctttggtgggtggggtgaggaaggatatcagacctaaatcacgaaggagcccatcctcttccttcactgcatccttctccacaacagccctttggacactgccttagcacatacaggagctgaactctgcgtagctgaggtttcccaaatgtaccccatgacaccaaaaaccaagctcgtcgtaaagaataaaggcttcgtgcaggttcccaggaacaaactgaaggactatgctcaatccttactggaatcaagaagtgaattttcatgatgctgggaaagaaaaaaggtagccttaaaaattccttactgggaaaagtagatggggacatgaggagcaaagtatctaagagaaagaaaggaaaaattatccattctgcctggtaagaaggcttctggcagcctttgctctgcagctccaccaagctaattctgcaagagctgaccctatcaggtggccaaagtctggaaccattggtatatacacaataaatgaaatgacactgcaaatcatgatctaatgctatcatctatggtctcagtttttatggccatagagtactggaaatcatcaaaagaggtgaaggtcaaggttggatgagctcttatgcacccccacccccaatgacgggggcaagtgtctccttagcagctgactgacctgagacctttggatcatgtatgcatcgtagctggaccagtggtacttggccgtaatatctggactgtggccagcaccacaagtgcatggtatattcgagctcaagggctgtttcttaggtctataaacctgtgggagaaagctacaatggttaggtgcaggagaggagggtgcagggaaggaattagggaaaagcaaagaaagacgctcattttgactttctgtggccaagtaggtggaaaatccagtgtaaaagatgcacagctccaaacaaagaggtcaggtgtaagcaatctctgacccctgaggccagcgttagcaaggcatgccactctgtggaatgaccccagtgtctggcagtgactgggaccctccctctacaaggagagagtgttcagacacagtagtggtctgtctctctgtctctctttctctctctctctctcattctctctgtctctcattctctctctctctcacacacacacacacacacacattctctgtctctctctctctctcattctctctgtctctcattctttctctctctctcacacacacacacacacacacacacacacacacacacacacacattctctgtctctctcactgtctctgaacaaggcagccccatgagaaatgaactctggtgcagggtcaatgtatgccttttccttcctgaggggtaaaagggttagtcacattgtaagtggagggaacttattccttcaggcttcccttccactcaccttgcccatggtgcttggcacagatcactctagcaggcagagagcctgccccaggggctgagtcaatatggacacactccacatggttactgtgtggccattagagagcttcagagccacataaggccctaggtaaaatgtggtagccactctgcaaggccataaaccattgagctgactgagtttcataatgaactcgaatcttagtgaatatcttcaatcattgcttacaagagtcaccaagtaatatgaggaggagaaatatcatctgaaaatttcatggatgattttccaatatacttcaggtgtaattatttccatttaagccacttccagaaaaccttccagagagcaaggaattttctgcacaagttagaactatgcccctgcttccatgtccctcaaaacaaatacagtggcctagaggggtgaaaacacaggataacggggcaaacaggtgattttttaaaaatagagtgaagaatggctgggtggtctctaagcatagtctggcagtgctagaacctgggagatgctccttggctgaaaggtattggaggaaatagtcaaagaactaaagttgaaagaatagggaatgaaacctaaaaacctggatgagggcaattctttacagggaccagaaaatgagcaagacggaaggtaacaggtccaacaggaaagaattttgcccagaatttaaattataagtttctagaatttaatcagaagtcaaacaaagtccactggaggaaagaaagttgagagctatttctggggagatgacgctgacacaaaagaaaggaaaacagcactggttgcaaaccacacaagcccagccacatgcacataaacacagaaaagcagtaaaatggtgttgcagcgacaactgggtccattgcactcctacctggttttaggagcttgagcccacaggatggacatgggaaaatgaagagtggctaaaatccagagaaagcccccaaagccccaaacccagaaaaacacacctgtcttgcaggaggccccacctgctgctttaattgatgtactagtcggtctttttcccgcttgagggccatgacttcttcctgcgtctttttctttttggaggcagacaattccagcaaggcaatgtttgcatctttttcactgatggctgcaagtagtgcttcctgtctggtaaaataaagattattgagatcatttttgtaaaataaaaaaaaaaacaaacaattggcatttatagttgaaatgaaccacagagtattgtctcaatggaaagaaattatgaatactacttaaaacaaactagctctttggctttcagaatggacaaagtagtttgggtcagaatccctgagactgcacactgcagccactgagagaggaatcttttaatggcttcacatgttataaatgggaagggacaaatctgagcattcattgctgacacatttatccacccatccaaccaaacatacatatattcatctatccatccatcaatttgccaagagtcttagtctgttttatgttgttacaaagtaatgtctgagactgcataatttataaagaaaagatgtttatttggctcatgattctggagattgggaagtttaagggcatggtggtagcttccagcaagggcttttgtactaacatggcaagaaaagtagaaggacaagtgagcaagtgtgaaagagaccaaagtagaaggacaagtgagcaagcgtgaaagagaccacaagatcaagcaaagcttccttttataacaacctgctctctcaagaactaatttactcctgagacaagataattagtccatttgtgagggctccaccctcatgatcctcatgatctaagcaccccttaatgcccctgccttttaatactgttatattggtaattaagtttccatcatatgaacttttgggggatacattcaaactatagcaccaagtaagcttctagatactctgcgaaaacccccccaaaactgggtagcaatttcacctattacttttttaatgcaagattttcttttgaaggcaggcagagaaatttactggaaaccctgttctattttcaatgcatttagtgatgctcctttgccatcccaccaaaaacgattacttcctcagccttccttatttcagtaattacactaccatccactaagtagtgcaaaccctgaacttagaagtcatccctgagttctttccttctttctctatccagagccaatccactgacaacttcagtaggttttacttgaaagtatgccccttatctaaactcatgcactactataaaaacatctacgaaccatcagcatcactcactggggaccactacaaaagcttactcattgatctctctggtaaagagagtaaagtcatctttcaaaacattataagcccagattccaccattctattgtgtaaagatccattgcatcactctttagacttgaaatccagaccttttattgatgcttgcaacacattacgctaatcagccatgacaacctctctgagggcctctgttcctcttctccttcctcaatcattaggctccagcacatttcgttccaggtctctgctagtcctcaaaaatgttacccttgtcccctcacatcacaggctttgcctttctatgcttttgcctcacacagctcttatcttccaggtctgtgactgaccactgacttagaccacctcatgtccaagtcggtcatctgtcacattacactacttcattttttttatagaactctttgccatttgatagcatcttatttattatttgctttctagacttgacgctccatgaaattgggacctcatcgatcttgtgcaccaccaattctcaagcttctagaagatccctcagcacatagcgagtgctcaaaaatgttagttcaaggaagaggtaagttcattttttactttttacagacttttaaagatatcaccagacacctcttcctctcatttaaaaaaaattagaatgctttgcttcctgcttaacctacagtcatcgcttattcaaaaagttttaaagttgcctccttcaatctttacagtataattttatgaccacatctgtcacaaattttaacctggaattttctgggatgatttttgcgtaggaaatagctctcctgggtgtgtttcactgaatcttcctttccactgggaaagtcttatctccaccatttgtgtctcttctgaaacattctagacactttggaagaccccacagccccaaggaagcctccacattgggaacttccctcgcacacaaggcccaggactaaaacctggtcatgatcctgttttgcctttctttaatctccatcaccagaccaggccctctccagatgtttggacaaggtggtcattatttggatctcagattattccccttttcactgcagggatttatatggagttttctgggccccactaatgcctggtagtaggagcttctgtttgaagctcacgcagatgtgtgagcagcagaacatgtcaggaaatatctccattttccagaagaaaagcagtgcaggctggactaccggcagcagcattaatatccagcttcacagagcctgtctgcctttggataacagctgagacaatagacatgcttgcggctcccagccagtgcatatttatacagagggcgaagctgaagaggctatacagactttaaatcggggagagcctatttgctatctgctattccaaactttagctacaacacacaaggtgactgcaatattttatcccctctgttgcaaactgaaatatctaagtgaagcttttttaatgaaaacaaactaaaggaccgatattaggaaaattggggattggaggtaaattgactacacctctacaacggcatctttacagacatatgcaggtatttaaaatgctgattaaaaaaccttagtgatgtgaaaatatttatgtttgttgagaaacaattctctatgagtctctcatgtttctgtacattttacaagcacaggcactattttcttttatgacaaactttcaaggccgtttgtatagtgactagctttgaaagacagaggtggtatttctttttggatcaaagggaagacacgcttactgccccatataatagtgtctccttccagagcaaaaggcaggcatgttactgcccattataaaatattcagattctctaatctcagggttgccctcctataatacaaatgactacatgtatgtgttcatccagtccatccgactggcctccatgggacttggagctaggaaaattgacacaaatatactaattcttcactctgtgccatgagcaataaagtcctttatctttggcccagaagtctcttgtcatctgcctgcatccatggaactgaggcaggctaacttgttaggatgccagtagggaagatctcagacccttcatagttttcgacatacaaatgtatatatatccaagataatccctaaaacataaagctatactcataggaaaaaacaaggacaggaaggaagtataccaaaatgataataatcaccatttcaaggtgacaggatgaataagacattttttaacttttttctgcttatacttttaagcattattcttagaaaatatcctaagagtaaacatttaaaacttgtaagttaagctttcggtcatcaagtaaacagcaggtacatggttcaaaatcttagcaggtatataatttgctcattttcccacccaggctatctataatatgttctgtctgtccttccattcttcatgcacagataggcacacacacatattttcacacacacacaatgtctgatacaatctacatcatctaccacttggaaaactgtagtagtctccgaaccagactccctgtgtctactttcagcctgctttaacccattttccttttctacgtcaaaatttgagattatatagctttaatcactgtcaaaagtcatcatcaaccaaaaaacaatcattttttaaaattattttactttaagttctggtgcacatgtgcagaatgtgcaggtttgttacatagatatatacatgccatggtggtttgctgcacccattaacccatcatctacattaggtatttccctaatgctctccctccactagcccaccaacccctgacaggccccagtgtgtgatgttcccctccctgtgtccatgtgttctcattgttcaactcccacctatgagtgagaacatgcagtgtttggttttctgttcttgtgttagtttgctgagaatgatggtttccagcttcatccatgtccctgcaaaggacatgagctcatcttttttatggctgcatactattccatggtgtatatgtgccacattttctttatccagtctatcattgatgggcatttgggttggtcccaagtctttgctattgtgaatagtgccgcaataaacatacatgtgcatgtgtctttattgtagaatgatttataatcctttgggtatatacccagtaatgggattgctgggtcaaatggtatttctggttctagatccttgaggaatcgccacaccgtcttccacaatggttgaactaatttacactcccaccaacagtgcaaaagccttcctatttctccacatcctctccagcatctgttgtttcctgactttttaatgatcgccattctaactggtgtgagatagtacgtcattgtggttttgatttgcatttctctgatgaccagtgatgatgagcttttttgaatatgtttgttggctgcataaatgtctgcttttgagaagtgtctgttcatatcctttgcccactttttgtggggttgttttttttcttgtaaatttatttaagttctttgtagaatctggatattagtcctttgtcaggtgggtagattgcaaaaattttctcccattctgtaggttgcctgttcactctgacgatagtttcttttgctgtgcaaaagctctttagtttaattagatcccatttgtcaattttggcttttgttgccattgcttttggtgttttcgttatgaagtctttgctcatgcctatgtccttaatggtattgcctaggttttcttctagagtttttatggttttaggtcttacatttcagtctttaatccatcttgaattaatttttgtacaaggtgtaaggaaggggttcagtttcagtttcctgcatgtggctagccaggcttcccaacaccatttgttaaatagggaatcctttccccattgcttgtttttgtgtatgattctaaaatttaggcttttaagctttaacacttatttatcctctcataataccataaaaaatcccaatgaattaatttctaattctcactttactgtcagagaaaaacatatatcaatttctaattctctataaatgtcattaaatacagttccaagtcaaattagccttaattatcaaatctcaaagtacatttaaaatctttttaataaaattacatttaaagccactcaccaaccttaaattaatattcatataaaataatctagtttgctctttgtaaccttctccttattgtatttttgttttattttgttttgcttttggctaacaaatctatttttatagatattggcattatataatcatagaactctaaataaaattagtgtaactaagattatctatattttgaaaccctcatttaaatactggccataaactaatgatattttccccaaaaataccttgattgagatctacattcaataattctagtccatttaaatcaaagggtcattagtataagataaaaaggtatataaaactagagaaataagaacatttcatacttcaggatatttggcaaggtattctgaatatgttaaggcttatctggctattacctatttgtatagatttggcaggcctagaattaaactaaatcttaattccaggctaacagagccattgaatttggtttttgaagcaagaagtttttaaaactgagttaaaatacctctttcttaagctaatagaatttagctaagacaggttgaacatcccaaatccaaaaaccccaaatccaaagtactccaaaatcctagatgctttgagcaccaacaggacattcaaagacaatgctcattgcagcgttctggatttttggatttgagacactcagttggtaagtgtaatacaaatattccaaaatctgaaaaaaatatgaaatctgaaatacttctggtcccaagcattccagatgagggatactcaacctgtaatttaaatcactgtgagctaattatgtatagttatgggttttcattatccctgccttaaaggtcagatttgttttgaggatgggtatactgaatataattttataaaaacgaatttcattttgctatccctacgtcagattctacactttcacagttcccatgagccaatttgctgatacattggcagaaatcacctaccaagaaaatcacattgaaatagattaggaagcttacattaaatatccttgcttttttttttctcgcggcaaattttggtccagccattgaaaaactggaaaaactaaaataccaccagttctgatgcaccacttttttttaaaggctcaagtttaaagagtataccagtgacaagacacttggatataaaccggaaacagaaaaatcattattttccccaatgaaagcattaccttctagaatcaagaccagatttatattgcttcagaaattattactgtcccatcaacctgaagagagttccataagcctgaaatcatgttcaatctatcccttttgcctttttacagacaacacggaaagtacatatatgcccattcttagacagttagtaggtttaagtatataccaaaggcttgcaaaattatcttgagaacattgccatcctcaagtaccaattactaaggtgatctgtctatgccccaaaatgtagcttaaaatatgaaaaggaagcccacatatactaggaaggaagataagataatgtgaagagaaataaatctataaaagtctgctgaatgccaagctaagaaagtgtatcatagacagcattttatcaacgtgcagcctaaacaaatgtcaaggggaataatttctttaacaaatatgggcaacaatagaggaaaaaagggggaaattctgtgccctgtcatacatttagtcaggattaacagtggataaaaatatgtgcaagaacacatttaataaccctaaactgtcattcagtgtgtaggaggtagtcaagatacagctaataaaacaccaaaaaaaatggttttagccaccctgaaaaaaaaaaaaacaaaaccttccatggaataaaacaaaacagggctgaagggcatctcctgccaagataaatgccttcttttgagtgtcgcctgtggctagccctcacaaagagagttccaggatcctctgatggtaatacatggctacctcacttatcacagtccatttaaaagggagctttgtaaacatttctacttcactccccattgctgtcgttctattaatgatgatttgagctctgaaagaggatctaaaattaatttcaggagttgcaaatgaggcaggccaattaggaactattacaaattggatttgggaagaagcattaacacattgtttcttgtgggttcttgttttagttagctgacccatctttaggaatgcattcaattacaaaagcagatgcttaaaaaatgcattccattaagaatgtttggataatgacatataagagaaagcctacattatgtatggtgcttagcccaggcagtcatgttctaatcatattgtggggggaaaaagtccgctcaatcaacttttctcagctaattactattttctttccctcatgaccctgaatattcaactgtaagttcagtaggaggtgacttcagacagatggtgacgaaagatcctattcaaaacagcctctctctcacccttggggtgagggttgggtggagatagatgttcatttgcctaaattttaaaagctgtgttttcaaatggcatcttgagaaagaaaagttctttgatatcaattaatatcaaccctacccaccagcagaatgatgtatgatatatgcagaaggggccatgcagaaagcaaagcagctcacatgaggtggggcccacagggtgagatatatttgaacaagcatgagtttcagtaaggacaaagaacagaccagattcgtaaaggccaggctttggcagcccagacttcttaatgtggtttgctccctgttgcccacctaaaactgacctcaaaaaaatagtttactccaattacggagaattctgtctttgaaacctaatagcacatgactggaatttcctaacacgggggccatggagtcttgtggaagttctttactctaagcaccagcttctaccctgttccttgctcagtgcatgagccagggaggtggctggcccatccggcggttcctccagtttctccaactggaccagaacactctcaagtgccaacgtcatgtgcttcagggcactaagagggcaaatgccagcatcatttggcatcctgctacaaatcagtaagtctgaagccaactgattttcccacatagaaaaggtccaaggccagaggaggagtgccaggaagagctattccccctattctaaatgtttctcttgaatcctgtccttctagagaattgataaaaaggcaatgaaggatgggagggaccattgtcccaggtcttggcagtggacatgtgtgaggcattgctcattactatgtgcctgatccaccaaaaaaaaaaaaaaaaaaaagaaacaagaaaaaaagaaaatacttcttttgagcactttagcctattatgattttttaaaaaacatacccacacaaatgaaatattactcaagtttttaagaggaggaggtactgatctttatttagtgctggggctttggaagcaaatgtacctgagtttgaatctcagggataaccttttgactgtggccctgggtaagttactcactgtctctgaaacttcaagttcctcataaataacctaagatggacaatcataactctctcttggattgaggtaggagaatatggtggaggcagggaaccgaaggccatttcactccaacttcctagaactaaattaaaaggaaaaccctaattttccatgcctaagtaacaaaaggaccaaaggttactccgtttgcaaactcccaccttttctgcatggcagatgggaagttggctgtctgcaaccaatcagactgattgccagcccagtcttcatttgcatagaagtgcaactttgtggccaggcatggtggatcatgcctgtaatcccagcactttgggaggccgaggtgggtgtatcacctgaggtcaggagttcgagaccaacctggccaacatggtgaaaccccatctctactaaaaatacaaaaaattagctgggcgtggtagcggacacctgtaatctcagctactcaggaggctgacacaggagaatcactggaacccagcagggggaggttgcagtgagaggaggttgagatcacaccactgcactccagcctgggcaacaagagggaaactccatctcaaaaacaaaaacaaatatgaaaaaaacaaaaagcaaaacaaacaaacaaaaagaagtgcaactttgtaacttcaccttagcctctgattggttgcaaccaatcagatgtttgcacaggaatgtgacctttgtaacttcacttcaggctctgattggttgctttcagaccgattgcgggccaccgcttcatttacatgaggtgagcaccaagtggtcaatgggaaacttctaggaggtatttgaacctgagaagattctgtatccaggccctgtagccactgcttgggcctgctcccaccctgtggagtgtactttcattttcaataaatccctgctttcattcttttgttgctttattctttccttgctttgctttgtgttttgtccaattctttgttcaaaactccaagaacctggacaacttgcagtcaagaccctctaccggtaaccggatcatcgtgagaattaagggatcacgcatgtaaagattttgttcagtgcctgagatgaccacacaagaaatgctagcatttgcttattaaatgacacagaccccaccaaagttaaagattcaaaggttttgcattactttctatgagctcccctttatagtgaatatatctaaacatgctcactggtctcttactttcaagacaaactttcagagaggcctttaaaattggtttctgttaagctgcacatttgactttcatgagttgacatctgctccataaacagacataaagaagaaaacagactttggagaggagtctgctgaccacagaagagttgcatcccagacaagccaggcttgacttggtctataactgtccaatatcattccatccaaattgataggaaaggccacgtgggaaataggcaagacatgatgtcacatagtttaagaaactgagaaatggaaatgtgttctgaaaggcgacttttaaaaagtcaaagtcaagtgcaaaatcaaacaaattcaaaataaaagattcttccattggaaaaaaatattttaaaaaattggtaaatctaggaagcagggagggtgagtgaaatgaagggacttccatgacatactgcaataccctctgttagtggtaatgttagatgatggtgcttggtcattcttgttattcccgttcagtaataagaaagcctctctgttgaccattcaattctgccaaggtagctttctatgtgaaatacacctaaccagaatctctggcaggttatagatgagtgataatgagaaaaccaaatacatctggacttcactgcaggacagagctttgtccagtatctgcctaaactaaacctattgtccatgggtgatcagttactgtcaagagactgtcgtattgcattaactttttggttggaaatgagtaactaccagaaaataggtcactgacatcaaggcttagcccccatagcatccaatcaattatttttttcttattggtgaagtgaggttatgtgtgtgtatatatgtaagtctctctaaaaacaatatgttttaatttcgcctctattgtatatttaaagctgctaatatttatttctcagtctttgcacagagcagcaaattgtccgcctacatcttgaactacatatttcccttcttaatttgaatattttgtgttaaatcaaaccttccattgtttatgtttacatggaatagaacattcccacaggctaaattgtaatacaaaacaaaacagatcgtcatgccattgctgtgagaagaatatgtgcagaagggggcacattctggaattctgttagcgcaacattcaaataaaattgaattaaggttctgtggagtggatttttttttttaaatgaagtcttgctctgtcacccaggctggagtgcagtggcatcatctcggctcactgcatcctctgcctcccgggttcaagcgattctcctgcctcagcctcccgagtagctgagattacaggcatgcaccaccatgcccagttaatttttgtagttttagtagagacggggtttcaccatgttatccaggctggtctcgaactcccgacctcaggtgatccgcccacctcaggtgatcggcctcccaaagtgctgagattacaggcatgagccactgcacccagcctggagtggatctttgtagagagaaaaacataaaagtgagtttattggaggcagctcctttgagagagttttaattcatgagaagggaaaaggcagttgtgcttctgcaaaggagaaggaaacacagggtggcatgtctgtgtgtgctgcaggtgatggtggtagccaggcaaagggcaggtttctgcgaggggcaggaaggtctgatcccttctgggagaggggctaaacagattcccatctgtttatcaaagctgttgattcaatgttaatcaaagctgttctcccttgttgtgcctgccacagagctggacagcaattcaagacaacctagaggagacattttgggagggtgaaggaaactgatggcttttaaggcatcctcaaagatgctcaaagatgcaattcttcatgtaaatgtctaaattactttgtgaagtctggattttaggtctgccatcttgtggccattgcaataaatattgcccttttcaatttttttctgtagttacatctctaataatctatattcagaaaaggtaccagaaagaatgcttatttaaaaaaataaacattacacatgggagagagatccatgattcagggggagctaggacatttcatattcaaatccccattctgctgacatttttcattctttgactaaagtctagtttcaaataattagctatcaaattatcatttaatacaggattgggactactaagaagtcagttaagaggtgacagggaagttttaggtgcctgttttttttttaaagaggtcatttaatggacacagagtttcttccaaatgaatgacagtctcagcatttctgtacttgccatacatttgctaagagaacacccagaataaaatagattgtcaaaccaaagggggcttcatacctgaaaactaagggaaattgcttttctggaaataactgaaagtccaaatgagtgagattagaaatactttattccacgccgtaaggaaaagaaatgagacaaaatttataatagttctgtgttgggaagaaatggttaaaacgccactatgaaaacacactaagcctatctaatgcacactcattaatcatgatcttgttgattgtgtcaacagaacagaaagcaaatacatgtggccattgcctttgcaaagtttcaccaatgcatcacagccttcaaatgaagaggaggcacaagagcatactcaatgaccacaaattaatttcagagcccaagttacagaagtatagaactatgcgtctacatacatacacctgaagccttgcactgctaagcaacggttcaaaagacaggccaaacaaagagctgcaagactcagcttatgtattcctaaattataaaaagttatatttgttagttacctgaaatttctggactcatgaatacaatttgtgggatgctactggagtgctccttcccagagtttgaaggaacctgaaaccagacagcagctgcagaaggaaagggtctggtaaactacctggaggagctccacatctggaaagaatcgcaagggagccagcccaagaaacaatggtatagaaagcagtctcagatttacaggatgggtggccttgtggctcacagaagtgaaatttccaccctgggaggagcgattactggaagcaggaacatttcagatatgaaattatgaactccaacctgaagcagctaaactgaatatgttcctctagggtggctatttactggccacataagcaaaaataaaccatccaggtggtcagaggcagttcatcaatttctccaactcattcaccacatatttactgagtgaccactgtgtaccacgtaccagggatgaatggggacaagcaagacagaaaccatccctgcttctctaacagcagaactcagagactgctaccacagcagaacccagagattgctaccacagcagaacccagagattgtccacagtcatgagacagacagaccctgtgatgatgccaccagacacaaagaaacacccttctattaccatcatgagcaaatgctggatcatcagcaataccgtgcaaagaagatatccctgaatcctgtttcccaattcaaatgctgggcaaagaatccatgtggcatttccctctgcatgtatcaaatactaggataatcaattcaaaagctccctcccagcccatcctcttcatcccgaatgcctagtataatccagttgcaatcagaagctcaaaataaacaaataaacagaaacatgaaacctcatagtcatagctactaggccgaataatacgaagttcaagttcacttttttatgggtcagaaacaattgaatatcagaaattttgtatggttcaacccaatagtcttccaaaatacaaggagttttattggtttctttgtttgcttacaacacatgcccatagatcattttaaatctttataattttatatcctcagagatgtaaaaggttgaggtaattccctctccacaatattcaacatacacccaagactgaccactagaggtaattaacccagtctgcagaaggccttttgcacaaattggaggtgggggaaggaggcctaggaacccagagaagtgacagaactcagtcctgtaaaagaggcccccaggcctggaaaaccacttagtgagaaaacatcctggtgaccagactccaacctgacactgactaccactccctgcaataccgatctgttgaatgctgagatcagaccatctatctccctggacaaccttgaggcttcccagctccactgaccaacaacaaagcacccctgcttagatttgaacttcaaggcatgggacataaggcaggggtcaaggaagaatggggctggagaacccttaaggtgagaggtgaggccagctggacttcctgggttgagtggggacttggggaacttttctgacaagaggattgtaaaaagcaccaatcaggaacttttctgtctcacaagaggattgtaaaatgcaccaatcagtgctctgtaaaatgcaccaatcagcgctctataaaacgcaccaatcagtgctctgtgaaacacaccaatcagcaggattctaaaagtagccaattgcagggaggattgaaaaacgggcactccgataggacagaaacagaacatgggcggggacaataagggaataaaatctggccaccccagccagcagcggcaacccacttgggtccccttccacgctgtggaagctttgtcccttcactcttcacaataaaccttgctactgcccactctttggatcagtgccatctttaagagttgtaacactcactgcgaaggtctacgacttcattcttgaagtcggtgagaccacgaacccaccagcaggagccaactccggacacaaagggattcaagatcccattgaagaggggcataatgaaaagatatctttaaggatgactgcatacctataggtggtggcttaaaagagcagtctaatgttgttaaccagtgtcttaatttctaccattttcaaagagaatttactatggacagaatacgatgctacgtgttatgaaggatcagcaatgggtaaggcttgcaaactgatctggtaaagaaaaagacttaaattatataaagacttaaataataaaataaaagataaataatagtttattaacatcttcattgttaagatacaggataagaaattgttaataattattattttgattactatatgtataagcaaggcataagtaaagtacgttgtttcatttagtctgctcaaaatagccttccaagagaaagttttattacaccccttgtaaagttgagtaaactgagactgtaatatttaaggttgtccaaggtcccattgcttttaaaaggagaactggaatttgtatccaagtctgtgatgttaaagactaaacttggccctttcaattcttggttgcaggaaggaagaaatgtccctttggtccgggatgatgggggcaggcttcacagaggataagggtgacagctgagtatgaagggagggtaggaatggaagggctctggaaggaaaagagtggcttccagatggggtaagtgtctgattgagagttgagatgattcagtcgattaaaattctcttttgcttacttatgcctgttcctagttgcataactttcaaggatgctagaataccaccaccaaggaagaaatgtggtcaaataaagaatgccttaagtgccaacggaaagactggtttggccagtgctgacgttttcacgcatgcccgcatgcacacatgaggatgtaggaacattatgtgtaagttgttttctggggaacagcagctttttattgtgacattcagtaatgtcctttctaatgtttggaattaaaatgaccctttctcaaatgatgatgataatagttaacacttgaatagtcttatttaatagcttaattaggttagcaagcatatgttgttggcaaaaaatattttttcctatgattggtccatgacttccacggtctggaaaacattcacgtgattgctgcatgttactatcagggtatgtgtgaggaacatcctcttctgttctgcataggtaagggctttccttgtgaaaagtgtttggcacttccaagctggctgccttataaatgccatgttgaacccaaattgtttgtactgagtgaccgtccctttgccaatgtctgtttccaatatggtatctttaggatataagtggagaataatctctttatttcacaaataggccccatcagacaagagctcgagctccaggtccttctaggggtcttcagtgaccacagaaggaaagaaaagctgagttggtcaatgccaatctttaggaaaattatttctaaaggtggcaagaagggcctagtgtaaaatatgacatactctgcctctctttcgtttgttcattttgttggattttagcacaatatgtatatatatattggtggaatatgaatgtgggagtaatcagcaacagagaagacttgggaacatggtagttatcccttcaattatctgctagagtaacatagatgaggcttgctccaggggcaccctaagatttgaactaggacttaaggatgaaagtcacaagtaggtaaggctgaggccaagttagtaacaggagcaactctggctaagtcagagctgtcagcaatggcctgggctccctcatacccatctctgacagtgttggtacaaacaacagaaggcaatgtcgagaaaatcccagggaaataattctaacaatggaggaatgatgtgactaaacacatgctttggttgggtttatttggattgcaagcaaaagaaactaattctggctaacttagcaaaaagaggaagtgttagagggatacttgaataaactgaggaaaagaaaagagctaacaagtgagctttaggagggtcagtgagaaagttgctccagtaccctcagtagcaggaaatcctaaacctttcttcagaagacctactgtttacagaataactttgttacaacctccaggcttaatggaaaaagagtaatgtttgaccttcctggaaagaaaatctgttagccccacctaggtcaatcagttatggcctgatttccccatcactagaaacacaccctaaataatgggatcacaccaaaagaaaaagggacagctatgagctgagggtcatcctaattggcagctctctaatgatcttacagctaaggggtctatttctatggtgtgctggagctggctgctagctagcgagagtcaattatgtgcatctccttccaactgacaagggtcagcctgtaccttggccatggtagaagtatttacacgatggaaattggcaatcactaccaatcagggattttgttttttctattgacctggtttaccagcgctctattggcctgtttcaagataattgaacagttttgccaagactgctgaacaagggacaggccatagagcctacaataggaaatacatagctaacacacaccagcacattttctgtgccaaagactataccattctaagtcctttatgtgtactaactcatttgagctgcacaacaatctaatgaggaaggtgccattatgttcccatttgacagataagaaaagagaggcagaaaggagtgaattaacttactcaagtttacatggctagtagatggcaaagtagagattcgaacccgggtatttataattttatgtctcaaaataaaatagattatgtctagcattgttctaagttgagatactcttgacacagaaaaaacagattcactttgaatcaagtgagaagttggctgaattccgataagaggaccaccccctcagtcacaatgctgccgtcagtaagagcagccgaccgcagctctacaactggtgctcggatgtttatttcatttgattgtatatttatttcatttctagggatgcccaaggactgaagccaaatcacaaagttgctaaccaagtccatggggaagagagagactcacaatgcacactgctggaactccccaagtgggtgacagcaatacttcagaactcggtgggcagagcagatcacatggttgctcctggatgggctgtgatttctcaattccagtgagaaaggggagagaagtctgaaccttcaacatacttccccccaatcccactgccaatactataaggcatagaaaacagaaaacaggggtaacatagaaagacagtcatccaattttatatatgtgcctttgacaagtcacttgactttacgtatcttagctgtgggaatctataaaataaaaatgatattacctacccccgaggtcactaagaggttcacagaagatcccccacaggaaagcatctggaaaactgcaaaaccccacaggaatggtgggcattactatcaggggcatccctactcacaaagctgtggccccctgggacccaaatggtgatggtgcaattggattcatttgaaacactagctggtatggacacaccatgtgctaggcactgcttctattgactaagccaaactcatcaagttggtgtaaaatcaccagtccgaatggctaatgggaatttcactggggcaaacataaattcacgaacggaaaacgactatctggaggaggcacaaaagagttttccttttccagtggttcattgagagatctgacaataatccattggcaagaaagagaatggctgcttctaaataaacttaaacaatgatcagtttttctaaatgcaccaaacttgcaattaatatttgttgaatcaatgaatgggattccacaaatctgggtttaaattctggttctgcaccactgccattggtgtgattttgggaaagctaattaactctttgaatctcagtttcttcatctgtaaaatgagaatcctaatacacttatgaggtattatataagataaatatgtaaaccatttagcacatttagttggttgtataacaagcagttattattattataaatgcaagctatagttattttttaccattactatgagtgtggttcattaagttattatcggctacaagataaatatgttcaaatcaccgatctctacagataagaaaactatttttttttttgagaaaactatttaaaaaaccaggagagaaaatattttattttctgttttctgtacttttatctacagattcaatacatttctagtgtttaccatggtatcacaattccactgccacaggcttaagcagatgtaaattggagagggaaaattaatttttcagataaatgcaaaaagaactgcattataaaaatgacagtgtaactaagacatttctactctagattttggcttccttttctttaatcacctagcaggattcttttggatatccaaactcaatatttcaacggctcttcagagccaaaaagctttctgcaaaggattaaagaagtagcaaaatgtcattataaatatgaatttaatttgcttgagaaaaaaaccctgcgtggctatgacagttatccattcttacataaaaaaaaaaatttaaatctcacaagagtaatagaaaaatatcaatgaactgctatgatcaaataaatgaaagtcctatcaatttatttgtagtttctctttgaactacaaataacagatgctaaatatcttcctttgtccattaaagaagtctgagattcttaggtttttctatcctaaacagcgcaacatgagccatgacaattcttcactgaaactgaattaatttagcttttagcttaaaaaagctaaagtatctataacccataagctgtactaatatagcaaaataactgtattgtattcttaagtgacagctgcattctttaggtcattccttagttaaacaaaagtggaggtggggaaggagacacagcaattgtcctgatatggaggcacaaattaatctccatttttatacttaaaaagtaattataaataaaatgctcacagtcctagtgattggctattcatcttcttttttttttttcatcttagccatttcctcaaagatccatctgcacttcatttatttatttcccccataaagagggattataactctcttatcccaaatttgaaatactggtttgtctgtaaatatggaagcctagaagaaaccacagtaattggtgcttttagctgcccacttaatcttgcttaagttaccagcattcacgatgaggaatgaccgagaggcacaggttgagtaactaccaggatggcaaatgcaggggatgaggttaataaagattattgtcaggaacctcagtgatactccaaagcatgagaaccaacaaatcacaaattaagagcacttgctaactagaagcaaggtgacagccaactgcggtagttaaggcattattgcttctgtaaacgctaagctcaagtataaagtagacatgtaatcttcaactccccgaacaccccaatttggccactaaagatgctgttttacatttccaaacattttcccctgtcactactttttatacttcagttctcaggttgtaagtatttgttacttgcaaagcagccccctttgaacactgaatcatgggaggcatttgtaactaactgccaatgctgcctgccaaacaaaaactccctgctggtgacatgaccacctagtgacctctaaaaatgttgtaacaatgtgaaaaatagctccctcttgtaggaaacagcaattttttaaattaaacgtacatcgaacgttcgcttatatacagataaatggtgttcagagtcaccttctctgtttccaatttcaatcttttgaaacccagcccaaacctaaataaataaatgttgatactaagaagaaactaagagctcaagagccttgtgattttgcaaacagcttttttccattttcgaaaatctaaactcggggccagacacagaacaggtaatgaaaaggaacaggcttggcagtccctctgtggttctaagctgaaaaatacgtcaggcagaaataagtggctataatttggcaggcttaatgtcttcaaaagtttgcagcttgctagagaaaaaaaaatttaaaacagttataacatttacaaattgaaacacagtcacgaagctaaaaagccagatgaacataatttaattatcctcagagttttaaacatacttttatcatcttcaggtgtttttgtacctacataatagaaggcgctgataattattaaaactgggggtaccaggaaactttttgatgctaacatgatcttaggtgactgtaatactgatgaacttagtctatgcccttgacatcaaaatattcttggtctcactttaaaaggtgcaatggagcttcccatatgtgccccatgggacacaaggaatgggaaattggacatgacagtaagtatttttgaggctgtggatcactgtttttccggttagtttatctttctaaaatttcaaaattaaaaatctcagagcaacagaagtatgacatgtcaaaggctgtttgactctaatgtgtctcttgttcatcctgacatcttctgatgaattatttccaaacactggcccaagccatgaaaaatcaaatcagcttgaaaacaaaggggcaccaacaactgtctgtttctaagccattaaaatgcctggaagatcactctttttagaaagaatagtcagtcctttttacctccttaaatctttctcgcctaccaccccatccccttcctctgtacccaagacaaagaaaaccaccttaagagttccctccctcaaagagggagaaaggaaacgtacatgcttttatctctgattttaaaaaatgaataagatgcaaagaagaaaaaaaaagtatacccaaatccacgttaaaatatgcttctaccttttcaaattttagcttaaacccactttgctaatatgctgatataccaaattcaatatgcttttggtgaaaacactccatgctgaactaaaaacttctccctgaactaaaaactactccccttgaaactatggtgtatgtgggtattcagaaaagaacacagaacaccacatcatattagtgtataggcatggtaaattattgtcatttccggccaaggagagcttctctgttttgtgacattccccagctttaatgagcaactctgtaatatgtaagttgttctggaagacttaacatttacaaaaaacacagcacgatattacttagcataatgtaaatttggaattttaaagaaatctgagaactggaaaaggatgtcccttccacactggtctctctatctcaaatttttaggtgaggaggtgagtattggcaatatgatttgatcagtgctaaatccaaatttatgtaataaatcattataataaaattatactaggtggacccctgtgaaactgccagtgtctgggtatgttcaacccataaaaatgacaatatcataagattcagcttaataacacagtgccttactttcttaatctactaaataattctaataataattatttcacaggattgctgtgagaaatcaatgagatactatatataaagagcttaacacagtgcttgacacatggtaagcattcagtaaattaatggagtaggaaaaggaggagttataaacctataaatattgttcactttgaacatcctaataatttaggttattaccacttacataaacataaattatttatcaatagcttacaatttaagaaatgtaatcaaaattcttagtgagtattaactgttttcactcttagatcattaaaagtcaattgtatttgaggctcagataatattcctcttggaaaaaaaattctatcaaatcaagataaatatcatatatatatatacatttatacctctgagttcttattttttgtattcaaataacgatagagcccattttttcatctggagagaattacatctgatgactatcagagtgactgaaatattaatgacttaaaaaaaattcacagctatccaatatttcccagcaattttgtgaattgtgccaggtgattccaataatctgctattctccccaaaaataacatggattgttctaagtccatgaagaagaggcagagctcatatttcatctaaaaatcttttgtgcaaaaagctgtatctacgaaattattaatttccaaaggatggagggactggaacctgtgactgaggtagtctaggactctgaaatgggctaagccgaatcatgagacttgggttccccaactccaaactatgcacaccacagccaccccactcatactgaggaagatcccccaaactctgcctcttctcatttcacgcttttccagaagttcatccttctcagaaccacttcttctctgacgggtatcaccaaaggtgaggggcagaccaatgaggaggagggcttgctgccatcctgcagagcctcccagtggccctatctttggcagtgttctaacttttacagatgcctgtccccatttgacaactttctaacttagatttccttgtctcctaggacatcgctagcctacacgccaagggctggcgttcagacaaggtgggtcatatctgtagccaaaaaaatccagccatttaatataaggaagtgtggatatgggatctttcccctcttcttattacacattaaaagccaaaccaactccctgcaaaaagctcaaactgcgtaacgttttccaagaaggttatggtgggtttatgtcaatgaaggtgaatggatcaaatacagtcttcagtaagatctctaccaacaaataaggcttaagcatattaaaagagagtccattttgggaattcaaaacacttggattgctaaggtgagggttaaccgctaaattccaccagataaggtggtttttcctttttctttttagattacagactctgactaattcttgatatttttagttctttgcagaggaattttaatttggaataaatttttactccttgacaattaagccaaacttcagaagcaactctgttttatgacatttcagcctcccccagtttacctatctgtaaaattcctccttttgtaccaatccaacagagcataaattaaagcacattgcaaatggtattctaaaggaaacagacaatccctgaattggtgtattgctgtgcatttcttcttgtcattttgaaaattacaatcatcttacaattttaaaaaacagctttctagattcttcgcaaatacaataatatgactgctccacagttcacttaaatcactcgggtttcacttcatcttctccacatttgcacaggaagaagtgttcgctattgtctcctccccctctctgggagtcagaccagctgggacgttttaagtctctttcattaaaaaaaaaaaaaaaaaaaaaaaaaaaaaaaaaaaaggttaaggtcaaaataagtatgataaacatggtagtttccattctcaatattcaaggacgaaagactaaacaacaacaaaaaaatgtaacattaaaattcactgaagtatgatgaagattgtttttttcttcccttgcaacataatcatggaggaaaaaagggttttggaaaacagcaggttttacctttagtaaatctagtctttcaaatgagtccagtagttaattttacagctgcacattccttaaatttatatgtttccaattatctgaatgactgacactttcaagttttatggttgattttgaagagcagggcacttaaacttacatgaagtagatttttacacacatgagtaattaaattgtgcttaacgagctcttctttgtacttgtgaagttttagcattttggttgaagtttccttaaaagttagtaaattccaacactggacttttcataatacacactttgctattgggcttaaccttttttacttacagagtgtcagcacccctccgtgacataaaccccctaccaaacagtagccagtgtcaaggttatcacatgaaaacagaccgtaggtttcagtctcgtacttttctaatggctgaaaaaggcaaattcacagcacggacagagtaacacattgacatcaaagaacctgtaatatcacaggtaaattaatgtgcttcccactgcctatagtcaaggagcaaactggattcttcagaaacacattctgaagccattttatcttcccatccccttcttccttaaatgtaatcgtctactgtctgtaatgtaagcaaatactttagtgaggttgtgaaaaattgattaggagcaccttgaagaccctacctccgtgatatttttttttgtaatagttacatgggtcagctctttgatatttgctgcatatagaggcagaagtattccttcactttagttcagaaacacttgaaatagactaagtagtaaaaattagttacatattccagttgctgtttaatgcattattaaagaattttcacatatacattggtgagaaagatggctgaactataatgtacaattaatatgttgctttgccaagagatgactggatcacaacagtagagaaagtcagaagatcaccctgaggacatcccaactaaatgctcacttatcactgaatctggctttccacggggtgtctctgctagtctgcatggaggtggttcagtgcacgtgaacacgccatgtacaaataacgctcagataaaataatccagaaataatatactttttgacacatataataagcatatggagtcagttaaccaagaaatgaaatacggcaaatgttagtgggtcaggggtgccttgatttgtttctagaataggagagcctaaagggcatgacataaacctgtggaaaaagaaaatggtaagatgcaaatctccctctgaaaagagtaggtgggcccagggtagattgggatgtgccaaatgaagacacagagatgtcctcttaagcatcaccacttgttcattctgtgatgcagagcctgtgtcaacattaagacagatgctttgaggatcaaataatacaatgcattgacactgataatacaaacgaaaggagagtggctgccgttatgatgtttagtcttattccttgctattcctaccatcatcattgttattactactggagctcaggtcccagcaaactttctataaaaggccagagagtaaacattttaagctttacatgtacagttgtttcatttatgcaaataaaaatacaggagttcagttacatttcaatttcagataaacagtaaatattttcttttaatacaagtgtgtcctgctcaatatttgagatgtgcttatactaaaaatgtattcgctgtttatctggtttttttttttcttagttttatctcaggctttccatgtgttatctggcaaccctatttataggccatgggttttctgttgcagctacttgactccgctgttgtagcgtgaaagcagccatgacagcacataaacaaatgcatgtggctgtgtcctaatgaaactttatttacaaaaacagatgacagatgaggtgatatggtttggcaatgtgtccccacccaaatctcatctatataattgtaatccccagggagggacctggtgaggggtgattggatcatgagggacacatggtagtgagtgagttttcacaaatctggtggttttgtggcgggcgcctgtagtcccagctactcgggaggctgaggcaggagaatggcatgaacccgagagttggagcttgcagtgagccgagatagcaccactgcactctggcctgggcgaaggagcgagactccgtctcaaaaaaaaaaaaaaaaaaagtatgtggctttcttttctctctctctctgcccccctccctccctcccttcctctctctctccccctccctccctcccttcctctctctctctctcctgccaccatgtaggatgtgccttgctttcccttcaccttctgccataattttaagtttcctgagggcttcccagccatgtggaactgtgagtcaattaaacctctttccttataaattacccagtctcaggtagttctttatagcagtgtgaaaacagactaatacacgaagataggagttggcccatgggccatactttcctgactcatgtcaaaggtcaaaataaagcctacactgagttaaataatcggatttaatgtaaggatggactattctaaacatttgaagggagcattttctttcatttggacaaatagggtaaattttcaccactgcctggccacaattcctgggtcttcctgtctgctaccttgcctaggaaaatgtttctgacactgcaatgcacctgatattgaagccactgaaaatcaatatttgacacatgtgtgttccaatatcataccacaacagacacacaaatgaatgagactttgtgcctgccttcaaggatctcccacccaggtcaggagggtccttatttttattttttttaaaaagtaatattaaaggtaatacatattgtaagctagttagttgggtcaagcaaacccttggccaaagctggtagaagaaacgaagggacccagaccttggctgaattgcaacttgaaggcagtgtggctcagtcttactgacagacccatgcactcagatgggtaacctgtatcacaaatacggcaaaaaagcagagtcaaactggggatatttattcaaggaagaaaagcctacaaaagagagacgcaaggaagaatggctgaatatttgattgtgtggaggagagacctaacttactccatatagtttgcaaggacctgaattatttcacatagctcaagatgacagaaccactgtccagttcagttcaacttaacaactgtctacagaacacatactaagtaggtaggtgaaagcctggccccacatgtacattacaatctagttggaatgatagaggttaaatacataattaaacagagaatcaagaaagagattcctaagaaaatggcattattggggacttgaggaatgacttggatttggtctagaagaaaagggtgagaggcagcctgtaggcagataggaaagcactggcaaatgctcaaagcatagagcttggcatgtggcaggaacaatgacaagttcaatgtggttacacagttggaccagaggaagaattaattgtctcccagcgatggtgatgagacatgaaagcgtttaaactaattattaaatagtattgattttagagaggtggaatgtggcttaacttatggaacagatgtctagtattgctagaatgctgcccattcacagaattttccaacaaggaagcaaatggccatcttgagtgagactatgaagaaaattcctgctctagagaggaggttgcattggtgagatagatgcatcgggtgtgtcttgcattaaacaaatccagattcagagagggactctgactcctgccaactggtgaccctgagcttcagttctgccatctttaaagggggatagttactgattttgcagggttgttgtgaaatttagaaatgagtaccaagtataactgtccagcacatagaagttattcagtaaatagtatagacacagactttctgactttaaattgtggacattttcaaatatacagaaaaggagaagcatataatgaatgcccacaagcccattacgaaaatttaataaatgtgtcatattttctcaccttttatttctgaagtatttttaaagttggacatcaagacattccacccctaaatatgtcagtctgtttctaaaaattatggattttccctatataatagtacctaataaaataaagcacaatattacagatattttatgcctctttttaaaataaatgttggcttctcacgacgtatttttatgaatattattttagtgcattcactaactctcatgcagacctacccttttcaatgttttaaagtcccccaaacaagttcccaaatattaacattctcagaaatacttccactgtttgcgtttctgtatttagttcagaataaggttttgcaatttttctttttatggatacagcctggggtgcactgttcagctacaagagttctgcagtgctctccaaattttaaaaaagtgtttatctctctgaagatggacaattttaacttaaattatttctctgcaacagccataacagatgaaaagcacatttgcaattacttgccccatttttaaaccattttcttcttaggcaatttttgcttccaggtgagcataggccattctctcctcctcttagaactggcttctgtcacacctgctgcaacacttgcatcgcatttacttactaacgggatcttttaccttggactgtgcacacagggcctgtgtcaatcccagtccccagtccccagcccagatcctggcaattgctaagccctcagttaggtgttggctgaatgactacacaaatgaaggagatacttatggctttggctgtgctcttattttgctcatcaaatcttccttttccagacagagaaaaagcaaaattctgcttaggtcgtaggatcttaaagtctgaattaacaacttctaaacaaatagggttttctgatagttttctatgcatccttaagacatttgacaattgttgaatgaatccccacttgtatttactcttatacctcccaagaattcatgagaccaactgacactcaaggaaatctagaggctaaatatagagacatggggcctcctttcacctgtttcttaaatgagaacgttcacctccattgcatgtagcctaatgtgactacgggcaaacaacagaatatgcagtggtgaggctcatttttggtggggattttcttctttttttggcaatacatagggtgagatttcagctgccaaattatacagctcttcaactctgtgccaaactttatcaatttcaagagtcacctattagaacaatttctaagagattagttttaatccaacaggagatcgcttcttgtcttccaatgtcagaaaaataggtcaaaactgagtctcctacaagtccacatgatctatttctttcttttcatttatttattttttgactgaataaaactggcattcctaagatagagaattcagaccagggcccatatgtgactgtaatatcctcataaatcaaattatgcaaaatacatgcaattatctacattacctacttgaataaaaggagacttttttctctccaagacccaagaatgatctgaagtctacttttcttggcagattaaattgcccatccatctccagccattggtgctcgttcaaacaagtaatggctctgcaaaggctgatcctaaagggtccccaaattcatacttaatctagagataagtgcagcaatcaatctttcccagggtctaagagagctattgtattccacccaatgacgtagcatgtgcaactattgttatggctttctgccctaatgactcaaaatgaacatttttagacaatccaaactggcagaggtatcctcaacagagggaacatgcttcagagagttgagtgggtcgttacttgaggcttttttccctgaggttgagggagcagctgttactggggctattacatcatgcagatacgatattaatacgaaacactgcaaagtttatctttaaagatggaccgcagaccagactaaaaacctgaggaaatcttgtccacgtctgtaacgtctctattccctgcctgctcaggtgagtttggctttcctgcattttgctgaataaaatgattacgtgatctcactgtctgttttattcttcttcagtctcaaaagaaaaaaagaaatcctaatagaatgagagtgagagggcagtagagtagggtgcagtcttttaaagagaagtcttttaaacatggctcaaggatactgtactccaaattgggggaagaatctgctgaggctcagaacccctgtagggtatgcctgggccaagtcccaggacactaagagaactgtgtgaagctaccaaggctgccaggaggagcagctgaattcaaagcccaggccacacacagaagcactaaatgccagcagatcgccaaaacctgctgtggccaagggctggcaacagaaggaaagctgcccatttggagagggggcatctgcccccatttaaaggctagaacacaactcttggttctctccacaagaaaaaaaaaaaaaaaaaggatcaaggacccaaacaaaataataggggaatagacgtatcagtttgtaggtgatttattatttttattttatttatttattttttagatggagtctcgctctgtcgcccaggctggagtacaatggcgcaatctcagctcactgcaacctccgcctcccagagagtgattctaattgaatccaacaacagtatgcaagctttcctgcccagccttggaaatgacccaaggagactgggcaggtttggcatttcaggtagatgtagaagaaaccagaccggagctcacccctaaaataatgatgggggaagagggtgagtggagcttgtgggatagactgaagacccaaaaaggagggtatctagtagggggcactcaccctctggccccacctcttatgtctggcacaggttgggaagggctggcaatcttgaagacaccaggaacactgagatgcagttatggacacagctctaggactataacccagaattcaccttctctgaaagcccaaatgtctgagaaaaaagagctgccaaaagtcacattgcattcctccttcaccttcacacctccacttcctggaacaggaatcctgagggtgattacttgcctgatttcccatgctacctagtttatcttccctcttatcatgttcttcctgccacctgtgtttcccaggtcatatcaacttgggggttagagaagcctaattcattcaactaacaaatatttattgagtgcttactgtgtgccaggtcctgtaacgggcatcagtgataaaatggtgaacaaaactaggcaaaggtcttgctgcattcatggatttatgacttaaatggcagggaggtgctgataccagttggagaggtgctaattcactagtcatgcagataaaatgtaactttagtgttccagtggcataattagttagcatgcagtgcttataaaatgtaaattgctcagcgggcttaggtttttgccaagggtgccagcttccaagtcactactacttttttccattgctaacatatctgccagctccaaagtggcatgtttcagatgttctcaaagaccccagaggcttcggcaaggccacctattcagtttccactggccgtcttaactgtgggccctttgctttcaggccaagtatgagggaagtaaaacagaaacccctctgtggacagacgcccagctccactcggagttactccttctctctcaacccagtttccctaaggtgctttaattcccaggaggcaaggtggtccttcatgcgtatagacctctaagaagcccgcctaatcagacatgcccaggtagatcaagactcagcttaaactagagatggcacagagaccctcctgccagctctgctctgtaggtgatgttctccgggagtacactaaagggcatcagggatgaacaacaaataactgatgtgaatgagtgatgtctgatgtagacatgaaaaatgaagtgttggccctatgttcaagttaagctatgaacgttctcgttacttattcaacaaacatttgggggtctactgagtaccaaatgtaggatggtgatatggtttggatttgtgtccctgcccaaatctcatgtcaaactgtactccccagtgttggaggaggggcctggtgggaggcgattggatcatgggggcagatttcccctttgctgttctcataatagtgagttctcacaagatctggttgtttaaaagtgtgtagcacctccttctccactctcttcctcctttttctggccatgtaagatgtgcctacttccccttcaccttctactatgattgtaagtttcctgaggtctccccagccatgcttctggtacagcctgcaaaaccatgagccaattaaacctcttttctgtataaattacctagttttaggtatttgtttatagcaatgtgagaatggactaatacagatggaaagaagaaagaaggctggtttgcaaatcagaacatcaatcctggaataaagcactatctgggaatccataagtcagtgccttcacatccatcgctcattcttccactcaagaactacttaatgatcaccaactctgtaataggcactgtgctttgtgatggggatacagtggtgaacacaaaggactaggttttgccttcctgaaattcaaagtgtcataagagagaagaacaataaacaagtaaaaaaatgaaacttcagataaagacaatctaaaggaataaagggacaaagagttacaggggagagggtatactttagctaggccttcctgtgaaggagatgtttgaactgagccctgagggatggaggacatggggccagctaggggaagatcacaaggaagtgcagaccagatgggagaacgctaagtgtaaacgctgtgaggcaagtatgagcttagaagaagcaagccaatggggccggagcttaggaagacagaagaaggtgacatcagatgggtttggggagtaggcagcgggcagcagcaggttacacaccctagttgggggttgggttttactttagttttatgttttaatattatttttgcctctgagcatgcaatagagggaacagacatgatcaaactcataccctaagattatccctgtggccactgtgtggatagatcttaggacgggagaaaaatcagtaccacagtgtcctcatctgtaaaatgagacattggattgcatgggctctaaggtccctttggctctgaaattttaacatctatgatgaactgggatgagtgttaggatcacagtgagcctgtctgcctggttcactgctatctcgcttggaggcctccgaaggctccagcatacaaaggtggctggtaaatatataccaaatgaatgactctgattttcatttacctaagacttgccctcttaacattaaagaagtctgtctttttagacctaagtggttatcatcactgctgatgaggtcaagtcattcaacatttatttgggggcagtttgggagctgatagtgaaccagcctggattaagagctctggggcacaccaggttcttctccagtagttttacattcttcagggatggcctcttttccctccttgctgaacctatttctgagcacatcttagggggaacatcacagggtctctgtctgggttgggcagaaggtagaaaaggtatatacaagcagaggatgcaaaggtttgcaggttgagaatgcaggatattgtcagacgatgttagataatgaattcttcagttctcaggggataaaaattataaatatatttggttgaacaattagaaatttctatcttttcagataaaaaaagttgaatatcagcaatttcattgggttcaatctaatgtatagtaaccaatatacattacatattggttactatatctgagtgccataaaagacggtattcatccacaagccacagagtgtcacacttcatcttaaggaaatctaaaaacacttcactccaggttttggaaaataactctgaaaacagctaaataaaactctggaaaggcaagtgaatggaaggagggggatatggcagaaggttcttgtggcagatcatgttgtcattcacaattatttgctccctgcttccctctaatagcagccaacatcccctccctttgccaggtgatttgcaggccttcctgtaggaaaagtacacttccttgccccatcgtcaggcttggccatgtgatctgccttgacgaatgggatataagagaaagtaatgcgtgcaaactgcaagcagacactttaagagccattgtatgcttcttctaactcttttttctctgccaggagaatggcatatcccaaacagaggctgctacctcatcctggatcctagagtgatggtgacatgtagagcacaagcacagaccccagtgacccatggctgacatgcaaccactgagctgtaggggtcacttgttatcctccaaagcccactaatatagcttataaacttgcagcctccaggccacatcagaaccataggaacattgtgtttgacttgcatggaattttaaaaatttatttttttagtcggttgccaaaatattaaaaaatcccagtttgaggctttctctaacaattggaagaattggtaacatcagagctgtattcctgcatgacagaaatcaactggaacagaggagtgagtgcccccttccccctttgatgggcagatgctctccagccctcactatttcctaccatctttccaactctgaatctaagagttggttgcaatttatcatcactgttaaactgttggtttttaattttttaatttttttaaattatactttaagttctgggatacatgtgcagaatgtgcaggtttgttacataggtacacatgtgcaggtttgttacataggtacacatgtgccatggtggtttgctgcacccctcaactcgttatctatattaggtatttctcctaatgctctccctccccttgccccccacccctgacaggccccattgtgtgatgttcccctccctgtgtccatgtgttctcattgttcaactcccacctatgagtgagaacatgcggtgtttggttttctgttcctgtgttagtttgctgagaatgatggtttctagcttcatccatgcccctgccaaggacatgaactcattgttttttatggctgtatagcattctatggtgtatatgtgccacattttctttatccagtctatcattgatgggcatttgggttggttccaagtctttgctattgtaaatagtgctgcaataaacatacgtgtgtatgtgtctttatagtagaatgatttctaatcctttgggtatatacccagtaatgggattgctgggtcaaatggtatttctggttctagatccttgaggaatcaccacactgtcttccacaatggttgaactcatttacactcccaccaactgttggttttttaatacttgattcaatatagatcattcagattacaaattatcctgatttaccttaaagataaaatggagaatgacattagcaacatcgattgtgctaggtactaggtaccttatgtgcattatctcactgagtcttcacgtccaccctgctaccattgcacagaaggggaaactgagtctgggagcccagagttagacaaaagttagtaagaagtaaagctaggacttgaacccaggtctgtttatctccaaatcccatgctcttaacctctcttgtgacttgttcgtggtggaaaaattagaagatgaaaataagcagaaatgctgaggcataaaccccactaggctggctgactgcaggcacaaagcatgagcctcctaatcaaactgggcttccaattaacacaatctgtcaaaacagcagtaactcttgctcccattgcactgaggcgagataattaaccctgcacacctgatgagactgtgccttcttcagtacccactctgccccacagcaggcctgaggaggcaggctctccacctgtaatgggaaataacctttgcacagagcacacaggatgtctgtaattatgggttttctcagaaatctcaactgtgtctcaccttttgctcctatccagttgtaaccttcacaaacaaccactcacttggaggggtgaaatatccatcagcgacctgggagcaactcataaaggatctgggctccaaggcctcacgtctgtgggcctctccgcccatcaggactgttgtgagtattaaataagaaaatccatgcccaaaggttagtatggtactctaggcatacagtaaggcattaatacctattcttagaattaccatttattttattaattaatttatttttgagacaaagtctcactctgtcacccaggctagagtgcagtggtgtgatcttggctcactgcaacttccgccacccaggttcaagcaattctcctgtctcagcctcccaagtagctgggactgcaggcatgcaccaccacgcctggctactttttgtattcttttttttttttgagacggagtctcgctctgtagcccaggctggagtgcagtggcgcgatctcggctcactgcaagctccgcctcccgggttcatgccattctcctgcctcagccccctgagtacctgggactacaggcacccgccaccacgcctggctaaattttttgtattttttagtagagacggggtttcaccgcgttagccaggatggtctcgatctcctgacctcgtgatccgcctgcctcggccttccaaagtgctgggattacaggcgtaagccactgtgcctggcctattttattttatgttaatttttgaaaaaagtatttcaagttatcacccatcctttccctccctaagcttttatattcatcagcactgagcccagcatgctggaattgtcaaatttgccaagatgaagagggtcccttgggcctgaagcaactcctgctgtagttaccctgtcttagctaagggtaattctattcttcccatttctcagacccaaaactttagtgtcaagattaatagcaccacaacctgctccctgcccctgtacccacatccaatccttcagcatttcctgttggccctaccttcaaaataggtccaaagtggaccatgacgcaccaccccactgccaagacctggtggggcttgccatcatctcatgcctggattattgcaatggcctcctagctggtctcctgcttcttttctcaacacagtagccagggatcctgttaaaatgttacattggagcaagtgattcctctgctcaaaaccttcccaaaggtctctgcatttttctcagagccaagccaaagtcatcccaatggctatcagtcccgtgtgacctggctcctaattacttgcctaacgttatttctactcatcctccaaccatcacacaggcttcctggctggtcccaccttagggcctttgcactggccatgccctctgcctggagcgctcttccctctcggacatgcacttggctggtttccttactccttccaaactttgttcaaatcttgccttctctatgaggtcttttcataattaaaaatttgtgatcccaacatttcagattcccttttctgacttcaaatctttctctttaacacttatcactatcaaaatatcatatgctaggttaaatcatacacaatttcctatttttaaactttttgacctatccacatgccagtttcatatgagacaagctaatactcatcttgcctgtcttattatttctcccttgttgagaatatcagctctatgaggcaggaatgttggtttcgttcccaccatccggaatggtgctgcgcacaaagtaggcccccagtcaatggttattcaatgaatatggaatatggcacagtgcttccatttcaatttgttttttaaaaaaaatcattgctgacaggtgttcctgggaaaggctattttggttagaagtatcctcgccttcttgcaagtgcacagagaaaaactgtaagtatattttttggttcactgaacacccaggatatactgaaaggaacagagattatagagggaaagaaggcggcttttgtgtatatacttatccaatttgagattcttgtcattttattctcttccttccccaaatttgggttgctacccctgtctgatgcccaaagtattctaaccagaaggcccataatcataatctttttgaaaaacatccttctggctgccctgcttaagctcagagcagtaattaaccccaccgccttctgagacctggagcaccctcattcaacacacacttttaataggatacattcagtctcaggctagactgggtaaaacatggtccttactgaagggaaagaggagacaatgggccataaccacatagttcttagtggtccaaggaccacctaacagggttgggaagaaagctcatgggatctcaggcagtgaggcattatgtcaacatcggttcaactaacaagctaagatggattctgcagcccaagctcaagtctgtgtgtgcatttagacactggggaaatgaacttccctgagctgttgcctggagcaggatacaaagcactcagggaccccccgacttcgtggtctcccatcaatgttatgatgctgcaatcttccccctttccttggctctcctgtttccctggtcttgttctctgggtcctgctctctaggtgttccagtggtttcccaaagacctggtttacaaaaggaggcatttgtattcattctgcaggtttggctttgcagagccaggccttcagaggctcggatctccttcagagccttggctgtcagcctgggagaacccaccagattacccaccaggtaaacaggatggcctggcccttttgggtgacccaggcaggctttccttagccttggccagccagggggaacataatatgcctttccagtcaatttcctttattttccatttaaaaagaaagtccttcatcaaaataacaaaccattaatattacctaattactaatatttattttaacatggttaagagaatggcacgttttacaagtattagagacataaaacacaagcccaatttggttcttgcctcattaaactttaaattgttacagttcactgcttacaacaacactgattctcactcccaggtctaactaaagaacaaattttaattcaatggacattttaggagagacaacagccttgtgggagtctttccacagcagaagcaggagcccagctagcatcaaatgtccccacacatgtcctcctgcctttaatctccttaatcagctttccaactacccaacttcaggggaaaggccttctttgtcttcaattttctgtttcctttttccttgcttgcttgatgatgataaagacatgagagacagaaaaagaaagagagagtgggggtcgggtgtggtagctcacacctgtaatcccagcattttgtaaggcctaggcggaaggatcacttgaggtcaggagtttgaggccagcctgatcaacatggtaaaaccttgtctctactaaaactacaaaaattagcctggcgcggttgtgcatgcctgtggttcgagctctcaggaggatgaggtgggaagatcacttgagcccaggagaatgaggctgcagcgaactatagcagtgtcatggcactccagcctgggcgactctggcagaatgagaccctgtctcaaaataaataaataaataaataaataaataaataaataaataaataaaaaaggaaaaagtgagacagacagagagagtaaggagagatagataatagacagacagagagagtaaggagagatagataatatgaacaaatgagagaggatgagacagaaaagatactgagagggccctgccctgtcttgaccagaaaaatccaatgagaaaatactttcccttcctaatcctctgatttttacaacagcagacaattagttatgaatccaaaccaacttttccctgcgaacttctgccagttttgagataatttgctttgtttggtgtgcagcaggggtggacccagttggcttccccaggggcagtctgtatgtcagcaacatttgcataatccatctcctcatctggccatgagctgtgcaccacaggagaagaaggataaagaaagcagtttggtggtgatccacagaccagtctcactgagctgagacagaacctatcctcacctttaggctgggcaagagggggccctactgtgaaggcctgcatatcaaaacaccaacacatacttttttttttcttttctggctctttagaatgttatttgttgttgttgttgttgttgttgaaagtttagtaactgaccaagtgaactggaattataaagggcacacaagccacacggggcctccatttgtcctattgtcctaggtcctggaaatctcaagaagcgggtctgtctgcacaccatggagagaagataagggcagaaatgatgggggagattgtcatggagagcacaacggagtaagaacagactgaggatttaaatacttaggtacataatgtgactaaggatggagcaggtctaagtgagagagaaggctaacaccatttcagggatggagcagggaagccgctgagtggagacgatgggactaagaaggagcaggtccagggattcactaggaacattcttgggaactcgagaccagaggagcttaggaaaaggataaagacttacacaaagaaataggcgtgagttactcatgtgagcctgggggtacggaaaggggctgggaagggtcaagctgtgggacagctagacctgggttgaaatattaactccagaacatcctggagattgggagctggagctggtggcctcaggcctttgacctagatctctctaatcctcaggaccttgtaaatggtagccatcccaaagggctgctgtgagaagaaaatgagaaagctcatacagtggagtaacatagcacccaacatggcaaacacacacaaacgctaggcagtgtggttggcattagcattcattttagtattagtattcgttgtagtttttccgtgaatgtgattccatttggctgctcctgctggaaaaaacacgggagacatctacaacttcctcaaccccaatcttttctggaattctcttgggaagactctcttcttgcttatagaaccaagtgtctccctcctctctttctccttctcaccccaaaggcagttaaaaatacataaaaaaaaaataataacagcaatatctggcatctcaaaaaggaacatatgatttctcctcagggacaaatggccttgccaggcagaggcacctggcaccctgtggatcatacctggtgtcaatattccagttagtgccagggacatctggcttcagtgtggcatctgagggcccatgtagcatcaggttctggggtaacaacctgcagaaagcagaagtgtacccagctagagcaggaaaaagctgcaactgtgttacagtgaaaatgaaatttcatgtggtgctctacagaagggctaaagatgggtgtccttcacccacacccaaggacctacccctcagaccatctctagatagaaagtccagaaacaaaagtgggcatacaggcacccctgtgggctggcggaaggagggaaaagggaggctttgtgtctaatctgaacttatttattgtcagcctccagctccattagaaatgctgttcattacccagaaagccaaatttgtgtgagttaatttacaactgaaagatgtaatgttatggagtaatctatactttgatttattgtaaatttcctactggcatgaatttttatacaccaggctttagctgatccccctaaccgacaaataatgcttgacaattacacactatcaggcaaacatgctggaacatacacttttacccctaatcctgtatataaattttactttttacacttgtgtggctctcttccacatgggaacttcagaatactgtgcccatttagtgtactgtttatcaagatgaaatgtgaccgaattgactatttcctcaatgaggcaattctaaaaaaaattaattttgttaggttttttattttctaaagagaaacaaaactttcagaccataggaaatttccttgatgatgcttcatatcagattaggtaagatttctgatgcctgctgttggctgacatgatcctttttcaatgaagtaaatccaaatgctcatgaaaaaaatatatttaaaaaaatttttttcacaaaagggattttgttagagtagtacctatgatgtaaatgcatatgcttatgtataactaaatgaatacacgtgtgtatgtatatatgtaaatgcacacaagattggaaaaatgcaggtgttccttaaatcctcagagggctactggagaaatcaggttctctggaaacatgacttgggtaagtccggctgtttctaagactctacttttggcacttttataccacattcagagtggtgtggtaagaaaacagaggaaggaaaggaggagggagaagaggttattctgtgtgtctattccatttcatgtatttcactagacataatgcctaattatttcatttctcaattttattttcaaactcttggcatggggaggtcttttcaaaagacaggaaatccagatgctataaaggaaaagactgggattcatataattatgaaagttctgtgtggcaaaaaacagctacaacagcaactccctaaatgagcaaagctgtaagataaatgtcaattagataagcacatttcagataaataatttgcatccacaatatgacacattaataagaaaaaggtctatcagccagcagaaaggtacaaagggtatgtatcattagcccatgcaaaggatatgaatatacaaagctctgaataaagacatgtgaatgactaattgataaaggatgttcatgcatacaaataattaggaaaatgaaaagtaaaacaacaacaagtaaaacaattaaacttcttggaaagtttaatcaaggagaaaaaggtggagacagaatgtaaagaaataactataaaatgacaaaaaggcaagggaatagaacagataaagaagagattggaataatgacaataggcatataagtagatgaaatggacaatactctagcaaaacaaaaataatagggaagaggcagataatctaaatgggccaataacccaataaccaggaaataaaaaaaaaatgttgccaaaaaattatctccaaaaatggccctgggtttggagcatttaatagaagaatactttcatactttcaagaacagaccaatgtttttggctgcttaaaaagttctggaaataggccaggtgcggtggctcacgcctgtaatcctagcactttgggaggccgaggagggtggatcacttgaggtcaggagttcaaaaccagcctggccaacatgatgaaaccccatctctactaaaaatacaaaaaaaaaaaaaaaaaaaaaaaaattagctgggtgtagtggcggtgcctgtaatcccaactactcaggaggctgaggcgggagaatcacttaaatccaggaggtggaggttgcagtgagccgagattgcgctactgcactccagcctgggtgacagagtgagactctgtctcaaaaaaaaaaaagttctggaaatatagactgcttcacaatttaattttcaaagctgacgtatcttggatacataaaagaagaaactgtaggtcaattctacttgtgactatgatataaaaactgtaagctgcaacacttgcaaaaaaaaccccagcagcacattgcagaaagaatacaaacacggccaagtagggtttatttaaggaaagtaatgatgatttaatagtgggaattccataatctaacacattacgttagtaagtcaagagaggtaaatacatatgagatcattcaaagcagttcttctttatcagtggtacacatcagaatcgtgggtctgattcctaccacggcaaattatcttacagtgtaactggagaaagtcttagtcttttttttttgttaagtgctctttgggaattcttaaatataccttagtttgagaaccactgatttagaagaaaatgttcatgaggcattaaataaaaattcaacaattcttgatataaaatcacaggaaactaagaataagagcatatctctttaataaggtctatctcatctgaataacaaacaaagaaatagtgaactacaggcaacattcccatgaaatccagaggcaagacaaggatgctcactataaccactagtatttagtattgttttagatattccacctaaaacaataagacaaggaaaacatactaaaaccgctattgtaaaagagaagcttacctgggattattaacatatgatatgataatctattcagaaagtacataaaatcatgaaaaagattccatttcttttatggaaaagagtcaactaaaaaactacttgaacaaaaaataatgcaggaatgtgtcaggttaaaaattcactaagctctacgtcaacctgcactgccagttaaaaagacaatggaaaaagtttccattcataatagctaataggtgtaccaaaaaacccacaataaatagacataacaaaaaattatgagttccaattttataaatatcaaaaagggaaaaaaatcatcttggaattaaaaccatgcaataaatccatacaaataacatattttttaaaatctccatcataacaattgttatttactgagtatgtcacatatgccagtctttatgtggaaatgagcattttacaagtgcatttctttttctattcagaaaagttcactcctctgtggcacacgccaatattatacttaatttacggatgtgccttttgcccaaggtcataaagttggtaggtggcaaatcctgtattcaaattcagccaaatctgccatgctcttgaccacagctctgtggcaaatatctcctcccaccagggcatctgattctgtagccctgtgttgtgtgatagcaaatgatacgccaagacgagctcactcagcttcatagggtcaaaacctttccacatcactgtttattaaaacgtcctaaatgaagaatagcaataaagggctctgaaggaagctatcagtgacatccggggccttagcgtgtggtatgtcacccaaatacatttggacattatatcatggctgttgttttgggctcttgcccaaaactctgtgtgagacctcagacaaggaaggctgtctctgctgcactgagcactctgtcaacactcaaaataatgctgaggcagccacagcacaatgcaggaagggatgtccggggccatgacatcttgtagaggacaccccatatttatcactgtttcaagttcagatctgcatgagcaactgaaagcaatacttggactgttggaagaacaagcactgggatgggaatgagaccctccagccctgaaaccacaggccctgcccaccagccctgctctccagggtaggtgctcagaaaaccttcctggacttctccatatgatcctaatggaagcctgggggaagaaacatttgtcttctgaattttcaagttcatagtgcattcatttaattttttaaaaatggttttttttttgtcatggcttaattccttgctcccttttcttctcccagaaagtctgaggagatgaaacaactcatttgaaaaaggaagagagagccaggtgtggtggctcacacctgtaatcccagcactttgggaggccgaggggggtggatcacctgaggtcaggagttcaagaccatcctggccaacaggtgaaaccctgtctctactaaaaatacaaaaaattagctgggtgatgtggccggcgcctgtaatcccagctacccaggaggcaaaggcaggagaatcgattgaacccaggatgtggaggttgcagtgagccgagatcgccctactacactcccgccggggcaacaagagcaaaactcagcctcacagaaaaaaaaaaaaaaaaacggaaaaggaagagggatataaagtatgaagaaccagaatggaaaagcagcctgtgagaaccttccttaactccacgttgtttccctgtggattgggaacgatggagttgtagagagaaggggatctgaggggacattttaccactcctctcccaccagggtgtaccacacagatatctgccaggggcatctcacattggttcccactgtgtgctctgagacactcaggctttctcacaccttggctggaattcttttcctttccacctgtgcaggagagacagcccactgagaaggttctgcatgtgtcaggccgacattcttgctgtcatcaaagaccacaggggtcttacctacagggtgatgctagcattttcctgggtactttggattgctaagtcccattagcttttctgcttatcccaagtccccataccctcacctcttccccctgcatccttttgcatttcagcaaaaagcaccatcatctggtcatttaatctgaccagaaatcctgtttcctatccaccaggttcactccatttctttgccttgaatcagtacccgtctctccatttcacagggcaggctgccatcaccttatatgttacaaccccaacaagttccttactggctatcctactttgatctatttactcgacaaatacagagtccctcctatgttccaagaagtattttaagtgctgggaacacagcagtaagaaaataaaaacaagcaaacaaaagaacaccagggaaaatggaatagggagcaaagatcgtatcactaccatgaacagggtgttaagcaaggccaactgacaatatgacagactcgccttttcctaccctctgtaagcttccccctctcccccacattcagccaggatcatcttctcaagatgcaaatcaggtcaaatcaccttccagcttggaaatagccactgacagtttaaatagcagaggcatcaaattagtatttgacaaataaatgtgtaggttttattatcacagtgaatatttgcaatgactcccattttacaaaagaatacagtgacattcaacagatggtaaatagcaaagccagaattcacacctctgactccagagccggaaacagctggtgtggccagccacagcaggaagtgccacagaatggggcactttccttacagttgtccccggaggtgtgcatttcacccacatcatctaataattctcaccaaatgctccctggaaggatgcaaggaatacttaccgaagcctgaaatgaataatttaggtttttacaaatgcctgcccttcacctggaggaagtgtgcacagtactaaggtgcatgggctcggcaggctgactgcctggactcaaatgccagcttagccactccctggcccagtaaccagcctgggcctcagtttctccattaataaaaagaagcaaatacttgtagtaccaagatcacagggctaaggtaaggtctaaggtaagcactcagcaatgtgcctagattgttattttttaaactagtctctgaacaaatgttatttctctgaatccaacagtccacctgtcattgttacatttactagcactgaattgattcaatctcaagaaatgaaaaatgtggatttacttttaaaatatttcactctttactctagaatgacagccctaaaataaaaaactttcctgctgctgccatttaaaaatattattatccataaggtaaattcagagagattgatggtatggtcttgatgtgcctatcatttgggcttactgaggctggagaatgcccatccttgagaatatagaaaaaaaaatagtcaactgccttgggtgacaaagtctcatcacttgccccaacaggtgataacgtgaggatcaccaaacacccatccccaaggcaaggtcccaacactgaaagccaaaggtggctttaaaaggacgggacaataaccaagaaaccagggttagctgtcgaatatctaaaatggtattggcttccatgacatctctctatctttcacccctaactactctacaggttaccagattaatgtttttaaatataaaatttctaaaaagtaatttcagatgactaagatattaccttaaactaggacattttcattctagaaggggaaggggtacttgttatagtagatgaaattatgtttgaacagacagaaatgggctaaggctttttaggaataatttctcacagtttacttatgtaaaaagaggcaaaattctttgtcttttgttttgtttttgtttgtttgtttgtttgttttgctttacaaaacctcaatttgtattctctatctttgtgatttttttttcccctatacctccacacaatgatggaatgaagactgtgagagaaacaaaggtaattcattttataggagatttaatatttacagaaatgccagaagttcatcattttccatcttttctaaaaaagagagagcttcaagagagtttctataggacttatcaagtttcttgattttggttaccaatttaggggactgtgtaaaaaaggctgcctagtgaggtcataggacccaaaccagtcatatcaacaacatgaccttgtgacgttgaaattctttataggagctcataaattatgcctgtaggtaaaacagcctcaacatggtttggccagtgttttgagtacgtctcttaacgtgaacagtttagagatctttcttcttcctttatgttttgtcatctactaatcccacacccaccccatttttctaggttttgtgtattcttcttaataagtctgcacaaatcactataatgtagctgaaatcttaattttcaaattgtgcttcaattaccatctacatgaagccaactgggagacatgcctttgtctcttggagtttgtcaggagttagttctttgcatgtgctggatggaagttgctgccaaagctagagtttccacaaatgccaacaaaacaaacggttgctcatttatgcatccattatattacttaccccctaatatgtgtggtaattctggccttaaggagagcagaggagataagaaagacatttaaaggcataaccgaagatgcatgatagaaagcctcacgaaggaaggaaggacatcatggttcaatactgtggagggctcggaaagggcaaaggatacttccagcttcaggaaagacttcttgcaaaagacatcattagatataggccttgaaggacatttgacccaaagggaatgactgaaagaattacccgaaggcaagataattcagggtacacaaggaaaacctaaaaataggtccagatcagaagtctttgtcttaatcttcctgcttagcctttgagtgttgagacggcaaatatgggtttgacaaattaaccagcaccatcctttgatttctcactaagtcccatttcaaattatttcagaaaacagatgctgttgaactcataaggtttcaaggtttctgccatcacttctctcagttccttcttttagctaacctccatcccttgctgtaattttgagcctgtttcttctttctgcatccatgggcaataggtggttatcatggtccttactatgccactatcttccctctttgtccaactctccaatgccctgcattcctcaacctcaactctcccccacactgaggacctcacatggcaatgcagggtgctctgctcatgccaatgaaaagccagcaagggctgcctcttgaggcttgtgctgtccacatcttctcattcatgctgcccggaagtgcctttgacttttcagcaatgcctctacttggggtcgattctcttgactagatctatacaaagccagctctgcaccatcttcagctcacagtttgtcttttctcctgccccgctgagttcaaataattgttactgataacttctttaacacatcaaggtcataaggaattctaatcctttcctgtaagatgccagctacttctgagtgggttgtgttccaactcggtggttacagggactttgaaattggccatgtgtttaacatattgaacaaagacttagatcttgaaatgtgcatttatcctttcacttattttcttaatttgtgaattgactaccacttatggatcatgcctgtacatctgttttagatgtgggattttttttcaattcgtcatttgaattaaactctacatagtatgtcacacatagcttgcaatatgccagcatacagtagaacaattatcttttcctttgcaaatctgattaaaaatgagccaagtcctgtccttctgtggaatgtgtacatgtaatggggcagaggggtaaggagttcttttgagaaaaccaaagcatggcttaactatatattttagaaaatattatagagctttctacccactgaatctaatgccatggaaattattcaaatgctgacttgatgccaagggccatgcccattgagctcattacagaggaacaaaaaagtctgatctctgggtctccatactagagtcaagcctcacaattaattccatgtgtgtaactgtgtgtgcaggtgtgtacatgaggctcccttgttaccactgctaattatatataattgtatctacagtgttgtgacacttactatgaaccaagcactgtgccaagtactttacataaatggttcatttcaccttcccaataagcctattgtactgggtacgtactattattatccccatttaacagatgaataaactgaggcttggaaaggtaaaactcacataaactcaactccgtcaactccaaagttcaggttcttgactgcattgccattctaaatgtatacatctaagtcagaggcccctggagtattggctccaggttttggccatggctggaatggaggatgagttgagtgagctctacccaaggacaatgatagcatctccctcaaggtggtgagtaatgaaaaaatgtcccctggcctgtgttcaaaaggaaaggtctactcagctagtgccccagcccttagaaaggtcactcccagtacttcacaggaagaactatactactacaagtccttgccctgaaatatatatggctgcattatgaactgtgggacagataggacctagttttaataccagctttcctaattactatctgcacaatcttaggcaaggtaattggtgtccctgagcatcaacttactcatctgtaagaaaagaataaaaatagtatgtgtcggctggggggcgatggctcacacctgtaatcctagcactttgggagccaaggtgggtggatggcttaagcccgggaatttgagaccagcccaggaaatatggtgaaaccctgtctctaccaaaaatacaaaaattagctgggtgtggtggtgcgcgcctgtagtcccagctactagggaagctgaggcaggaggatagcttgagcccagggagttggaagatgtggaaagttgtgatcctgccactgcactccagcctgggtaacagagtgagaccctgcctcaaaaataaaaaagaatggtatttatttattaatacctagtagggttgttatgaaaaatatgttggttaagcccagtatgtgatctccattcagatacagggctagacatggcatctcaattatttcttatatggcaggatttttcactagtaacttttcatatattttacctctttagagcttttagttactaacactccattttattttattttaaatgggaaataggaacaagggatataagaagcattcttctctccagtaaatctacaaagacccaaaacagatccctattgatccatcagaactcaccagagaaaatttaccactccatatctgataatactactcccacaggctgaaaacagcttcaaagtcaaattctccagaagatatcatatctcaagcccaaagaagtggcatcctcctgaaacacatgggctttctaattcctgggacctattagtccctaataagaagaaatccatgtcctggaagccacctcttggatggttagagatttttgatgtgtacccaggccatagtattattgactaagtagccagtagcaaatttatcctcacaatcttttcttaagtaatccacataaaatgacccagtggttccagaatcttccaaattagacatactaaaagggagaggagatttttaactaatccctcacagaaccagttaaactcattcaccttaattactgtttaggccaagtgttgttatcacctctcttctctcatctgaaagctaaggaatatgtggcagggcttgggccagttccaattgggatgtagatctacatgtctgacttaaaacatggcccagaatctcccctgataatctcagagttctttaaacactggacagctggttgcattccttgaccacagcaggagccactctgcaaagggtatctcgagtcctggccatgtgctaggaaagggcctatgaactctcccctgtctctccccaagagaatgatcatcagctacaatgggaggacaacaggcaattcaaaaccaaaaccacagcataaaaagaccttgatctttttgtcctgtgaatcttcccttgagaattcagccccattcctcaattctcacctggatacactgagtcaagcatataattcggatgatatagaggcagcaatggcctaggagagggtccctttgggtactgcaacaattctgcagctggttggtcagctgacggtctttgaacacaccctacctctccccaaggtcttggtttcccagatgtcaacataaacaggctggaggtgatggccatcgaaggtcagctctgttcagttctggtggcctacagttctatttttatttattttttaaaataagcttatttattgagggataacatgcatacagaacatttcacacatcataaacggatagctccatgaattttcacaaagtgctcatacatgtgtaaccagtgcccttctccaaaactagaacataaccagcacccaaagccttcttgtgtagcttcccagtcacctcccaaaaggggtaaccagtcacgagttctctaacaccacagactagtttttccaattcagactttatgggatcaaatgtcctctcctttattgtttctttctctctcagcatgttagtgagattcatctttgtcgtcgtgttacaatagttcatgctcattgttctagagcatttcactgcctgaatataccagcctaaggcttaatatttgcagatgtcccccgccaattttatcctataatgcatgatccactgtgactgtcctgcaaaaaggcagaaaagcagaaccccctaaaagagagactttctttactgcttcctagggccatggatgccgtgttttttccaagtccatagggaagctgagagtcttctaagtggccagagatgctgaaagcaaagtatcaacaccatcagccttgtttaagcagcacctttctgtgcttgctactactccatgagatttacacagataagatcccaagtctcttagcaattttcaagataagatcccaagtctcttagcaaatttcaagctaaaaagacaacactgatgcatagagagattaccgatgcagacaagaaacccaatacataatctaatttaaagaaaccattaagtgcaaatgaaagaaaatacttcatgtgcaaaaggaagaataatggcattttgtggggttatgtcaggtacaattgctatcatttcccccaaacaattggtctgagaagaagtcacatggtatgctggaagagaaaggcactacagaaagaaacagaaactttaaatgaactttcctatttaagcaaacatagagggtaataagcctactggtgatacaaaaaggcagaagagttccagagccatcatctacatcccttgacaaggccaggggactttttggcatcaatgtgatgtgatttggcagccagcattgacaccgttgggaaatgtcagcctgaaaagaggctgttctattggacagatgtaaggccacgacttagcctcacaggcctggattactgcagcatactcttaactgggcttcctgtctccaactgtcagtccttccctccattctttgaactgaagtctaaaggctctcccccaaacatgaacctgatcctgatacactctcacttgaaatcttttcatgattctttattccctgcaggataaagtccaacttctttgtagcttttggggctttggggagctgacctctgattgctttaccttgctcatctctcaacacgctccagccatatggaacttcttatagttccttctgcctagagcacctccctcatggccttcattgggctacttctgcttccttgcaggtgttagggagctgccagtttctctggaagcgcttccccgagggcccctctattctcctgtagccccccacaatacagtaatcatagttaagatctcattccctgctttagcagccctggccagtgcctcaccctcatcccgtcagcactcaatagcacagaacttgtcaacagagtcctaccgttgacaccagcaattctacttgtgggcttcttcttggcatgccctgcacatacaggccaggagcaccagaagttaatgctcctaagagcatccctcagataacagcggaaggaaaatggagggtgaataacaaccctactatcccccacctccagataagctacttgtattcaaatccttgtctgaaggccaacttctggggaaacccaacccagacaatggcccatcccctagccagactgtgaattcagtgaagcttgggactaatgtcttttcatttatcagtggacagcagccatgcctaccgtatgtctggcacatagtacataaatgtttactgaatgaatggtaaacattcaaggaacccttgtttcattcctggttttcgactcaaaggcaatacagagctcagcaaagagcttcggctctggagtcaaaagaccaagttcacttcaaaaggtggaatcctccattcctgatgggtgtgagtttgggcaggggtgggtaacccacctgggcctcagcttcctcttcttgtcaaccagggtcatcatgagactcaaggagaactgtttaaaattgcagggagttacacaaattaaatagtgtttattttaggcattcatgtaattctttgtgactaaatatggggaaagagattttgttctagataacacaagcacttgtggtgggaagaggaagtaaatgaaaattggggctgggtaaacagttaattccacttggagagcctttagaggcagagatctctgttttgataaagatcatttaaattccaaaaaagaaaacagaatggaaatgagaaagtaagtttttaaaagtccagaaataattgctaactataaacagacataaaagataggtacatatctctatgtatgtggagatatgtatgtgtgtatatataagtatatatatataaaacagcagacatgtaatgaactatattaaatatgaaaatcttactatgtttttccactttgtttttgtcctttaacagcttcagaattctaaaactcaaacacatgtatgctgagaaatgtctgagatgtttttaggtcaagctaaaatcaaatgtcatctcataatcttataatcttcataaaactgcttttattttcaagacatgcaaaaatccatattaacccatcaggcacaattttgaatataggactcgaatgaaaaattagagtgtagtcaaaaacagtgaaattcttatttgtggtcaatactgaatgaattaaatgtcttttgacatctttttaatttaaggaccagctttaagaacaaaaattcagagatacaaggaatccagattcatttttctgccctttatttaactgttttgtattctagtggggaaaaaacatggaaaaatctgatccaccttcctattgattagcactctgcaagagtaaggagtatgtgaacatttttactccagagttctcaaagttaatctttcaaggctgggctttctctccagaccctcacccacgactgtgtatcttatgtattcatgcacatggaggacataaaatacatgtcaaacaaaataaagcaagttattaagtacaacaaacccctaaatcttggtggaagtcaacagataaacagactataacagactataatagtctaagtacacaatgcataattcatggctaaaccaaggctaggcttgtgcaatatttcaccagctcccctttgcaatctttgaggttaagactgggtaaattgcactgactgctaactcagcaaaactgaaaaattagaaaagaaacccctaacctttccaataatgggaacaggcaagaaggcagagggtggagaaaggtattgtttagctctcgaagctaggcatttaaaagtcactgtgtgcctagctctcaaagctaggcatttaaaagccattatcttattaatatataattttattgttgacaaatgtttatttttctgctaaaattaagagagcagatcacttcccttcttacacctaatcaccagcccctgtgctcagttcacaataggccttcaataaacatttgtttaaagaacttccttttgatttccatttgttgtctatggaatgtagcaatgaaatgtgaaggtgaatatgcaatgaccaacaatagtaatggaaaggtgaataaaattaagcacctcaatgcaatctggatcccggacaacttttccatttattatttcccaaaatgtagaacaaatgaatgtgcatgaatttcccaaagctaagaagttgaaaccaagtccttggcagcacttcaatagccacaaatgaggctctattccattaaggaccaccatgtcttccagggaatagagagctggtggattctgggtgtagagtacagtgtcatttttagcaactaagaaatgagagagggaagacaaatgtcaagtcagcaccagcagaaattattgtgtttcctgacaacgggtgaaccatgcctggtgatgctataaccctgagccctggggagtatatagattggtccaaatagcaatatttgtgctaagataactgtggatgcaatttatttacttattttattttattttattttgagacagggtcttcctctgtcatctaggctggagtgcagcgcaatctctgctcactgcaaactccgcctcccaggtttaagggattctcctgccttagcttcctgatgtagatgcaatttaattcgttcaaggtactctgcaaatatttttaataatacaaattgaaagaatgctataaacacaaaaaggtgagaactcctggtttagccttctaagcaaatagatttaaccagtcattaacatccccttttgaatgtgttgaggttgatggttatttgctgatcaaaaaagccaggtgaacattctaattacagaatgtctgtgacttatagtcactgcaggactgtttttgcctaagagtaagcagaaaagatactggttctgcaaagtttttattcagtgctatagggaaggtttctttcactgtttaaagtttagaggggcagtgggagacttaaaaaagagttgttatgattatttcacaactcatgttattttgacatattgatgatataaatataatagcagattgcattgttaataagaaaattaaaattaaaaacaaaagagcctagataaagcagaaataatttacactgaatctgttaaaagggataacacttcacttcctatgaaaaatcgtattatttagggcccccgtctacacctaatcaagttacttaaaacctcagtacatcactaatgaacaaagagagacagagagcaatagaaaaacttgaatggtagctcgaggctttcatgaaatttaaaagatgatggtgagtggaaattttaaaaatttggatgtgttcaagtaaaatccctgtgtaattgcctagatatagaaatagtgccagatctctgcaacataggcacacagattagaatttctttctggacctttaaaataagcattaaaagcaaaaccatgtacctttcacaatatggaaataaaaactagtactctcacaaaatgtcccttctctgagttgcactttaatgttatggcaccctcttttattgggagtcattgtaggagacagtgatatgaaaaccacatctgcatttgctggaaagggctgtcaaaggaattatccattatctatagaaaatcacacataagaaactccttttgctatctggtgccaggaaaatctttatctctagaaactaatctgtttcctcctttctaataacaagaatgatacaacttttatcctgtttccctttttgctctggctgccagggagttcagggccaaacttgatgatcagtcatagtaattataatggactttgtggctagaggaattatttcctcaggttttcatggcttttattttccatttttagttgtattaatcatgttttatgtgtccatgtgtgcacacatgtgaagacttggttttaattgtaacttacttcaagtcctttttggaaaacaatgaattatgtttatctcataaaagtaaaaaatacaagagatgtatgtcaaaatatgctttttcttggtacaaatagctttcatacctgtgtgaaagcatacgcattttgtctttctctttggggataactacttctaaacaagttatatgttagtcaacattatacccagacaagctttcttctgcttatggatcatttctttgacaaaataatacatccttatttatagttgataccttccagaaaattaacaccataattttgcaaaactttgttaaactcacagttatcatgaggtccttaaagttggttctgatggtttggctgaattcacagaatcactgtacaggattcatttacattacatttaccaaatgtttgaaatggaccatcatgtcattttcactttgcttcaatgttttcttttttcttaggtaatacataggaaataaatggttgatttgcttcaaatggtctattttccttccctgagcctgttacattagccagcttacatttaaacatattttagtcatatagattttccactgactaataagcaaaacacagctttttttaaatcctaaaaaaaagtacattaacgttctttcaaattattgttttaaaataatgttccacattaaattcccaagcttgggacaaaccggaaagatcccctgagtttttaaaccatattcatttccctgagcacaggggctctgcatcctggatggtacaatgccttcagtgcccctgtcagttggaatttaggaagtcatttctctttaatggttgccagacctcctggataagctggggcaccttgctttgccccagatctccattgagaatggaaccttcctacttactttcccttcaccgtcataagaacactgggatcctgctgtcataaaaccgttttgacccctgaatcataaagctgtacattaacagtgggattgtttgcaattaggtaactgatccttttccccgtttaacttgagtcagctcatttgatactaacatagtgcttctgtaactccacctctccacccgctgcctttcactcccgacaggtctccaagaatagctgggtggctttgttcttcaactctgtacgtaaccaagaaaccaaaaccatagagggactggatatcagctcagggcctagaatcagacaaagccccctcagattgaatctggggactgccacttcctagctgcatgaccttggataagtgacttcattctgtgaaacctgagtctcctcatctgtaaaatgtggacaccaataacagtacctgccttatagggttgcttcatcattcagcaaataattacccagagtacctactattggccaggaactgtgccagggaccagaatacagtcagagcacacagggttctacctcatggagctctcattatagttgaggagtcacaaactaagcaaacaaatgaaaaatgcatagttacatattttgagaagggctccaagtgagacagaattctttggtgagcaacagtgagaagttgtggtggttgaggggggagggtagaaagaaatcaaggcaggcctcttaggcaagaagcatttaaattataccggcaaggctatagcagaggaagccagacacaggacacatggaagggaatttcaggaaggcggaacagcacgtgcaaaaggttcgaagcaggcaaggcctggctttgtttgagaagaaaagtgaactattgggccttcggtggactgcatgagaagcagaaatctcaaaagtgaggttggtgaagctcatcagcgatccaagacacaaaaagacttgatccagagtttagaacagatcagaagtcgaggaattacagaactgcagtccatgggcccattgcctgtttctttttctttctttttttagatggagtctcactctttcgcccaggctggagtgcagcagtgtgatcttggctcactgcaacctctgccccctgggttcaagcgattctcctgcctcagcctcccaagtagctaggattataggcttgtgtcactacgcccagctaacttttgtatttttagtagagatggggtttcaccatgttggccaggctggtcttgactcctgacctcaagtgatcttcctgcctcggcctcccgaagtgctgggattacaggcatgagccactgggcccagccccactgcctgtttctatgataaaaattgtactggaacacagccacacccatttgtttataaattgtctctggctgagttcacactactcgcaagcctaatatatttactatctggccttttaagaaaaagcttgtcaactccgaaacagtaaacttcaataactgtttaaataaaacaacaaccaaaaggggaaacaaaaaggccattttttttcccacatatgtgagagcaagtaacaggctttaattcaaacacctttgagaaatggtgtaaatgaaaatcctgaaaacatctagaatgtaagactattggaaaattaagatgaacaaacttaaaatattttaagacttttcagaaattatttctattcatagtgtgtacacattaagcatatgaaataagacacttccagcattgtgtctgactagatgctaggaaaggccctctcaaaacattttttattgcattgctgggctcataggaaataggaaaaccctcaaatgaactaaaacaaacaaataaacaaaattccaaaactgagctgaaacaagaatggtatgctgaaagcccacataaatagcagaggttgctctgagcacaaacaccatggtcatttgtacaaccgagagactcagccagtggcaagttgaaagggcttaacatgaaagccctgataaaccaggattcttaaaggagctaggtgatcctagattgatagcagctccctgctcccagaagaagcaaaagtaaattttctctgcagaaaaatatctccatttcagtcacttgcggttcccactaagatttgtcaaatataaattcccccagatcaccaagcatataaggaaaccagtcaccagtgagggaaagatagtggaacagacgagaataagtgcaaatttagatatacatccccaatggctttggatattagaattattaattaactacagaatataaaatggctatgttcaaacatgcatattatgcatatatatattacatacatatacataataagtgtgtattgcatattgaaattttgctaagagagtagattttaggtgctctttctacaaaaaggattagaaataaaataattaaatgaaaaatgagcacgcaacaacagactatcaaaagttactagaaagatttgaagaatccaaattaaactttggggaatgaaaaaatataattgttaacctaaaataataaatgggtttagccacatagtagacacaggtgaagagagaatgagtgaactagaagataaaactagagaaactagccagaatgcagctcacagagatcaggggagggaaaatgtgaataggacatcaagcaatatggaggacagaaaaggaaagtctagcacattcataattagagcccataaagagagactgaagacacagaaagaaggtaatagatatttgcaaagataatggctaataattaaacagaactggtgaaagatataaatttatacatgtgtgaagcaggataaaataaaattaataccaatacattgcagtaagaccacagagcattaaagaaaaaagatcttagaaataatcacagaggggctgggtgcagtggctcatgcctgtaatcccagcacccagcactttcggaggccgaggcgggcagatcacgaggtcaggagatcgagaccatcctggctaacatggtgaaaccccgtctctactaaaaatacaaaaaattagccaggcgtggtggcacgtgcctgtagtcccagctactcgggcagctgaggcaggataatcacttgaacttgggaggcggaggttgcagtgagccaagaccatgccactgcactatagtatgggtgacagagcaagacttcgtttcaaaaaaaaaaaaaaagaaagaaagaatcacagaggaaagatagccacttaaaattagcccaacagccaagttttccacagcaacagtggaagccagacattagtggaataacatgttactgagagaaaataactatcagccccaaattgggtgaatcaaggatgagggtaaaagaaggacattttcagagaaacgaaaattgaaatggtttatcaccaatagacctacactaaaagaatttgtaaacgcataaagaattataagccaagaagaaagaaggtatggtaaaccaagaacattatttttaaaaaataattttataaatgctttagaattaactatacatttttaaaaataatgtccaatttattgctaaaaaaataaataataaagtactagacaagaagcgcatgtacgtaagagggtggtacacagagttaatgtgtgttctcatctctatataatatggaagggggattcatcggtcacagtagcagggctagtaggggccatgtacagctcagtcacacagctttttactcaccaaagctgatccagcaaccaccatggctcaatgtataaagtgctactgcaaaggccaatgctgagttcctgtgtggactaactggctacctagtgacacattgatgacacttgacttctctgactttgaagagggcagtaccttgatttacataggatagaaacattgtgtgtgtagattttccttcttttccttcggtattcttccaggaccacaattcttatatatatatatatgccttatatatatatatgcatatatatatatgccttatatatatgcatatatatatgccttatatatatatgcatatatatatatatatatatatatgccttatctatcacacggcatcctacacaacatcacctccaatcatgggacacattttaccacatgcagtgcatcaaaggatccactccacagaagttctggtttagtaacagctgagtgacaacacacaaagaggttaggatactttcctataggaatggaggatgtgccttaaatcagaggccactgtatggtgccatctctcccatagtaaggatgcatgactggaaaaactgaggaggatgtgggagtggcccctctcacgaaaacacctaatatcttgttggaataatgtttgcttccaccagagaacattatcatgatgtgatgaattagaaaccgagactgtcctttggccattttgggctcttcgttccattgacccaacagtcagagtaggggtcaccattactgctatataatagggataaggaaggcaatatgcataacccagggattcactggggtgcccttaaacaaaagtcctggtcagtgaaaacagtggtaatccaatcaagttaaagccatcaaggaccgagatgacttccattattgaaacaagatggaagatggaaatgtgattactagtgagagcttgtagtcagttatagagacaggggctatagcagctttctttctttctctttcttactcttttttctctttctctctttctttctttgtttcgtggagtcttgctctgttgcccaggctggagtgcaatggcgtgatgtcggctcactgcaacctccgcctcctgggttcaagcaattctcctgcctcagcctcctaccgagtagctgggattacaggcacgtgctaccacgcccggctaatttttgtatttttagtagaaatggggtttcaccttgttggtcaggctggtctcgaactcctgacctcatgatccacctgcctcggcctaccaaagtgctgggattacaggtgtgagccaccgcgcctagccggaagttatgttttaagtcaccactaagtgacttttttctccccttctgcccaacttctaccatataaaaaaagacaatgctcatgatagctcgtgttttagatgtatggccaaactgacattatctcacaatgacacaagacctaaggtgactccacacctccctcgtgttggaagcaccaacttttcatcttgatgaaaaacaagagtagaggccaagaggcaaatgagtgaacggcactagatattgtccatttgcccttctagatccatctccacttttctctccttgctttcttccccacagggtgacatatacaaatggcagcagagagctctgcaccctcaggcttccagcagagttgagctaatagcaggagatagatgtaggaaggaaagtggggtcagcacatttatttccctggttccctcccagtaagttcacctcagactggctgtgtccctcaaaagagggttactatccttcctaatgcagctctaggggactctctcttcttcaagggtctgaaaacctctccttcttttgtccttttgggcctagaagcagtgacatttctgctgctgtagcactaggttcttgaacaacccataacattcccctatattgtgcccacacctttggaattaatccctttgtacaaaattgcttcttgaattatctcaagttgaaatatctgtttctattgggacctgactgacccattcactgtgattacatattacttaatacaatgtctatgaaccaacacccatacaaagagattttcttaagacgcccataaactgagagacctgggtaattcccggacctgggtaaagtcccaggaaattccctgtggactcaaaaccggttaactgtttggaagcacctgaagggctcagaaaaactgtttataagaatattttctggtaaccagggagaaagaggtccaagagggatgtgaaaagtcaggtgcatgcttcttctggttgtaactcttgaacaatttctatggaaaaccaagagagagccaaaggtttgtctaaaaaccaggttactgagttaagagaaatattaatccagcttagtgttaccttcttgcaggaccaatttccttaaaacaatttgaatcatttgaatgggtatgaatttataatcaaatgaccaactgaccagatacccagagggaatcctaatatttctggaagaaagaggttctcgaagtgagcacaggagcatcacctggaagtaggactggctataatttggcagggcccagggcaaaatgaaaatgtgggacccttgttaagaaattattaagaattccaagacggtgatagcagaaccattaaaccaagtacaaggctcttctaagtgcagggccctgtgtgaccacacaagtagcccacccatgaagcctgccctgcctggagggtttgttacaacacagactgggagccctgctcccagaacttccgatccagtgggtctggggcaaggcccaaaaatttacattcctaacaatttcctgggtgctactgatgctgctgtttcagggaccacactctgagaactaccaccctagataatatagaatacagggaaaaagaaaacctcagaataaaatgaacacatgaccaatgtatttagagcttaagctgaccaatctatatggattttgtactgaatatcacagtgtatatctacaattcataaaaaggtaaatgtactcaattacaaatttatagatacaaatttaatatcctgaacgttattaactgcctgtatcacatttaattattccttttcccaacaaatgctttttgtctactttatgccagggtactgtgcttgctcacgcattatgtattgaataggtcataaataaatgaggatattatttagaatagttatcttgagtataggggacggggaggtatgaagttcagatagggagaacacccagatagggaaattaaaatgtgggaatgctatgtcattttttataagcacaaacctattagaagcctattaagaaaatataccttgacaaatattttgattttgataaaattgatacataaaatagaacaagcatcatatctcagtgctttttaaatggtagacaactcatttcaagtaaggaagaaatatttggttttcatggttacctacaaaagtttattgagaattttaaactcctgtcctatattgaaatactcagtatataaacacacagacaaaatcttcagaaggtttcaaatactccacttggaataacccaagttagttgttaaggaaatcagcaagtttagggggaattttttttttctgaaggattaacagaaagttagatatccttctatgaagatgacactaccccactgtcacttacaaggtcttacaaagacactgactgttttcacaaacatctccagcatcacagcctgcaagagtccatgccagcttcagtgttctggtttctcttcctgaatatacggtgtagttagctattgaccgtatatcattacgatttcaaagaatgaaaagttcgctcatgtggaatgtaggtattcttgacctctgaactccattgttctgaagctggggaaaaatatgagtatggtggtgatactaaacaaatctgataaggtcatgcttggcttcaaaggaagaccagtaaccaagtgcacaatagcctgcaatttccagtatattcttctctctaagccttgagtgttgataattaacttcctactattctaaactgaatttattgctttttcaattgcaattttagtaaaattacataattaaaattttaaaacttattatatgatattcaaaaaattaaataagtgatatttttctcccatggcctccctacctcacacttaaacataacgatgaaaatttatgtaccatattacaagggtttactgggaagaacattaatgaagaataccaagaaaactttatgctagacttctaaaacataaaaataaacacaggaactccaatttccaataaaaatgctcaaatcaagggcatttcaactgatgaatatttactatgagtttctggtaattttttttttttgtaaaggcatcatttttttttcaagcaaagatcaaagaatattttgtatctggtcccctgttgatttatatcagtttaactgccaatatttcttaattcagaatgaaattgcacagagctcaatttataaatatttatgtataaagttaacaactgtgaactgtagtggtgtgtcaaactgtaaacacagtcatggaatattggttcattttgagaacagatgttatgctatctccatcatgggactgattgcaggagaaacaagtcatgatttagtctcttgctttttagcaactttcaaaacaacaggtaaatctagggagagcaaaacctgacacttcagtccccactttccatgcctgccatagtgacagacatcactaatttatcctagaacttcctcagagctcagattacccttggtataattttcaacatgtgctccggcagtcactgtctattgactggaagttatacaagattcaagctattttctctgtatttaattctcgtatcttgcagtggttctcaaaatttttttatgtgtagtatattttcaaatattagaaagtctgtagcattctcaaagggattaagagattgaaaacaattataaataaatttcaccaacaataataatcgaatccctctcacatcctcttggtctagtaaagtggccacaattatctggttcattttgtatccaagttaccctcaaagggtaactttacagcttggctacaggcctgcatttactcacagagtaaagctcccatgtacccattaaacacattcctttgggtcctcctggtggtctgcttaggagagtaaactctactgttaagagaatggggtgagatgcgtcggtttgccttagaaagaacattttggccaatgagtgttagcctaaccccagagacaggatgattaggagtctactggttgtttgctgtgaaaaacaactaggtatccctgttttatttgcattatttcctttaatcctctcagcactgctgtgagagaactgaggttcagcgaagtgagttccttgccttgtgaccctaagaagaactgacagagccaggactctaatcaggagatatggctgacttcaaagccagtgtgctaagcctgtctgtaactccgccctccggtgactaacagaatccagggaccttccatagcaggaatggatcttaaaaaccaacagccataccccaaaatgaaatagccaccatcattcttttcactgcttcagtccgagttggttttattgagggcagggaatccacttcctgcttggaccaggtacctgaaagcaactgttcttctgcttgcttcaggaagtctttctgaatcactggtcttccacttgaagtgtggcaactcataggagataaagcagatgagagggctttgtaaacattaaaagccacagtgccacacaatatgaattagtgtcagaattacttaaatttagccctccaccttcaaacaggagctatatttttattctcactttataggtgaagcaatggaggaaggaagacagggaccctactaacctttattgagtacttactgccaatgctcctctagacacgacatacatgagatcatttaattctcacaacaggcaccaagtgtatgtttttaattccttctgtttaatttttattaccttgtcacctactatatgttttccttatttaatttacttatcatctgtgccctccccatcccattagactcttccttaagtgattcagattttggtctgtttcatttactgctctatctctaatagtgcctgacatagagcagatgttcaataaatattagttgagtaactaaatggaggctcagagagattcagtaccttccctgaggtcacacacttggaactgagccctgtgtcatctgtatccaatcaccatgtgaacactcccagctctgaacctggggttgctcgaatgattgacgagtcccaccagcaagcagaagactgaggacagtacagccacatttggatatcacttggcattgcatttcacaggaaaaaattgtgacatttgtcacaggtagggaggggtgctaccagatgtgctctgaaattattgcttattcacaacaacaacaaagatagaagtttagcccagagatagcagacagattctagatttggaaaaccctaaaataaatggtcctgatcggattacacacccagaaacccagctcacaattcttccttgatactttcctcctagtctttggcccctgtctggttcagatgcctgtaattaaactcaacagaaactgaccaagggcctactcacggccactttttgtcacccacaggtgggaactggggaaaatgttctgaaatattgtctactatgaggagaaaggcaatgagacactaaagttcatatgaagcattacaaaaatgatagagcatacaatagagtgctgaggaaggaaagcctgttatctaaaagcttaaagaagatatgaggggctgggtatagtggttcaataatcccagcactttgggatgccaaggtgcgcagatcaattgaggtcaggagttcgacaccagcctgaccaacatggtgaaaccctgtctctactaaaaacacaaaaattagctgggcatggtggcatgtgcctgtaatcccagctactcaggaggctgaagcagaagaattgcttgaacccaggaggcagaggttgcagtgagctgagatcatgccactgcactccagtctgggagcaaaactccttctcaaaaaaaaaaaaagcaaagaagaaaaaagaaggaagaagaagaaagaagaagaagaaatgagagaggagggagcttgtgatctgggctaggaagagagtcactgtccaaaggaaggaagaatcacaaggtcaccaccaagctgaagcagaggaatcatagattccagaggtctaagcaaaactcagaagcaatagaattgagccccgggattctcacccaggggtgattttgctacacaggtgacatttggcaatgtctggagacatttttcacaactagggaggggtgctactggcatccaatgggcagaggccagggatgctactaagcatcctacaagacaaaggacagaccctacaacaaagaattgtccagcccaaaatgccaatagtggcaaggctgagaaagcttgactcgaaaatcataagctttgaaggccaacacacctgagttggggtcccagctctacccctaagtagccaactgacgttgggcaaatgacttatcctcactcagcttcagtgtgtttatctgttaaatggcaaatgctagtggtaactactccacaatgatcactccttcattcagcaggtatgcctaaggggtctcctaagtgtggagctaaacgtggaatttgggcataaaagcaatcaatgatactaaagaggtagaggtgctactgaagagatacatgatggctaaagaagctccaagaaggatcatctaccctacacaagagagatcaaagacttcctggaagaagtagcatttaattcaacatgtgaaggacggtgaaggatgactcagataaagaagagtggattaaatgagataacaaacgatactcatcatgagatgtatacattgcaccaggcactagagtaaaagtttctcttcttcctaggtacttggctccttgtttagacattttctaaacttcattacagttgatatggctgtgagactatgttcgtgccaatataattgagaagtgatgtgttgatttctgggcctgggattttaagtcattgatttcccaatgacttctttttgttccttcctgaatgcaaaatagggaagtggcccagacccaacttcaaccatgctagggcaggggtaagcagagttcttctgtaaggggttatatagtaaatattttcagctttgtgggtcatatgaacactgttgcaattactcagctctgctactgtagcacaaaagtatctacagtatacaagtgggtgtggctgagttccaataaaactttatttgtaaaaataaaattaaaggactggatttggccagccgcagttttctaatccatctgctcgagatggaggagcaataagatggaaggaacctggatttatgatggataacgtggtctagaacttccttatcaacctagactccttcctttggaattgttaggagagaaagaagtaaatatatgctttaagccttataacttagccttgccttaactaacacatgggcttttcaggcttctttgggcttatttagactgtccttggaacccaataattatgtacatataatagagtcttccgctaaaatgacctctgagcatgaggcttttggaagtaaggctgccttcaggctggagggagctcatgctttagcatcaagggttgagggttaaattctcagcactcattccccatccagctgagtgaagtaaattggagacatcgtcatcatttcaaaattcaaggtttatagaaaacctaataaatcatctaagtctggcttcctgacacctactggtgtcctcctggaaactcccctctaagtaagtggatggtgagtgcaccaaatgagatgaaagagcagacaaactctgggtgcttgccggcaggtcatgctggctcaatggggcctagtgacctaaaataagatgaaagtagaatttcttgtgggcctctggaccaaactcaatgacggcgttaattatttctggtttgcctatggctgtttttgttgggaaagtaggaatgcaaaagtatcccaggcagatctttttccaaaagagtttgaaacaaagtgatcacaattctttttacagtcacaaaccatttacatctgtaactattttaggtaaccccaccttcaacagaaagtaatcattgccaattctaaatctctagactatgacaaaagagagctaaaccagtcagaggcactgggagaggagggagggttggcagtgccaagatgtttccattagagggaacttaaaaagcatccagtttagtttgattctcccatttcacagatgaaaaaattttgactcagagagggtaaatgttcaaggtcaaaaaacaaaataatatattattataccataattttatatatatatatatatatatatatatatatatatatatataacgtataactaaacatatatatatatatatataattgtgagagaatatgactctactagtccttttccccttttgttttctatattgaaaagatccagaggtaaatgtggatctcaactttttaatcaatttttgtgaccaaatcacaaactcttataaaacttggagttaataaaacctccagaatattgatttatttattaacttcacttagttgtctactaagaaaaatggtatgaacaagtaagatatttatacctggtctggtcaaatagcagctatgtcccccagtgcagtctttttaaaaaaatcctacagaattctatggctttcagaaataagatggaaaagaaaggaagtactagttacatttagagtcagatgtaaagatgcatcataaacaaaattcacttttctgtttcaaatatccctgtaccttttaaaattgatatataatatatgtacagtgttttggaatacatgtggtgttttgtggcatgcatagaatgtgtaacgatccagtcacagcatttagggtatctatcacctgggaatttatcatttgaggacatcagtctaggcaaggattatatggctagtatctgaaaaacacaggcaacaaaaacaaaagtagacaaatgggactacattaaactaaaaagcttatgcatagcaaaggaaacaatcaacagagcgaagagacaacctgttgaatgattatctcaataataatactatctcagtagtatttgcaaactattcatctgacaagggactgatatccagagcatataaggaactcaaacaactcaatagcataaaaattttaacttgattacctccgtaaaacaataagaaataaaataaaataataaccccattaaaaagtggacaaagaacataaaaggatattccccagcacttttgcagggccatttgtctatcaacacaaccaaagtatcaaagtccccactgggcttccctacaagctggttggcatccgtgcctcaaatcacagaggtttgtggtaagaaattagctggaacaactgctggccacatttttgatcccccaaactgcagggaaaatgcatgtatcaagtgttttcaacacattttcagatacaccaaatatgttacaataaagagcatctcaggtagaggaaaacagttttgttagttcttgagtctagtgtcaaaggggcagggaaggcttacacatgaaaagcaaagatgtacttcacattaaataatccacgatgacaagattttaaggagataagtccttttcttcacaagatatgtttaactcactggcatgtctacaaatcatcaggcaactactgtacattttaaaaatccatcttagtcctccattcatgaaaacattttcatattctgacatgtgcaaatatccctgctccttttttttcttttttggttacacacagaaatcatatcatagaagaaaatccaaaatataaagataaggaaaaataaaaacaacaaactataatgtcatcaacccaaaataaataattttcagacactggtaaatatccctccaaatatttctatctttttctctcatgtcttattcccctcttctctcctccaagtatataacacacagacatacacatcctaaaatgaatgcacactctacatagtaacctgagtttttttcactcagtgatatatgtagaaggtctctctctccctctttttttttttgtttgagacggagttttggtcttgttgcccagccgaaatgcaatggcatgatctcagctcactgcaacctccgcctcccaggttcaagcgattttcctgcttcagcctcccaagtagctgggatcacaggcatgttccaccacactgaaagttttgaactttcagtagagacagggtttcaccatgttggccaggctggtctcaaactcctgaccttaggtgatccacctgccttggcctccctaagtggtgagattacaggcgtgagccaccacacttggcctagaatatctcttaatgaaaataaatgcatatctatatgataccttaatgggtatattgttgttgaacaaataagagatgtctctccttccctctagtatcataaatgattctttaatagatgtggatatccatgtacctagatctttatgtatctgtctagtagtttccacaggctaaattcataaaagaatagtcacaccaaagaatataaatattttaacgtttcagaaacctacaattcccatgttaggaggagtgctgttcagagctgtcagaaagaacttggtgatacggaaaggttctatatctgcactatctgatacaggagccactatccacatgtggctaacatgcatttaaaatgccattaggattaacttttaatttgctttaattttaatttaaatagcaatacatggctaggggccaccatattaacatcacagattctagatcaagtcagtattacttgaacttttaagagtaaatgtgccatatcaagcatgccttttcttaattaatcccaaacgcaaccttgacattaaagaacatcatctttcctatcaaagagcttttaggtactctctctctcaagtggtcttcacagtaccttctgagaaaacaagggcaggcgttatttttttccatttcatacatgatgaaaactggagatcacagaggcaaagtaattcagagtaagttaaaagaggcaaatggcacacagtccatgttttcagctctttgtccaatgttctttgcttataaaattagtctacattacctgagccttacacagatggagttctgccaaaactgagctcaatttcttgccacctagcctttgcctatgtggttcccactgccagggatactggtcttgttcctactcctttgcctacctacctgctctttatcttccagaaatcagcttagatatcaccttgcttcctccagcaacctttctctgactatgcacccccaaggcctgtgttacgtatcccattctcaaaattctgtagcattctattctcaccctaggcataatacatttcttccttcctcacaattgcctatttgtcttttttaaatttaatgttattttattttaagttccaggatacatacacaggatgtgaagctttgttacataggtaaacgttacataggccatggtggtttgctgcaactatcagcccatcacctaggtattcagctccacatgcatcagctgctcatcctgatgctctccttcccctgcccaccccacaggccccagtgtatgttgctcccttccctgtgtccatgtgttctcattgttcagcacccacttataagtgagaacatgtggtgtttggttttctgtttctgagttagtttgctgaggataataattgcctatttctttatctgaaatcggaagctgtgctaaagcaggggccatgccattcttgtttacttcaagaccttcagcagctagcaaggtaccttctcccatagaggggacctcgacaaccacttgctgaagcagtaaataaaagtataatagaagaagggacccccacagcatgtttgttatcaaagagcaagtattctgaggttggaaaaataacttcaaataatccattaatgtgatactcaaaagaatacataatcaattataaatataaactaatccatcacgcaaatacttgttgtgtatccatgatgttccagacattggattccagattccaaagatacaatagagaataagagagtcacaattactgctataatctgatgaaacaggcaatccacagggcacccaactacaagtgggaggaggtatgatgaatgagcttgagagggcaatcaaagagaacaggagggaggatctacttaaaagcgggggaagggagcattccaagcacagagagtttgactattttattaaaagcttggtaataataaacacaaaacccagggtcatgggtgtatctcagggcaaggcacacaataggagagggggaaaccccacacagacataatgttataattaatctgctgactcttggtgtgatggtcagtttgtgtttgtgtgtacgtgtgtgcatgcatgtgtgtgcatgtgcacgtgtcttgcatgctgcctggaccaatgatgacagtatggcatgaatcaagtatcatggtgaaattaactccataacctaaggtccatttgaaagacgaatgagtgccaggcactgtgttaagcactgtacactttcttatttcaattctcataaaagtccaatgagaaaatactgtcattatccctattttgcctattaagaaaccgaagcacagaaaaaccaagtaccttgctaatgtcctatggaaagcaaatgttaggagttgtaccaaggcagcttgactccagagccacagtcttctaaaccactgctatacaaaccttctcaggctatactagttcggttacctatgcgtccaatacagtatagctaggttcctcctagccacactgggctatttaaatttgaattaattaaaattgaataaaatttaaaattcagttgcaccagccatattgcaagcactcagaggccacgtggagcaagtggttaccctcctggtgagtgcagatggagaactcatcaccacagaaagttctactggacagccctggcctacatgattgcagaatcaagaacatagctcaggtcagctcattccttggttctgtgctcgttcccttactccacactgcttctcagtgatcttcacagtccttacagaatctgtgctcaggaaggtcctttgaaaatctgccctgcactgagctggaaaggtacaaggtgactgggaactgtctgaccaggtagccagctttctatgctagccttcttctcagtactggctattttttccctaacaaatgaagaaataaaaattatgtaacacaaaaatgttcagcatgtgtaaatagttacacaagagaaaataaaaggcttgccacaacaccttcaaagagccagccttaatatgaatgccaaatttttatcattccttcaaaattatttctcctattaaatgcaagtccctccattaaagccacattggctcatttagtcaaccactctcctagccttaggcagcacacacttttcaacttcttctcatgtaaccctcttggctactgggaatgctacaaaacccacttcaaagcatgtgaaaggcgggaacaggatctacatggccaaaaggaaaagattccagggatgaagtaagatatgaagtttggagaggaagatgaaagcatttataaacatttttgcaaatgcattagtaccagcaaattgaagatgaaacagaatgaaaaacaaaaatctaagtgtatctctggcattccaatcaaaaactctttccaggaacctgattattcaagggtcccaaaattcaggaagatttaaattagaagattttggttcctagacatgcataatccaaccttcagggttatttcatgtacattttctccttttgattttcatgacaatcctatacgatacacaaagccagtggtaatatactcattttgcaggtaagaaaaccaagacgagtcaagtttataaattgctggagaatccacatatgatctaggatcaaaccaagatttcctgctgccaactcggaagagtttttgctctgctgtactgcattttaactttatttttacattttgaagtatgaatcacattctctactcttccctttctgttcaaatagggcttatgtaaagaaagcctttgaaaaccatagctcaggcatgaaataactagggaaacagaaatgttggctgaggtggtcaatctttctatagaagtagttacatgacagatgacaagttgtaagatatatgtggggtggtaaatgtgggctatttatttacaagcctgcatgaaacctggattaatatatggctctagtcactcttctccatgttccacatgaaagcatttttcctgaccctctactccttgtcaaactcacaatcgtgtggcacatgctggaactcaatggataccatgcaatgacaaagtcatctaaaataggcatggtgtttggcaagaagtctgctctttacccctctgtctggttaaatctttctcatcctttaagtctatggtctagacaagataccccatccagaatcctcccttgattccttagcactctgacccctattgtagcagctgcccatcccatcttactggggcagtccacttgttgtaatcccctgtttagtctgtctccaccaacagactctcagctccaaaaggcaaactctttaaatactggaatggggcctaacatagagcagccaccagtaatgcttattgaacaattacttcaataacttcaattagggttcaaatataccaaagatgcccatttagaaatgcactgagacatctactcttagtggggtgtcataggcagaatcttggcccctgtcattttgttccctactgttacacccattaatatattatgttacctggcaaaagggactttgcaaacataattaaggtcactgacgagctttgcctttaaaacaggcaaattatcctggattattctggcgggactaacataatcatctgagttcttaaaagcagaaaaggaagtgagagcgatgtgaagcataagaatgcagtctgccattgctgagttgaaaatggagcggccacgtggaaaacacaagaaggcaatcaattctgccaacaaccaggagcttggaaggggagcctgagtcctggataaggactgcagcctcagctgcttaaccgaatttcaacctgtgagaccctgagcagagaatctagctagaattctaacctacagaaactgagataataaacatgtgatattttaagctgccacctctgtgtaattcgttatggcggcaatagaaaactaacgcgggggattccccagatgtagcggactctaacccaggatttgactgtaagacttcaattggaaagttgacagccttgtcaaaactggtaagggggtaaagaagtgagccagaaaaggaaaggaagccaatgcaaaatgccttcgtgagtaagcaggttaccactctaagaaacggagctcagtcccactgggagcctctggaaaacctaccagactgcctcaggtatcttcttagagggtaggcagctgggattctgctccaccagttctcacctggcattggtggaggactgctcccagggactttaactctgcagcactctagcctttttatattttcttctcccttgcagtctttcagactttcagaggaaagcaatctgataacataattcctcagaaagtattaatatgacttagagaaaatgtgcaatggttaaccttctcaacagtgaatcccaaatgggggaattttaagcgtgtatcggatgggagaggctttcctagtctccctactacatctccctactcccaagcctccatccctacttgctgctgcatctgctggcaaggcttgtctgtcctgaaagctgctgaaagttagcatttactagtgacatcacttagtgaatatgagtgtgagccttatcaaaactgtgacccatgtggccccactccataccaatgtgcacatctttaaccactttgggcatcttgaatgaaagccacatagatacaaagcattattcccatttactagtaatgatggtaataaatccaaagaacaagaacaaaacctgatgcttggggacattctgagtatgtagcagactccttgaaggaactcatttcttagcacaagcataactgcacttatgccagatgcaatctcatttccgcacataattcccattgttttaagacaattcaaatcccatctttcctcagaggaaaggctgtgattgcaaaacaggagttttttacagcagggataaattgggttattctacagaactattttatctggggaaaacaaaaacaaaaacaaaaaaaaacgaaaaacaccccaagcaggcaaagcaggcctaaaggagactcctgtaggttgctatggacaatcagacctggccaggtagaaattccttacataaatcctgaaagagacttgaaaagattttctgctgtctggcatgtgcagcagtgcagagaaagtgacgagtgagctacctgactgtcaaatgtgtcaagattcctcagaatattcacatcagaggctagtctcaggctccactgagcacacgatgcttcaaataaccactttcaaaggtaaggcttgtaggacaggagggggtttctacccgtctccaataatgtgggttattcactacttgctagaccctggtttaagcaccattcacgcaataactcacaaccaccttctactattattcttatccccattttgctcccaagtgaggctcttgatcaggtcactttcccaaggtcaaaacaactgagatctgaacccagctctgacttgctactctggtccctgttgcaatcatttccaagcttttagtgtttcacatctaacgtgcacaggttcaggaaacaaatggctgagcctttccagcagtgaggtgggcagccctctgctgcctctcagccttgacttgtgccacagcatccccaattggacactcctgagagttcacccaagggatgggcggccttcagctcatcacgtctaacctctcctctttcattctagaaagcatttcaggttgcaaataagcgatatttatattgtcataagaataaccctgaattgactcatatatttattagaaagtcaactactcccaaacctcggttgaggcactaatgtgtaggggttatctccttgggctcaggggccaaaagaacttctgaattcacctgctttattcacaagtcacttgcaaggcaaagcagttaagttatctgagtctcagtttcttcatctgtcaggtagaccattttatagtatccgttcatggtgaggatcaaatgaaataacgcacgtaaagagctctgaacaatatctggaacacaaacagccttcagtaaatgttagtctcattatcaccattatcatcttattattttctgtagtggcaaacctccagctgatgaggacagagcagctccaggtgagttaaaggaacagccttccagttctctgactggatgaagtctcaaacttggcctctccttattgacctttcgagccagccatttgactgcttgtcagcacctctttcacgaggcacctcacttctgggggatcataagtaagatttaaggtctgaacgatgggactgtcaagtgaaattcctcctttcttttggcaaaacagccaagaccttccagagctgtcctggaaggagaccataccctgaatgtttcaatacattatggtgacatttatgcaacacggattctgtgtgccaagctccacactcagagctggggcctcacagccaaatcagcctagtccctgccctgggtaaaagcatagtgaagtgcctctcatttcatcagaatagagtaggagtctgaaatagtcaataaatcctaaaagtcagaattaaaaaacagtacagtactactaacttttatacctcgatgaatgatatcaatgtatatctcactccagatcaaatattcagcaattatcaaatgctattacactgataagatttctatgaaacacacagtacaacagtataagaatgtttcttctttcaaaagaaaaacagaaacacagaagctgaccttctgctcagatgaatctaggtgtgaactctcactggctacttgcaagctgggatacttagcaagtgacctaactatcttgactttgttctccacttctgcaagatggaggcattgacaccaccaaccacagaggggtgctacgtgtgtgcaatgtgacaaggcagctgaagcacttagcacaatgcctagcattcaccaattgttagaaatgcttcttatttttaaagtgcctccaaactcactacatagattcactggcaacaattcagcaaagaaacttctaatggattcagagaaggaatacgtttaatattttctaatggaaagcatttcagagttaatgtatataacttgtttccgcaagtccacaagtatctttatgtctacttgggcacataggaaggaacaagcttttacagataccagagtaccttgcaagattggctggcactggtgcaagctagtgtgggtcactccatagaaattcatttttctgcactagctcttaatggtccttctctgctgggcattttcggctatggtttaaagtaaatgcattcaaataaacatcttttggtgccagaaatgccatgggcacatacttttctttcaatggtcctgggaagtggtttgttaaactattgttctcgattaaaaactcgtgtgtttgttcagtccaatatgggtcaccgctttgagtgaaagatcccttgacatggcaaaacctcgacttgtgacaagccagtgccaagtatgtcttaaccagatgcaggccagggtttgattagcagccactgaattccatgtaaaatcagataatgatggtttttcgcctttctgttgagcaaatatcctcagcttttaatcaagtctatacatgaaaactcctctataaataactttatgcagtacaatggttttaaaactatggttcatctcaactttcctgacctttgactgcttaatctgagaagaacctgtgcaataccaactaaaaataaaggaactacactatttattttggcagattccataaagatataatagagggacatgtggtgagtggaaattctctaccacacacagagagaaaagaaaggaaaggctctggagcccatttttgttctcccacttgtgggatagcatctattagacaatgatgatattaggacggcagagacaagtgccgctttggaatgctgcaccagactccatggccatgcacagaagccttctctgccccgtttgatgtccaaagggtccaactcaaacctgggaaacatgaaccttttcagagaggctggggtctcagcctgggcttcctctcctttcttgtgggtacaatttgggcatctgaagttaattacttgcaggtgcattttggctgcgtgcaatggaggggggttcccaattagcctcttgcaggtgtaattagcaatttcacctcactttgagggggcaagtggataattgtgcccatgaggttgttcctaaaggggtctagcagaatgcccattgcagactgctgtctggagaataagctccatgaaatgggatgctgagcattcaggagtaagtgtcaggtgtccacgtggggtctagaagtggagccccacatggagggtggggttaggagttccttctggttcttcacatccataaaagagagtggagccacaaaacagcattgagaaacaaggacctcaggcagactctctgaggcataagggagtaaatactttggcctgatgacattgagtaatgcaagaaaaactagctcagaacgggagtggaccagaactacagaattaacattttgtagaacaaaaaaagcaaagcaactcagtgaaaataaattattattaactttgccataagccttacacttaaagtgttgtcacagaaatcaactcacgtgagctcataaacttagttataatattcaaaattttaataacaacacttactgagcacttatggtgtctgaccttattctgaaagcgtgtgtgtattcaaccgatgctcttaacagactgctttaaagactcgctctacccattttaaagaagataaattgaggcacagggagatcaggtagcatacccaaggttacacagcgagtaagtagtggagccagatctccaagccgggcagggcaccagataggtcactactctgggtgagaaaatgttcaaacaagaagatggaatcagggagttgaggcttgctctgcaggatgcatctatacaaaatcattaattgcttcattcatttgttcaaccatctgatcactcaaggaacatttagtgagccctgggccaagctactgcgctggcataagtgtaacggagagggagacagccttcttagccccagtgtcaggctaatgttttataacttgaaggtttccttggctgcttgttcagtgttgggaagaaaaatgggagagagcaagagaagaaggaaggaaacagaatgaggaaaagagacaggtatgaagggtgctagagcgtgtgaagaaggggtaaaaaaaagaaaccttcaaaatgagtttttcttctgaaaatgaatccttttatgagggggagaggagaaaccacatcaactgaacagtgagattagactgatgaatgtggaggagaaaccctactgttcctccagatgattgcttgctttaacaagaataggtgtgcaataggactgccaaaagttattccccatgttaaaatctgaaaaccaaaatgaccccatctctggctcgccggccactgtggtctgtagaggggctaattctgagcacttgagttctgggaaacccatcaaacacgtggaaatgagcttgatgagaatcgctagatgtgaaggggctgagtgctactaagacaaattccactgccccattcccttactgaccaaccacctatattttatcatttttattgaagcacactttaccagcgtcattacatattaacctgtgttgagattgaaacagaagattcacagtgatgcaccctaaaggatgtgcaaaacttgagagaacaccaggaccaaaagaaacctaacttgttttctgacaaagctgatggtcattctaacaagagctgatgtagcatgcatgcaaatgtctcacagggaccaccattcagtcctcatgatgaacttatgaacagctatgactccattaacctaataacacctaatacatacatattgagagcttctgtgtgtcccacactgtgcaaggccctttatggagactatctgatgatggagaatatctctcaataatcagtagattaccataggctggggctcagagaagtcccacaccttgcctaaggtcacacagctggcaggtgtcaggacagagagagaatgtgtacattcaggtgtgttcatgctatgctcccagcattcacatggagttggttaaaaaatgatctttcctttgatgtttcctaagacttcatttaaaacttcagatttttttttctttttctgagagggtgtaaaggatattttcactgtaaaagtcccctttgctttactggtttcattaagtagctgggcatttattctattggcttattaaagccttgcaagtgtacatttttaaatgttctgagatttgaaattgacatggtgcagttgttcaagagattgtgaacttggcatagcgttagtcatcaaagaagttttgactttggcatggtgatagtcttccaaaatatttccttttaagatcctcacttattctaaaaagacttaaaatcaactaacacatggggcctgtttctgaaatttatgttgctacaatataatcttcaagttagtcctttagggctaagacctgttacaccccttaattaaattatcttgttttattatgtacagcaatgaaagtagggactcggtgacccactcagtgagcatgcttaattggttttttcatcctcatcatggttcttatcaccagctggactgttctgacttacaagaatttttttttcttttttttcttttttttttttttgagacggagtctcgctctgtcgcccaggctggagtgcagtggcgcaatcttggctcactgcaagctccgcctcctgggttcacgccattctcctacctcagcctccccgagtagctgggactacaggcacccgccactctcctacctcagcctcccgagtagctgggactacaggcacccgccactatgcccggctaattttttgtatttttggtagagacggggtttcaccgcgttagccaggatggtcgcgatctcctgacctcgtgatccacccgcctcggcctcccaaagtgctgtgattacaggcgtgagccgccgcaccgagccccaagaatttttaatagccatcatgctgcctagactcgtcatggcaaaccccttcttctttttcttcattcgccaatcacacatggctttgccaatatcatctgggctaaactaatgaggtcaggaattgtgcagtgcctttcatttctattttaaaagacatgaaggagtcatttggcctctttgtgctgagttagtagagcaaaactgggtccactcaattacattttaagtccattgtaattgagctggcttcatgagagagctggcctcatgagaaagctggccatgggcactcacccatctgagtgatttgaagtgacctcagagagttcacttgctccaaggctttaaattcccatcattcaagctggaccacatgcaatgttcttttaaaatcccaatatcctcccagagggagtacattttctgccttcatagtgttcacctcttgtctttgttatcccagtacccttcatactttggcaaatggccttcctaccataccctgctgtcctggtaaacatcttaggcatgggtccccctcctccctgtctcagggtgggcattttacccagcctgagtcattcatagtgcatgcccctcctcctcctcacccccacaacaaatgattggtttagacatgggctttgagagggacggagaaggaagtcaatgacctggcctactggaattgagaagctttctctaaatccatagatgagtagcccaaatgcaaaagaggggacacagggtatggcagatactataacatactacttactaaactcattttttcttcttcctggtttcattttccagatcccatcgctcccatagggagccatatgactgacttctgtttaatgaagagtgagtgaaaatgacgtgccccacttccagtacagccctcaaattcccaattgtattagtttacttgggctgccataacaagataccacagactaggggacttgaacaacagaaacttatttcttcacagtctggaggctagacatccaagatcaaggtgtcggcagattcagtttctcctgaggcctctctcctttggcttgcagatggccaccttcttgctgtgtcctcacatggtcttttctctgtgcacatgtaaccctgctacctctatgcatgtcccattttcttcttcttctaaggatgtcagtcatattggattagggccctcctgaacaagctaattttaacttaattttctctttaaagacctaacctctaaacacagtcatagtctgagagaccaggatttgggcctacaacatagaattgagggggtggccaaaattttgcctctaatactattcgtgattctccaggctctctccatttctaccatctggatatcaacacacaagtggaactggaagctgtgagttgaagatggccaaccttccatcatccaggcccccataacacccatgtcagaacagagactcctgttaacctggaccttccttggactgtttatatgagcaaaaataaactcccatatgagtaagaaaaaaactcctgtatgttttagcatttatacatttttgggtctatgtgttaaagcagttagttgactccaactaatatacagggcaaagcattttttgacattttgccaaaagtcagcctgggtggaatgattatttatgttgaggattctgagagttcccacaacactttatcacttctagtgttatcacatggtttacatcagtgtttctcaaagtgttgtaaaagtatggattcctgagcctcaacccacatctgctaatcaaaatttcagtgccttttgggggccctgcatttttaataagcctatatgtcactcagatgcacattaaactttaagaagcattggcttacactgtggatcccgttctaaatttaaatgaacattgaatgggtatagcaaagcttctcctgcccaaacgtggttagccgttgagataagtgtttagattttctccacaaattacagaacatgttcattcatttttgtttcctctctattttagataagccaaataactcatttttccccttaatcatcactattttatgatgatttaccaccaaattgaggtctcaggtagagtcaccattttttttatcatgatgtattttagtaactttcaattaaaactagatttacaattgacacagaagttcacccagggagtaccacagggcaagaacctggaattcttccttgtgtcttcatttcaaactgtgagcagggttgcttagttctcagtgttaacaatttcagatccaggctgaggaagagcagtcaattaccctgaaaaatactcctcctccattttatacctgagtcttgggctggcattttccaacatgtgacagtaactccttagggttttaattactaacaaataaaacggttatatggtcaaagtaattgaaaaatacaatatacagtttaacagatttctttatctaatgattatgatctgaacctccaagggtacaacacaatgtccaaattttccagacttgccacaaagagtttgtgtgtgcatatgtttgtatatctggatgtctgcataactatttaaaatatcactattcttcagtacacaaatatccatctaaaagtcactaataatttttatttgagataatatcatggctgtttttttcaatggacatagttacttctgaattttttctaacattagaaccattattaatgtataatcatcctttaagtcctgtgataatttcagccatctctcaaaagtattttaccctctgctgagaaattaatatttcatctgtggtgatattacactaaagttaatataaagttatgaaaactgaaaaactactatatttgctagtattagtatcattattgtgtttgttgtttttgttttaattattattatttataacatcattattcctatctctacacctcttttacatgttggattctgaacatttttctttctggggaagttgaagttaaaaaaaattaaaaacaaaacaaaacaaaagaaggaaggagaaaggaaggaaggaaagacagagggagggaaggagggagggagggaaggaaggaggaagagaggaaggaagggaggaagggagggagggaggacatattgctacaaaaaccgcagagcttcacagagtccttggtatctcatgagtataaaggtggttgtgaacagcaataaaagctactttaactgaagcaatactggcaaattacaaagttgggtggatggcaaacaccagcacacttgtcttcattctgtcctcttgtgccatagcaggaaagaacaatcaatccaggacagctctagtgtacttggcctcaaaatgactgtgaatgcagtgctccaggaagccactacagaacagtcagaattagggctccagctgacctctattactgagtagttgtaatttccaggagtctaccagaatctggactcagaataccttaagttgaagcctatttgacactggcaaatgaagtaacttccctaagcctgaattgcccatctaacaaaaaggaatgttaacagcgtatatattataggttgttgtgaggttaaaacgtgaactagttcttgtaatgcacataatgcaaagcctgacaataatcattgtttaacaatttccattcattgtttactgtatcagatataccaccctccccattttacaaaaggctaaaacagacccagagagtgtcttaaaccatgccaaactaatgaagtctaaattcctgatttccacttcagttttttctcctccatattcattcggtagaaagtctgttttacacttatttatctatttagaagtgtatttgttgtcttactttgtcataactatttggataattccaaaaagatttaaaatagctttcaaatggaagactggcgaggcacattgtgctctgggaggggttccaactctcctgcccaattctcctggagggcagtggttatcactgaagagccggctgaagtgagaggccaccaagcagagcacagcctgtttcattttaatagcagcctcactttacttcttactgacaatgccctcctttacattagctataacctcagatggctgccttaacaaaaggaagtaacacggtctaattgttctggatttatctgtaacaactccctcttgagtaaggagcattctttcggtattcctgctgcatgtgattcctggcctttttccagtatatttagtcattccctcattgtaaggaaagaaaataaaggaagaagaaaagaaaagaaagaaagagggagaaagagaaagaaacagagagaaagaaagaaagagaggagaaaaagaaaaaaggaagagaaagaaagaaagaaagaagaaagagaaaaagaaagagggacggaggaggagatgaaagtaagaagaaagagacagaaagaaagaaaaagataaagagagaaaaagagagaaagagggaagaaaagagagggagggagggaggaagaaaggaagagaagggggaaaaagaggaaatgatagtcacatggtcataatcaacccctaccttgcttctacaaatgctatatctgataattcataaatgccactgcacatgtgggtaaagatgttgattgaataatcactacacaaatttaatcagtctgtttttcatggggaaaacttgggcacaatgtaaatcaagttgttgtttgttgttttaatatgtctatttcccatataatgagcagaaatcttccctgaaaccatgatcctacctttcccatggtacctgggtccctgtgaattctacatctcttcatcctccacactgacaaacgcttggacttaagccttcaaaaatgccagtaactgtatgactagtaaaccagacatagaaaagtactacaacccatgataaatacaaagcccctcatgagagactgtcatttgggatattcacaaaactgttccactcagcagcaacgttgagaagccagacaacatcgcctgtgttcagcacgtccatcgccactgcggccaagccgatggaaaccagctggaaagttgtcagccattttaaacactcagctagagtcactgtcgtgctaccaactgtgaccgtctggaaaaatcacgtaagtacaaagaggcacgaaagaataaattctgaactccacttttaaagaacacagggaaagctgcacaatggcaggcagcatttaactctttaggccctgagacttccattgctggccatggtggagtggcccaccacagaccagctctcttactcattacagctaaacattccggacaaaatacaaacgcaaattcctgaaggctccaaaagtgatgtgccaggagcaaccacaaaataaaaattcctggggaaacctgtctttctggccatagacctggggaaagagacccctgaggtccaaagagtaggggagaaaatccctattttgttcttccttttttctcctccagctttgcctaaaggcggagtgtagctggcagcaggggcagcaggggcagcaggggcagcaggggcagcaggcagttaaacccccaagaaaaatcccgtccttctattagaggactgcaaaagagggccctgtgggctgcagactgtgaagtgaatcctggagggaaaagagctgaagatgaaaatttcataagttcatgtatgagcttgcaaaatgatcagtctcatccctaagctgtgcatgtgtacaatagatctaaagacttgaaaacttaatggacactgagacaactaccaccaaaggtaagacagacttgtggtaggaacctaaccaggttgactgctaagaaaaaaaaaaaattcaatattctctacaggattttagcaggaccaagagtctaaactacacaatgttcaaaatattcaggcctggtgaggtggctcatgcctataatcccagcactttgggaggctgacgtaggcaaatgacttgagccaagaattccagaccagcttggtcaacatagtgagatcctgtctctataaaaaaattagctgagtgtgatgggacatgcctgcagtcccagctactcaggaggctaatgtgggaggatcgattgagcccaggaagttgaggctgcactgaggcatgattgtgtcactgtactccagcctgggcaacagagcaagaccctctctcaaaaaaaatttagaatccttgacatataaaaaataggaaagtgtaaccaattttgaaaggaaaagatgatcaacagatgccaaccccaagattactcagatattgacaatatcagacaaagactttaaagcaactattataactatgctcctaagataaagattgatacatttcaaataaatggaaagatcgatctcagaagagaaataaaaagaaaatatacaaatttttaaaaattgttggatatctcaatagcagaatggaaacggtcatgaagtcatgaaacttgaagacagatcaacagaaatcatccaatccaaaaaataaaagtggagaaaaaaattaacaaaacataaatagagcctcagaaacctgtagaacaatatcaaaatatattttttctttaatgagatggggtctccctctgtcacctagagtgcagtgcataattacgtcttactgaagtttcaacctcctggactcaagctatcctcccatttcagctatcaaagtggctgggaccacaggtgtgcaccaccacatccagttaattgctttttaaaattttttgtaaagatggtgtctcactatattgcccaggctggtctcatctcaaactcctgggctcaagtgatcctcctgcctcagcctcccaaagtactgagattacaggtataatacaccacacctgccccaaaatatcgaacatttgtgtcattggaatcacagaagaagaaaaagagtgcagtgctgaaaaaatatttgaagaaaaaataataactgaaacttctgaaatttggtaatagacataaatatacaactcaaaaagtagagccaacttcaaacaggagaaacaaacaaacaaacaaaaaaacccacctgcagctacatccaaatcaaactgctaaaaacaaaaggtcaaacaaacaaataacaaacaaaaataggcttcaaagcagttacagaaaaatgacgttacacagaagaaaacaatgactgaaatgactgtgtacctctctcagaaatcactgaagacagaaaacaatggaacaatttttttaaatcctgacataaagaaactgtcaactgagaattctacagccagcaaaaatatgcttcaggactgaagatgaaacatgataaaggcaaattcagagaatttatcaatggcagacctactctaaaaaaatgatgttaaaaagttgctcagactaaagagaaatgcagaaattcagaaacgaaggacattcaacagcaactgcaaatatcttggaaatataatggactatttttctccttttagggccttcaaactacgtatgattgctaaatgtaaaaatgataatattgtcttgggagggggtttcaatgtacatatataatacatttgacaaataggaaagtgaggataattataaggttgtgaggtttctcaatttacttgaagtagtaaaatattaactctaagtagactatgaaaggttaggtacctgtatagtaatctctaaaataatcactaaaaatgcaaagaggctgggtacagtgactcacacctataatcccagaactttggaagtctgaggtgggaggatgacttgaacccaggagtctgagatcagcttgggcaacatagcaagaccccatttctaaaaaattataaaaaactaaccaggtatgatgctatgtgcctgtagcctcagctacctgagaggctgaggcagtaggatcccttgaccccaggaatttgaggctgcagtgagctaggattgcaccactgaactccagtctgagtggcagagtgacaccccatttctttaaaaactaaaataaaacaaatagatatagtcaaaagtcaatagataaattaaaatagaatattaaaaatattaaaataaggtagctgcagtggttcacacttgtaatcccagtactttgggaggccaagacaggaaggttgtttgaagccaggagttcaagaccagcctaggcaacatgacaagacccctctctacaaaaaaaaaaaaaaatttaattagccaggcagggtggcacaatgctggagtcctagctacttaggaggctaaggtgggagaactggtcaagcccagaagtgtaagactacagtgagttgtgatggtgccactgtacttcagactgggtgacagagcaagatctgaacttcgaaggaaagaagaggggaggggaaggaaggggaggggaggggagagaaggggaggggaagggaagggaagggaaggaaggggaggggaggggagggaaggggaggggaagggaagggaagggagggaaggggaggggagaggagggaagggcaggaaatccaaataatctaaaataagtctcaaaggggagaaagaggaacaaaattaaaggaggcaggggaaaacacataataaaatggtaaacctaaataaaatcatatcaaggattataatagtctaaacatatcaattaaaagacagaacctggtcgggcagccaagatggccgaataggaacaactccggtctacagctcccagcatgagtgacacagaagatgggtgatttctgcatttccatctgaggtaccgcgttcatcccactagggccagagagtgggtgcaggacagtgggtacaacgcaccgtgtgtgagtcgaagcagggcgaggcattgcctcactcgggaagtgcaaggggccaaggagttcactttcctagtcaaagaaaggggtgacagacggcacctggaaaatcgggtcactcccacccgaatactgtgcttttccaacgggcttaaaaaacggcacaccaggagattacatcccgcacatggctcagagggtcctacgtccacggagtttcactgattgctggcacagcagtctgagatcaaactgcacgtcagcagcgaggctgggggaggggcgcccgccattgcccaggcttacttaggtaaacaaagcagcctggaggctcgaactgggtggagcccaccacaactcaaggaggcctgcctgcctctataggctccaactctgggggcagggcacggacaaacaaaaagacagcagtaacctctgcagacttaaatgtccctgtctgacagctttgaagaaagcagtggttctcccagcacacagctggagatctgagaacaggcagactgcctcctcaagtgggtccctgacccctgacccctgagcagcctaactggaaggcatcccccagtaggggcagactgacacttcacacggccgggtactcctctgagacaaaacttccagaggaacgatcagacagcagcattcacggttcacgaaaatccgctgttctgcagccactgctgcggatacccaggcaaacagggtctggagtggacctctagcaaactccaacagacctgcagctgagggtcctgtgtgttagaaggaaaactaacaaacagaaagaatatccacaccaaaaacctatctgtacatcaccatcatcaaagaccaaaaatagataaaaccacaaagatggggagaaaacagagcagaaaaactggaaactctaaaaagcagagcgcctctcctccttcaaaggaacgcagttcctcaccagcaacggaacaaagctggacggagaataactttgacgagttgagagaagaaggcctcagacgatcaaactactctgagctacaggaggaaattcaaaccaaaggcaaagaagttaaaaactttgaaaacaatttagacgaatgtataactagaataaccaatacagagaagtgcttaaaggagctgatggagctgaaagccaaggctcgagaactacatgaagaatgtaaaggcctcaggagccaatgcgatcaactggaagaaagggtatcagtgatggaagatgaaatgaatgaaatgaagcaagaagggaagtttagagaaaaaaagaataaaaagaaatgaacaaagcctccaagaaatatgggactatgtgaaaagaccaaatctacgtctgattggtgtacctgaaagtgacggggagaatggaaccaagttggaaaacactctgcaggatattatccaggagaacttccctaatctagcaaggcagaccaacattcagattcaggaaatacagagaacaccacaaagatactcctcgagaagagcaactccaagacacataattgtcagattcaacaaagtggaaatgaaggaaaaaatattaagggcagccagagagaaaggtcgggttacccacaaagggaatcccatcagactaacagcggatctctcggcagaaactctacaagccagaagagagtgggggccaatattcaacattcttaaagaaaagaattttcaacccagaatttcatatccagccaaactaagcttcagaagtgaaggagaaataaactcctttacagacaagcaaatgctgagagattttgtcatcaccaggcctgccctaaaagagctcctgaaggaagcactaaacatggaaaggaacaactggtaccaaccactgcaaaatcatgccaaattgtaaagaccatcgaggctaggaagaaactgcatcaactaacgagcaaaatcaccagctaacatcataatgacaggatcaaattcacacataacaatattaactttaaatgtaaatggacaaaatgctccaattaaaagacacagactggcaaactggataaagagtcaagacccatctgtctgctgtattcaggaaatccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacgttagacagatgaacaagacagaaagttaacaaggatacccaggaattgaactcagctctgcaccaagtggacctaatagacatctacagaactctccaccccaaatcaacagaatatacatttttttcagcaccacaccacacctattccaaaattgaccacacagttggaagtaaagctctcctcagcaaatgtaaaagaacagaagttataacaaatggtctctcagaccacagtgcaatcaaactagaactcaggattaagaaactcactcaaaaccactcaactacatggaaactcaaaaacctgctcctgaatgactactgggtacataatgaaatgaaggcagaaataaagatgttctttgaaaccaacgagaacaaagacacaacatacaagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaactcacagcagaactgaaggaaatagagacacaaaaaacccttcaaaaccaggagctggttttttgaaaggatcaacaaaactgatagaccactagcaagactaataaagaagaaaagagagaagaatcaaatagacgcaataaaaaatgatcaaggggatatcaccaccgatcccacagaaatacaaactaccatcagagaatactacaaacacctctacgcaaataaactagaaaatctagaagaaatggataaattcctcgacacatacaccctcccaagactaaaccaggaagaagttgaatctctgaatagaccaataacaggctctgaaattgtgaccataatcaatagcttaccaacaaaaaaaagagtccaggaccagatggattcacagccgaattctaccagaggtacaaggaggaactggtaccattccttctgaaactattccaacgaacagaaaaagagggaatcctccctaactcattttatgaggccagcatcatcctgataccaaacctgggcagagacacaaccaaaaaagggaattttagaccaatatccttgatgaacattgatgcaaaaatcctcaatgaaatactggcaaactgaatccagcaacacatcaaaaagcttatccaccatgatcaagtgggcttcattcctgggatgcaaggctggttcaatatactcaaatcaataaatgtaatccagcatataaacagaaccaaagacaaaaaccacatgattatctcaatagatgcagaaaaggcctttgacaaaattcaacaatgcttcatgctaaaaactctcaataaattaggtattggtgggatgtatctcaaaataataagagctatctatgaaaaacacacagccaatatcatactgaaggggcaaaaactggaagcattccctttgaaaactggcacaagacagggatgccctctctcaccactcctattcagtatagtgttggaagttctggccagggcgattaggcaggagaaggaaataaagggtattcaattaggaaaagaggaagtcagattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgtttcaaagagaataaaatacctaggactccaacttacaagggatgtgaaggacctcttcaaggagaactacaaaccactgctcaatgaaataaaagaggatacaaacaaatggaagaacattccatgctcctgggtagaaagaatcaatatcgtgaaaatggccatactgcccaaggtaatttatagattcaatgccatccccatcaagttaacaatgactttcttcacagaattggaaaaaactactttaaagttcacatggaaccaaaaaacagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagaaccctcagaaataatgccgcttatctacaattatatgatctttgacaaacctgagaaaaacaagcaatggggaaaggattctctatttaataaatggtgctgggaaaactggctagccatatgtagaaagctgaaactggatcccttccttacaccttataccaaaattaattcaagatggattaaagacttaaacgttagacctaaaaccataaaaaccctagaagaaaacctaggcattaccattcaggacataggcgtgggcaaggacttcatgtctaaaacaccaaaagcaatggcaacaaaagccaaaattgacaaatgggatctaattaaactaaagagcttctgcacagcaaaagaaactacgatgagagtgaacaggcaacctataaaatgggagaaaattttcccaacctactcatctgacaaagggctgatatccagaatctacaatgaactcaaacaaatttacaagaaaaaaactaacaaccccatcaaaaagtgggcgaaggatatgaacagacatttctcaaaagaagagatttatgcagccaaaacacacatgaaaaaatgctcaccatcactggccatcagagaaatgcaaatcaaaaccacaatgagataccatctcacaccagttagaatggcaatcattaaaaagccaggaaacaacaggtgctggagaggatgtggagaaataggaacacttttacactgttggtgggactgtaaactagttcaaccattgtggaagtcagtgtggtgttcctcagggatctagaaatagaaataccatttgatccagccatcccattactgggtatatacccaaaggattataaatcatgccactataaagacacgtgcacatgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgcagggacatggatgaaactggaaatcatcattctcagcaaactgtcgcaaggacaaaaaaccaaataccacatgttctcactcataggtgggaaatgaacaatgagatcacatggacacaggaaggggaacatcacactctggggactgttgtggggtggggggaggggtagggatagcattaggagatatacctaattctaaatgacgagttaatgggtacagcacaccagcatggcacatgcatacctatgtaaaaagcctgcacgttgtgcacatgtaccctataacttaaagtgtaataaaaaaaaagacagaacccgccagagtaaattaaaaaaacaaaaccctactgtgtgctgtctatgagaaacccacttcaaatataaagatatacacagattaaatgtaataaaaatgggaaacatataccatacaaaaactaaagggaaaaaaagctgcagtggctacattaatatcagacaaagtcaatttcagaacaaacagtattaccaggaattaaaaaaaaagagtccctagtaataaaagataatcattacataattatgaggttacaacaatattacacatttatgtacttaataatagagcttcaggaaacatcaagcagaaacagaattgaaaaaaaaacattattttactttggactttaacacttctctctcaataagcaacagaataagtagaaagaaaatcaacaacgggatagaagatctgtgcattattaaccactttgacttaattgacattttagaacactccactcaacaacagcagaatacacattcttttctagtgcacatggaacactgacaaaacagacaaattctgtgtcatagagcaaacctcaagaaatttaaaagaataaagattataaaaagtatgttttctgaccataatagaataaaactaaacatctataccaagaatatatcaaggaaaatccccaaatatttgaaaattaaataacacacttttatataatccacaggctaaaaaggaagtcacaagggaaattagaaaatattttgaactgaatgaaaacacaacatattaaagcatacagaatgtagataaaacagcaattagagagaaattaatagcactaaatgttttattaggaaacaagaaaggtctatcaatcaaattgaaattagaaaaatactaaaatcaaggaaacaaaaagtttgttctttgaaaagatcacttaagttgataaatctctaggcatactgaccaagaaaaaaaggaaggaagacagaaattacttgtatcagaaaggaaaagacaccatcatcattagaaaccctcagacataaatagggaatattacctacaattctatgttcataaatctgacattgatgaaataaaccagtttcttaaaagaaacaaactacaaaagctcactcaaaaagaaatagataaccagaataatgtattaaataataccctgctactcatgaaggtaccataaaatggcagcaacagaaattataaacccacagatccaagaactacaataaacaccaagctcaagaaacatgtgaaaaattaaggcaaggaacatcataaccaaattacttaaaactaatgataaagagaaattttaaaaggagtcagaaaaaaacttataaagaaacaaagataaggataacagaagatttcccaccagacacaataaaagttacaacacagtggagcaacatttttaatataccaaaagaaaaaagaatcagccaaactaggatactcttactacaaaaaattaccttcaaactgaagatgaaataaagacttcttcagctaaaaaaaagcttatagaattcttcactagtagatctgcaccacaaaaaaatgttaaagtctttaagcacaaggaatgtaataccaaacggatattttgatccacaaaaaggaataaagagcaccaaaaatattaactacatgagtaaacataaagatattttatctcatcatttaaacttctaattagccatttaaaacaaacctaataaaaatgtattgtggggttaataacaaaaattaaaatacaatatattacagcaaaagcacaaaagacagaaagaaaaaaatggaaatataataagattcttatgctctacatgaaatggtataatattatttgaagatagagtttaataagttaaagatacatattataaatcctaaagcaaccaccaaaataacaaaacaaagagctatggtgaataaattgccaagataaaggtgaatcaattaaaaatcctcaattaatccaaatcaagacagtaaaaagaggaattaacgaaaagatggggcaaataaaaacaaatagcaagatgacagatttaaatctggccataacaaggaatcacattaaatgtatttggtctaagtacctcaattaaaatgcaaagattttcatactggataaaaaagcaagactcaaatatatgcagtctacaagttatctattgtaaatataaagacagaaataggaaaaaaagtaaaaagctggaaaaataaatatactaacactaattaatcaaaagaaaactggagtggctctattagtatcaaagttgatttccaaataaagaatattagcagggatagggaggatcattttatattgataaaggaatcatttaaccaagaggacataacaatcctaaatgtttatgctcctattaaaagagcttcaaaataagtaaagcagtccccacactaggtgaaaagatttataaatcacatgtgtaataaaggaatcaaatattgactatataaagacctctcaaaactccaaaacaagtaaacaaacaatacaaaatgggcaaaatatatgaacaaacatttcaccaaagaatctaacacaggtgacaattaggcacatgaaaaaatgttcaagttcattagtctttagggaaaggcaaaataaaaccacaattagatacttcaaatcttcaccaacacttggtatggctaaattaaaaggattgaccataccaagtgttggttaagatttgaagaaactggaactctcatacactaatggtgggaaagtaaaatggtacaactactttggaaaacagtcaacgatttcttgaaaagtccagcataccctaccatatgactcagttattcctctctcaggtatttacacaaaagtaaagaaaacatttgtgcataaaaaggcttatagaggaatggtcatagttattttatttaaaatagccctgaaccggaaacaatccaaatgtgcggcaacaaatgaacagacaaatgatatgccaaacctactggcatactagtaggcaataaaaaggtataactattgattcatgtaacatggatgagtgaaaataagcaagtcaaaaaagagtacattgacgattccatttacgtaaaattctaggaattgcaaactactatatagcagagtgacataaagcagatcagtgcttgcctaaagatagagatagaggggtcatggagaggtaggaggaatggattacaaagaggcattaggaaatttggggtagtaatggatatgttcattaacctgactgctttacacctgcatccatatgtcaaaatatatcaagttgtatgcatgaaatatgtataatttattgtatgtcaatcatacctaaataaatttgttaaaacttcaaataataaacttaaataaaacaaatctggctgacacggtttggctgtgttccaacccaaatgtcatcttgaattgtagctcccataattcccatgcgttccatgtgagggacctggtgggaggtaattgaatcatgggggtggatctttcctatgctgttctcatgacagtgaataagtctcacgagatctgatggttttataaatgggacttcccctgcacacactctcttgcctgctgccatgtatgacatgcctttgcttctcgtttgccttctgccatgattgtgaggcctccccagccatgtagaactgtgagtccattaaatgtctttcctttataaattacccagtctcgggtatgtctttattagcagagtgacaatagagtaatacactggcaacaaccaaaacaatacagaaggtaccttttactaggcatttgctatgttctaggtgccatactaaatgcttttcatatcatctaattctttcaaaaaacataaggcaagtgctattatggtttctacatttaaagagaaagactaaggtagagaaaggttaaataatttgcctaaggtcacaacattagaaaggggtaaagctggaatttgattctagagtcaacaatcttaacaaaaacaccatgaggaaactgaaactcaaggaaggccgcatagtgttggggatccatcctagatttgtccaacttcagagcccaacctcttaattgcttcattgtactacatctcgtcttgaaaacatcctgccaaaaacctaatagtcagcctagcctgaacacacctgtgctaattaaatgtgtatttcctggttcccatattcaggaaaaaggggactcacactcagcctttctcagttttcatgtaaccaacaactgttgcgtgaatgaatgaagtgaagtaacttaagttaactagcaaaatgtcctcacattaaaaaaaattaaataaaactggaggaatttgaagctcagaaaaatattaagaatctgcctaaagccaaacagtgagttagtagtggtgaaagtggaagtcaaactcaggttggctaattccagagctagatgactctgtctctccaaaaaaaagatgatcaaaatctgcctgccaaaaaattgcacccttttagacaaccatgagtggctcagaagtgttgaagggctgcagatgagctgagacaagcttacaaaggaatgtgggtgtcccgttccagggacacacaatgaacgttcagctctccttgtctctgaagacaatgcattccaggctcccagccctatttaagagtggaggggttctgctattcagctgtccggcacccctgctatctcaagtttaactagttattttcctttataattcactgtagactgataactattatttccctgtctaacacatactgacaagtgctctggttaaatataggttgctaggaattggggtggaaattttttttttttagctcaactttatcaagggtctgtagactcagaattccagaaccatcccattacctcagtgaaattaacacatagactcagttaaaaaaaaagaacaatttttgttttcccagatctcaagaaagatatggaaaggactgcttggctttctgtcctcctatttcttggttttaaccaagaaacgatcaaacgttagaggttctaacctctaacgatcaaaagtgagttgaggagctttaagagattagttctatgcagaaggaaagcaggtaagaaggacaaggagtgtgtgagagagagagagagaaggagagatcagagtccatgaataaaaatatgcaatgtatttatcaaggctccaaacccacataggactgctggttattgtccaatcttcccttctataattacggacatttagctggcctgtggtatacaacaaaacactaaattttccatttccccacaacacaggatgtagccatgtgactaagtttgggccaaggtatgagcacagcagtgatatacaaagcatccagcctgtgcctttgaaggagaggaatatggtctccattacttctttctcttctcatggttggagcacagactggatagagggagctggaagagccattttggaccaagagatggaaactgtcatgtttttagggtggcagagggataagatagaaggaacctggtttcctgtcaaaccatttagtctgtcctagatggcctacacagactttgatgtaggaagaaactaatacatcagatcatatgagactgataatgaggataaaaatattgaatgatattgatagaaaggagaattttatttcattgccacaaactcttctggaacactcttccccaaccacccaatggtgcaagttcaagaagagatcaaaagtgtgatttattgtcatggacttaaaatctagaaaatatagtcaagttgttgagctatttcaattttcctttgcagcttctttctgaaggcttgaaatattttactttaaatgtggaatgtttgcagggaggactttccaatgctgaaaagcacaagttctcccattccttaatcccactgcaaaaatgtgtggccccaatgtttcatgtcagacctgttggctccttcctttgcaaaggctccagttgttacactaaaatcacactggatcatattagctctctcctcccaatttcctgttcataaagcttggagcctcatcacaatgaatgtattgtaaaaatatagggtaacaaatgttttctgctgggcttcgtaaattggaatgagacaaggattgggcatttacacccaatttacttcagactgtattacctatagaataacttgtgagttctcagataaaagcaaataatggaaaccatgccaaagtaaacgaacatttttgaattcctttcaaatattaaatactgatattttcctccagaaatacaaaaatgcatagctgtgaggtccactttcatgcaatatgtggcatatgctgtctaccactactgttgaaaggttgaacatatgcattctacatatgcctttctactccttggtatatctgcaatagaaatgtaggcaaatgttcatcaaaacacagttagtagaatgtcacagcaacactattcataatagtccccaaatggaaacatacatgaaaaacagaatggtttaaaagaaacattatataattgaagaatggaatacaacaatgagaatgaattgactagaagtacacacaaccagatggatgaatctcacaaacataatgtgtaaaataatccagaagggaaagaatgtttgctgtatgatttcattaacatccagttcaaagccaggcaaaattaatctatggtgtgagaaatcataataattattatctttgagagaaaaaatgactaggaaggcaagacttctacagtgctcaagatgttctgttttttaatctagacattagttacatgggtgtgttcactttgtgaaaatgtacaaaggtgaagtcatatgatttgtacactttcatgcatgcatgctatatctcaatttaaaaaaattaaagggatacatgaattcaaaatgtcacaattgttataacaccaaaataaaagtgtgaaaagattgctactacccttcatctaagacatttacactaaaaaatactatggacatatctatgaaaatgaataagctacatcagaggataaaaagagaccctatagggcagcagtccccagctttttttggcaccagggactggtttcaaggaagacaagttttccacagaccagtgagggggtagtttcagaatgaaagtgttctacctcagatcatcaggcattagattctcataaggagcactcaacccaggttcctcatgagacacaatagggctcacactcctatgagaatctaatgccaccactgatctgataggaggcggagctcaggcagtaatgctcgctcacctgccactcatctcctgctgtgcaacctggttcctaacaggacatggatcagtattgatccagcccagggcttggggactcctgttattaaaaataggcaaaaatgggccaggcgcggtggctcacgcctgtaatcccagcactttgggaggccgaggcgggcggatcacgaggtcaggagatcgagaccatcccggctaaaacggtgaaaccccgtctctgctaataatacaaaaaattagccgggcgtagtggcgggcgcctgtagtcccagctgcttgggaggctgaggcaggagaatgccgtgaacccgggaggcggagcttgcagtgagccgagatcccgccactgcactccagcctgggcgacagagcgagactccgtctcaaaaaaaaaaaaaaaaaaaaaaaggcaaaaatggaaaagtaggacttctttttttaggaaaatctgccaacaacatttgggtctaattctaaaaacataattcaaccccaactgttttacttacaagtagcaattttcactcttaaaccttgccatttgaattacttagaatccattttttgcaatgagtctgaatctataagccagagtccattggcgtataatgaatgcctggaacaccagattcaagaagctacttgcctgtaaaggcaagacaataactcagctcacaggagaccaactaaatttttcaataaggcagccatgtacaccaaaggttgtgcaaatagagcaagcaactgatgaagttcagactaaacacaaatatattagcaaacaccactggggacagaaagttataaggaatatcccagaaagaagggcagcctctgagttggaaatgacttcttacaaggattgatattatatcattctttttttaacttttaagttgggcggtacatgtgcagtttcgttatataggtaacctcatgtcacagggatttattgtacagattatttcatcacccaagtgctaagcctaatacccaatagttattttttctgctcctctccctcatcctacactttaccttcaagtaggttccagagtctgttgtttccttctttgtatcaatgtgttctcatcatttggctccctcttataaatgagaacatatggtatttggttttctcttcctgccttagtttgctaagaataatggcctctagctctatccatgttcctgcaaaggatatgatctcattcttttttatggctacatagtattctatggtgaatatttactacattctctttatccagtctaccactgatgggcatctaggttgattccatgtctttgctattgtgtacagtgctggaatgaacatttgtgtgcacatgcctctatggtagaaagattcatattcttttggatatatacccagtaatgagattgctgggtcaaatggtagttctgtttttagctctttgaggagttgccatactgctttccacaatgattgaactaatttatactcccaccaacagcgtataagtgttcccctttctctgatataagtgttatttcatccttattcattctctctctctctctctctctctttctctctctctctctctctctctctctgcattggttctgatttcaggttacgtctgcattatgtgttttgtcaggagaagggatttcagagagatgtcaggtttccatttcaagatattcaaagcccttaatgagatatttgcctgccctgccactgggaaactcagcagaaagcttgcacagtttgtagggtaaatggcaaagcacaagtgagcaagttccagacccactgcttcatacatctgcctgttatttgtggaggtaatagaaggtcttcttaggcctgacctggaaaccagaaaccatgaagaaatgattggcagatgggaaaacataaatgtcaaaaaggcaaatgtacataacacccacaacacaaacacgctgggaaaatattttcaatgtttctaacaaaggatatatatctttaatatacaaatagatttatcagatgtgccattggatcaaagatcaaaggggaaaatgaggcaattcacaaaggaaaaagtataaatgggagaactttacaggcttataagttataaacctataaagcttttcccattggacataaattaattaaatgaggattttcaccctcctttttattgagagggaggggagccttccacattaaaatgattttgaaaattgccaaagtcactattggcaaaatgtttaggaatggactacctcatatgaattcatagtcatatgcgagggcttgaaatgtgtgatctctaacagcaagaccgggagatacacttgacatccattcacagggagtagttgaataaatcacgatgccacagataaaagtagagtgctccacagctattaaaaacaatgaggtaaagctgtgcatcatcaccagcattgaaactaatgctatgctgggaaccaagctgactgtagtagcaagtactattttaccactttcatataaaattatatacatatggtgccgggaggacagatgaaaaaaagaaggaagaaaggaaagagaaaaagaaaggaagtttcaattattaaaatgttaacaatgattatctctgcatggtggcaatttgggtgattctcacttcattgcttatacatttctgaattactactattattattatttttgagacagagtctcactgtagcacaggctggagtgcggtggtgcgatcacagctcactgcagccttgacctcctgggctcaaatgatcctcctgcctcagcctcccaatcagctgtaaccacagatgtgccaccacgcctggctaattattttattttttgtagagatagggtctcgctatgttgcccaggctggtctccaacctctgggctcaagcatttttgccacctcggcctcccaaagtgctgggattacaggcatgagccaccaagccccagctaggatattatcactttgaaaaaaaacaaaacgtaaccaaaaataacaaaactaagtaactgaaaaaacttcagactccctaggagctcatatttatgcatcatctgaagccgtcttgtcctccttctgccttttcttccaaagtcaatctgtttccatatcctattaattttactcactcaataggtattttatgaagctcctgtgttctctctcctccctctttttcctaattattcttctccaccaggatctatctccaccactgcccacttgggccatcgcctaagcctcttaacttatgcctgtgttttctactgacttctgctcccattcatccttcacaccgcagaggcatcctcgcattacacttttaaaagccttccatgtttccctgtggctccaaattccttatggtggcattccaacttgctggcccatactggcacctccgccgtcatctcccctgcattcactcctatccattctcaactcccaataattgcttgctccgaggatgactcaccattctctaagctcaccacatatgtttttatatttctatatagttggtcatcttgtcctctaagaagctaatgcctgatttccctgattatggaagggaagtttcctgattgtggaaactgattattttccaagattcagatcaaactgaatctcctctaatagcccttgctcaatctttttgtttttgtttggggaaacaaaacaaaacaaaaaacaatcacctttcttagtcactatttcattcttctaagtgtgcccacatcttcttcactacagtgtggagcttttgtgagtggaggcagtttttttgttgttgttgttcaactttttgataccctaacatgcctagtaccagtttttcacatcttaggcacttaaatattttttttcaaaaaacagagacagtgcctgccatctgccaggctctatggtaggtgagtccacagtcaactgttctcaaaacatggtctgcattctgggcacagtcactctcattttctatgtggacaaaactgaggccaagagattcagtaacttgccacagaccacacagtaatggcagatctgagataagagtcccggaccaccatatgaatccagattcttttgactgatctgtgcttcttctgcacatatgtatatggagctggactgatctggacatgtaggaagtgctgactcctaaaatccatttttctaactaagaagtgttcaatgtattcccaggttttaaaatgtctatttgctttaggccagctgaagcatcatctataccctggacctgtggtttctctaagcttctatcaccccaagaacgtcagtgcttgggggtctgtctccaggttaacatcctctttgcacattttaagattttttcccagagctcactttttctagaattcaactccctgccttctctcaaatttggatgtaatagctggcaccgacgcaggaggatgccttgtccattctactgtcagccattctatttccatatcaacaaatgcccatgcccctcttcaatttttacattctaatgatttcaaatttaaatcttccaaggactaagttgagggaaaaatagtccaaagaacaagccacttgccaccatcagaggtaacagtgcttctgggtagcctgagattctgtttgacttcatcaaagtccacaaattccaggactgcccaaattaggagacagccaaggaattgatcttcaccttaaaaacaacaacaataataatgccaatacccaactgtattagtttcctaggattgccataataaattaccgctatggtaacttaaaacaacaaaagtttatcatcttacagttctggaggccagaagtccaaaatcaagatgtcagcagagttggttccttctggaggccctgatggagaaaccattccatgctttttcctaatttctggtgatggccagcaatccttgacattgtttgacttacagatgcattacttctctgcctccacaatctctgcctccaacttcatgcgaacttctggtctgtgtctctgtgtatcttcttcttttctgtctcataagaacatctgtcattggatttagggcccatccaaatataggatgttctcatcttgagatacttacattaattacatctgaaaagacccttattctgaataaagtccattctgaggttccaggtggacatatcttttaaaggctttcattcaactcacaaaccaacactggttgaaagttcactgtgtaacaggcaccattctaaataatgtgtattaagtcattttatctttacaataactggaagaagtaagtaactatttatagaggaagaagataaagacataggaaggcctcccaatcttcctaagacctcatgggtggtaaaagacagagctagtacttaggtgttcatcttcttcataccagggtcaactgttttagatgcatttaccagaatcaaagtgtctaaataacagccaagaccactcctagagagtcacactgttaatctaaaatccctgaactagagaatgttggaaaatatataacatatgggccattgcagcttctacccaatgatgtcagacatcactaattgatcacagagttgttccctatggcaccttaaatgtttacaacattcattatccatcagttcaaggtagcactctgaatgaaacctcctgaccatcctgtttctagatactctttttcaaacacacacacacacacacacacacacacacacacacacacacacacgagagaaccaaagggcaacatttggtctcttcctgtcaagttcctgtcctgccttctagcctgacttcccctgggacttgtatttgccttccaagtctgattgacagagcaagactggatcccatcaaatagcctggagagccagacagaagtccatgctcaaaatccagaccccatcagatgttgtttgaaattcagagactgcagagactgctggcacattcttggaaaagctctgaccttgggaagaaaacttacttccatctctaagaaaaaatactagataatgatttttttaagcccatgctgggagttggtggcaggatgagaatgcacatggtaacaggacaacagtgggtactggcctggagcaggctcctacgtggcctccccagagtccaggctttattctcagcattctctatggtccagcctctctccacttaaactacacttcagataatggtgtttgctacaactctttacaatcaattattttgtcattgtctttatttaaacatgtacacacacacacaactagagggaatgcactggagaatgacacacaacgcattccaaggaaataacaaaattttttctggcttgcgtgcccaacccacaaacttgaagatcaccagggctttatttagtttggttcccattatcattatgtgaggcatgttaataactggactccagagctttggttttagatacttgttcctcacctctctcatctagagttttaaaaaatagtttttattataaatacatattttttgcttttcctgcccacctaacttttaaaaaatccaaaaatcccatctactctcattagagttgaccacaacaaaactgcatgagaaaaaaaaaaaaagaatcctttggatcacatgggtgtcacaccattgttggccatgggagctcagcctaataaggagaagatatgacaacagagagagcccagggtcttgggccctttgcacagaacatggtgtccttactggcagtttgttttaggcttaacatattaatttattgctaaaacaggccgggtacagcggctcacgcctgttaccccagcactttgggaggccaggcgggtggatcacttgaggtcaggagtttgagaccagcctgaccaacatggtgaaacctcatctctactaaaaatacaaaattagctggcgtggtggcgcattcttctaatcccagctactcaggaggctgaggcaggagaattgcttgtacccgggaggcggaggtggcagtgaactgagatcgcaccactacactccagcctgggtgacagggtgagtctctgtctcgaaaacaaaacaaaacaaaaaaactgatgtagtaaaatgtgctttacagtaattacaccacaagaataaactactagcttagaattatttgttgtatttcactaatgccaaagacatagatttttatatgtaatacaaatcccttattttataggtaagataaatatggcccagagggataatcagaactaccaaatgtcacatagccacttagtaacagaagaggcacaacagcaagttctcctagttacagctctacacctcatgacctccatggagccatccaacctgaccaccgggttatctacaagggaattttttaaattaaaaaaaaattcccttgtagataatctagtgatcgggttaaaaattcctttaaaaaaatcttgcagcagaattaatgagggtaaaggtacatggattcttttcttttgactccttccatttttatacctgaagttactccatgagaggaggaactcagtctgcatttactcataactgaactctcaacatttaagacatttcactaaattagtaataaattgatggcagcatagaaatttgtttcaaaattactcaataaaaatacatactgcatttttctccagatattcccccctaaattattggcatagtcattagccctttataggagtttttgaatttggcaccttgacatttggatgggctaatactctgttgcaggaggctgtcctgtgcactacagaatgtttagtagcatcgctggcctctgccctatacatgccagtagcataccttctggttcctccccatcccactgtccagttttaacaacgaaaaatgtctccagttgtcaaatattcctgggtcagggttggggtgggttgtggagcacaatcgcccctggttgagaactcctgatctaaggtgacagcatatccacccaccctcgaccgtccaaccatgtgattcatgggacatggaagcttgatgaatcaaccaactgaaaattaaaagatacacatagaaagcactcaggaggctgggtgtggtggctcatgcctgtaatcccaacactttgagaggctgaggtgggaagaacacttgagctcaggacttcaagacccacctgggtaatatagtgagaccctgtctctacaaaacattaaaaattaaccaggcatagtggtagcatctacaatcccagctacttgggaggctgagaggggaggatgacttgagcccaggaggttgaggctgccatgagtgtcatgattgtgccactgcactccagcctgggagacagagtgagaccctgtctcaaataaacaaagaaaaaaaaagaaagcactagcactcaggaaatataagtatgaattgaattagatatactctaatctgcttatttcaaacatcatcacttttgaagacattatgctaagtgaaataagctggtcacaaaaggtcaaatattgtatgattccacttacttgaaatacttagaggagtcaaattcacagacaaagtataatgtcggctgccaggggccagggagaggaggaacgtgcagttattatagaatgagtgcagagtttcagtttgggaacatgaaaagaattacagaagtgggtggtggtgatggctgcacaacaatgtgaatgtacttaacactactaagctggacacttgaaaacagtgaaaatgataaattttatgttacatgctttgaccacaaggcctaaattagaccaaattatcacaaggcctaattccacaaagcacgaagcaggcccagcgcggcggctcacacctgtaatcccagcactttgggagaccgaggagggccgatcacctgaggtaaggagtttgaaaccagtctggccaatatggtaaaaacccgtcgctactaaaaatacaaaaattagctgggcatggtggcaggcgcctgtagtcccagctacttgggaagctgaggcacgagaatcgcttgaatccgggaggcggaggttgcagtgagctgagattgcgccactgcactccagcccaggtgtcagagtgagactccatcccaggggaaaacaaaataaagcacaaagcacctagataagatttaaaatccccacattctcccataaacttgagtttttgcttttgtagttgttttgttttgttttgttttggttttggtttggtttggtttggtttggtttgacaataaattccttagctaaggaatccaaaagctaagaaaatcttcctcttcatttgtggctgagagcacaggagcagcagagacaaccgcggctctggggcctgctgcagagcagcacaggcacacaccaggacatgggccctcagggaggccccctgatttaagagtcttctcgtgtgaaatgcatccagcccagatcccctaaggacctggcctgtgggtcatgtcagcccagagcccttcctattgccaggatgctcttgacaaaagacagtctggcacggagcagcagggccattattttcatttaaaccatacatgtcatgtcctgtttgtgagaaacatgttaaacaattcagaaacacattcacaatgggctctggagtgggattcgcattcctatgggcctgcatactgtaaactggggatggggaaggaggctggtggggagggtgggatggtgcctctgctcttgttttaacagagagctcctccccggaagctcagctgtaaatagagaccctcacatccttgtttgatgtgggtcttaaagttttcctatggccaaaagcacgatgctcaaagtatgataagccccccattatccatggcagcccagtaacttgaattcctttaagattctctcttaccaatgtttattttaattttgagaaggaaaacaattccactaaggaaacactcaaaaggaggtgaactgccccatttccacctagattgccacagcagatgatccacctgcaatgactaaaaggcatctcagaggtgtaaaccataccaatatgactgaaatctgcgatcctgagccaccccatcacaagagtgtctcagatggaaatgtacacacctataacacacaagatgagaaattcctcattcactgatgaaaggaataaataataaacatggagaaaatcacattcagtcaagtgtaatttgatttacaacgctgttcacttaccaaacatacagtatttatatgcaaacttccaagaaaagtacattctaatatattaaaattagaccccaaatccaggcctttggccaagtcaaataataaacagtgtgataactacgtctgctttcttgccatgacatttctttggtagggggggatgatttaccatttaaaccatacatatcacatcctgtggaagtttttgaaaaattgaacaatttcctctaaatgcttaaaggcagattaactataaagaaaaacagaatcaaacagaataaaagtactgtagaacccattaaaacattaaaggaaactatatagcttattagaacaaatgtggagctagcagatttaaacaatacctgcaaggatttgtcagagatataaaagcaaatgctagaatgccttatttcccttcccatgggactcatactttctttgttgaaatatacaaaaattctgcagtaatttaaattttactttggctttacataaaaaggtgtccctggcctcttaaatgtaactggtgaataataatatatttggccatcgacctccaggctgcagcagtccattctttcctctcttgcccctgtctgtcaaagtagagatgaacactgagcctctgagaaagatggagctcaggctcttcttggcaccactaaaaagaacttcatctttgccttgactacaaatgcaagaggattcctgtcacagacagaacggattctcttgataacaataatcagcattaaaactaaactcaggcctgtggttggttaagtcaccccagttttgtgtctttagacattagccaggcagcaggcttggtagggcccaccaatgctccagtgatactaaggaacagctctcttgcttgagtgatcgatctgctagggcatattccacccagagaagggtttgaaagagagaaagaccaaacgataaactatagatcaggaagaattttgtgactcgtccaatgcagaacagaacaccattcattcttcatcaactaattcattcaatcggcgctgttctgagcaccggagatatagcccaggctctcccagagctttgattacataaagaagactacagacaatgaaaaaataaacaaaacatatatatacacacacatatacacatatatgtataaagacacacatgtatatgtctctgcgtgtatatatacatacacatacaatataatgcatatatacacaatatgatacacacacatacggtgatggtaaatgttaaaaagaaaaatatctatacccaagagaaatgaaaacacatatccacataaaaacttgcacatgaatgttcatagtagtattattcataatagctaaagagcggaaaaaatccaaatgcccatcagctagtgaataaacaaaatgtgatatatctgttcaatagaatattatttggcaataaaaagaaatgaagcattaatacatgctacaacatgcagaaaccttgaaaacattatgctctatgaaacaagacaaacacaaaaggccacatattgtatgattccatttatatggaatgtccagtataggaaaaccatacagacagaaagtagattagtagttgccagagactaaggaaaaggggtaatagacagtaattgcttaatgagtatgagtatttttttgggggtgggggtggttctagaattagatagtggtgatgggttgtactgcaaaataaatgtaccaaaaatcactgaattgtatactttatattggttacaagggtgaattttatttcaattttataaatgttaaaaaagaaaaataaaacagagagggtacgaggacagagggtgacagggaagacactatttagctaatgtggtcagaaagtgtcttggataagctgacagtgaagcaaagaccagaatgtaataaggttatgagccagaaagatacccgcatctttgttctctgccatttctgtctttgtctctccctctccctctccctgtatcattttttttaattgtggcaaatagatgtaacacaaaagttgtcactttaaccatttttaaatatacaattcagtggcatcaatcacattcatagtgttgtacaaccaccactattatctaaaactttttatcacctccaagaaaattgctattcttcttttaatgctactgtcaggccactaatacagaaaacaaaacaaaacaaaaaccatgactaataactagcaagaaaaaaggtgagctgggagcatactttcattgctgttcagtaaagggtaaatgatgatgattacaattgttttacataggctactcaggctccttggagagagagaaagctgggtatggtggaaaaagagatgtctggcaagatcagccttgtagtgagaaggtccttccctcatcatgaaacactcgattttcaatgatttgctgactcatcaagtgtggaccctcatctctgaaatggttgggtacctcttcacatcccatctattctacggaatggacagccatccaaccaaatctaggtctacaaactcccagcctctccttcacctgctccccaaatggtacataacctcaaaaaatacaacagaactattttgctataacttggcattaagccttaataatttatagaaagagcagtaatttttttctcctgaaacttgtgacatataaatatatgtatatacatatacatgcatacacacatagacacatatgccataactaaacctctattttaaaaaggagacatacgctacttaaagataaaaacaagtaaagatggctaacattttattagtttgaactaatatgagttggttcctattaaacacagcattctcagctttattttctcataatgtcattcttactctgagctataaccctgtttatatattacatgtctttgttacatgtaagaaggaatttaaatttacaatgctggcaggagaaatggatatattaactctaaaataaaagctcttattcaacatacttaaaagtacttaaaacactactgatagtaagctgccacgaggcaatgtgtgatctacatgactctgagcaaaaatatttaaaggaggctctgatgcctatcacaaaagcacactgctgctcacaatgaaacagaagataggtatcacagccctctgagaagcatccaagtgcaagcagtaggtgtgtcctatcttaaagtgctctgatttacaaagtcagaagaaacattttgattcaaaatacaagtctctatattgtagagcaagacaaaaatactctgcaacacacctaggctgaaaataccacaaatgtaattcctaggtgatctcctttacagcaggcgcatcacatagctgacagagtaggcagggtccgggccagcctcaacaccactctctgctttagagctgggcagctggattctgttttcctggcatgctaggcctatgttctcaatctactcacttgctgaggttgcaccctgccagccttcccttagccgttctgctccctctgcccagcaccagatgtcctcctgacccctgcactctatccctaattttgcaaagaactgacctggctcctttacagccccagtgcaccctcagcaccttcccattttgcatccagcaattctattagttggacatggccatgtacttctcccagcaagccctcaaatactcacccctctccaatagcgtccagctctcatactccatctcttctgactgtccctagtccagatggagagacatacagctcttttggggtcacttcctgggctgctgggggaggctactggacttcctggatgggggctcacagtgcttagctccatggggaaactttgcccacaaaatcgtttcttatttttttcccctttcttcttcgcttccacccaccccttccctcaccccctcgcagtaactctaaactgtttactgtttttgaacaccttcattcctgcagggcttcaacagcagtgtggccaagtcagtggaggggctgctaaagctgtcttcgtgtttgtctgtgccactggggcaggggtgtaggatgaccttaagtctccaggctccctaccagccagcctggccaggctgctcctaatgaataacaaatgggccttcatgatgcattggctcaggaaaagctgtcattacaaaccattttgtttttttagcatgtggtaatgtatcatcttgcttggctggatgtcatcttcaagaaggtcaccaaaggtatgtgtgcctttgcccaagactctcctcccacccacccacatccccaccaccaccccttctttaaaggaacgaagtgtttgacacccttgtttggacctatggagccagaacatctaggtctctgcttgtggccttgctagtcagctataaacactccccgttttgtaagatggaagatctttagtacagacagaagacaaaccagggggatgacactgtgctttcaaaattgattttgaggaggaaaatgccctctgtcctaaattaaaaactcagatctcaattcagagagtagaaaaggttttttatcccaagcctcctactattcatcttcatttcacagatatttaaagcacgtattatgttgctatggacaattagccttttatccaattttacttgagagtttaactctcccacccgaaggttttaattataccctcagccccatacttaggcctcggttcctgcagctggaaatctgccccagtgatgttataaccttgttaatgtaacaaaagaggagtttacttaaaactggactgactatggatttaagccaaatttacttgaaagaggaaagagtctgtcaaaaatcctatagtaaacacggcaaagcagttctttcatagccttcccttaattcatagcgacaagcaatttacatgtaagtggattcatatgctctaccaagaggccatctctccaagctggggcgatgtgcaccccccgcctcatccgcctcctttttttcttttctgtcctcccttttagtgtttttttctcttttcttttttggtatgtagagtaggccattctccttggtgaaacagcataaatccacaatgttttgatcgccccaaagcataattagggccctctaaacatttaccaagccagtcactctgaataaaggcagctgaattttcagaaagccactctcagatctgactgttgtcctgtcaacgacgcactttattttctgctgaagcctgcttaaaaagctcgaaaaactcccctgctaatgaggtaagagttgtgagctttgagtaggaattgctgatcaaataccagagcccaagtttttctctgttgccaaaatcctgagggcttcttaccttctgttaattagattaccttttttagtccacacactaacaaaaagcatacatgagactaaacacagtatgacagcaaggaagggactgaagagagagccttctgagaagacattaaagaaaaatatcactcttaatatccctggataaacgggggtaaaagagactacacgggttatttcagtctgcaacgggggaaatccctgacattttagaagcaaaaaccaaaaaactaatttcccccaaatagaaaggtaggggtttgctgtagctacgctattttcaactgtgctcgttgacaaaacccatccatagcaaacaactggccagcactcaagtttctttcatgcattttgaaagtttaattagttctaactagatcaaaagttgcttttcccccttttggcatgtatctgtatcatttctgtgctatttggaaactgctagacatcaaaggcagatccatcattcttgaggaacctccactcctcggatgagattcagatctaccttgccttccttactacggatctcatggaagccagcgcagctggttgcaccccaagatatgcacatagctcattgtcactcctcctgaagagctcctggtgccaagtagcagaaatgctccttagaatgcccctagacaaccccaaagcaaacataacatgtggaaacatggcaaatcctccaaaacagagaacctgtgaaaaatattctaagatggagaaagtccagaacttagcatcatttaagcctttaacagcccatgatatagggacctgttttaattactctaaagttatcctaatttttttttcatttctctctctctcttttatcctttttgctattcattctaaggtcttttgttcaaaactttgaactggattagcaaattactaggcaaatcgactatgtacccaaagccttctagttaggagagcttagaggttataaaagccccaggccttgttggtagaaggccaaggttggcatctcagccctcccccacattagctgtgtgccttgggcaaatttatctagcctctctgggcctcagtttccttccctgtaacttggggagaatattctctctttcatcaggttgttccaaagaattagtaagatgtaaaacactgagccctgtactgtgttttataggccgaatatgcccataggccatgctcagccagtgttaaacatcactctaatcgaagtaaccacttctacttctagaggatagagttgcagtgttctctgctatggccttttaactacaaaagtgaggttgttttaagctccaatttttgattacatactatgtgccaagaactgagctagaagctatttaagcaaaacacacacaaacacacacacatacacatatatgtattttatgtatgtgtgtgtgtgtatatatatacatatatattcacacattttttttggtcagagtggcaagctctatgggctccaaattctagttgcttcttcatctatgcagagtctctggcatctgagagaagccatatgacccacttcaggccaacgacatagcaaaggtccttggaagggggtgtcccttcctaaatatggaaagatgtcctttcctacaggtaaggtcatttggcacttatacttcctcccgttgggacacagatgtgatggctagagctgtggcagaaattttgcaacatgaagacaaaagctggctataacaggataaactaggatggcctagtttatcctggactgcctgtctccagacttgactgttacgtgagaaaacatattattctatttgtcaggttttctgttagagcaggcaagtacattcttagctgatatctaccctgatttctctttggcctagaagaagctacagagaaaagaggatctctggacactttgcagatttacttggacctatttaagaaataattagaggccaaattgagatgtcgaattctgctgttcaaacctgtcacacttccctttccagcagacccaccacatgcagcaggatcacacaacacaatgactgaattatggttttatcattgtctgcaatattttgacttcccttgggttccaaaatattatgttttaaaatctccatacttgccgttggttgggttccaaaaagaaaagacattactggagagcctgtgccttcctaagaagcactgacaagaggacatcttgaagtgagcacattaatgggtgtcctttaaaccctccacttcccattttcccattagagcctccttaatttggcaccccaggattcacttaaattaccttcttagctgggattaggggagcaaaaggagaccacagagccctgaccctgacagttcaaactgtcagcgccaggagactgacatttttctccttgctaatcctgcactgtatggcatggtctcaattttggagaaatctgaatgctcatacacttagccaatcctcaagtgattcagatagactcagtactggataagtgaggcacttatgtatcttgaatatctctgcttgctcgacgccagggcctcaatattttgataaagcgatgacaggaaaaacacagagaacaaaaagcaaaggcaaagaaaatactataagtacatggaaaaactatgaactgctggaatttattttgtgtgttagagaaggaatatagttccctaatgcaattttcaaaatgtagattttagaggccagattggttttccttcctttttcaaggaaactgaagcagagttgggctcagaaaattcaaattcaagggccaatttctaaaagccactttgaatggttttgctccagaatgtgccaaaaaagtacaccaaaaagaactttgaaaaccttctctgtctgtagcagcactgtcaaatagaaatacagcacaaaccagattttctaatagccacatcataaaagtaaaaagaaacaggtgaaattaatattaatatttttattcaacccaaagtattaaacatgtaattaatatataaattattactgagatgctttctattcttttttcacactaagtttttgaaactgtgtgtgttttatactcatagcacatctcaattgtactagccgtatctcaaaatctcaatagccacatatggctcatggctacagtactggatagcactagtctatagtacctatcctctctgtaacacacacacacacacactcagagttaacagcataaaggttgtcattatagcaggatgatatgtagctctttttcaccccttctacccatcccatatactcagtagactgcagaagacataaatcagcagcaggtatatatatatatatatatatacacacacacatatatatatacatatatatatatatacacatatatatacacatatatatatacacatatatatatacacatatatatacacacatatatacacatatatatgtgtgtgtgtgtatatatgtatatatatgtgtgtgtgtatgtgtgtgtttatatgtatattatatatatataatagcttaatccagataaagtttttgttattcaccatttctgactctaaaatagcagtttcatatggtacaaataaatattttaacccaaagatttcaagagaggagttactgtgagattcagaactaggcatatagtggatcttccaaaaagttactgacatgagtggctgctaattgcaaagataacaaccactgtgtattttacatccatgtgcagcaattcattaactattaacacacttggttccttctttttaagccaacatgcagtttctataagtctgaccaaaagataatattttatcaaaaagcaaggcactggccaatgataggtgctcctggccaccatgtgcagcttaaggtttatggctgcaaatgcctgaaaagatataacttaaatgcctcagaagcccttcaaactcagtctttgccaaactgtcaccatcatcacaatcacagtcatcatcatcagcagtaccaccaccacagccatcatcattgggtcatcatcaccattgtcatcacatcattattactgtcattataaccatcatcacaaccatcatcatcattatcaccatcaccgccataatcattgttgtccatcaccactaccaacaccattatcaccatcattaccatatctcctgtttagtaagtccttacttagtctcttttacccacttcttcacctgttgaactattcaatctttaagacccagttaaatatcgactttaagccacccctgcaaccacgtcacaggccaaatgaatttctctctcatttcttgggaactactgaaaaagccctttgtatatatctaggttataacataatgacccaattatataatcttctctacctactttcagctcctacaactaggcctggtacttactacaagactcaaaataaatataagttgattgaattcaaatgagtgagtttcacttcaagcaccagtgcctttcacttggtaatacattccttcgatgctgagctaaaaaatgattttgaggctgtgatctgatatttccaatcattttatatatattctcctttcaaacaggctgtatataaacataggcatggactataactcgtatgtctttgcagatttcggagcactctgcagagaccccctttaataaatattcacataccatacaattcacctacaattcaccattgaactacagttcaatgagtttttgtacattcacagaattgtgaaaacatcacccacaatcaaattttaggaattttttttcaccccaaacagaaccctatacccattaccagtcacctctctcactctccttccaccagccctaggcaaccactaatccattttctgtctctatagatttgcctatttgtcatataaattagatcatacaatgtggcctttttgactggcttctttcacttagcatgatgttttcaaggttctctcatattgcagcatctatcaatacttcatttctttttattatcaagtaatagtgcattgtatggatgtaccatcttttgtctatccattcaacatcaattcatccatttgacttgttttcactttttggctattatacataatgctgctatgacccttcatgtacaagtttctgtgtgacaacatgttttcatttcttttgggtatatatctagaagttgaattgctgtgtcatatggtaactttgtttaacattttgaggaactgccaaactgttttccaaagtggccgcaccattttacagtcctactggcaaatgtatgaggtttacagtttctccacatcctcaccaacacttgtaattgcctgtcttttttctgataaccatcctagtggatgtaaagtggtatctcattgtgattttgatttatatttccctaaagactaataactttaagcatcttttcatatgcttactggtcatttgtatatcttctctacagaaatgtctattcaaatcccttgcccattataaaataaggttatttgagtttttattgtttagttataagagttcttataactcttatagaggatacatatcccttacaagccacattttgaaatatgacttgcaaatattttctcccacattgtagtttgtctcttcttgatagtatcgtttgtagcacaaaagtttttaattttgatgaagtccaatttatcacatttttctttagttatttgtgcttttggtgccatatctaaagcagctttatataacccaagttcaccaagatttatgctgatgctttattgtaggagtgttacagttttaactcttacatttaggtctatgatccatttgagttcacctttgtgcatgatgtgaaagagccctgtacatagcttagagttttaagaaatcatccattaagttttttgtgtatttcacagccacattaccaataatgtcttccttaatggcaacaatatttgagtatgctttctcttgagtattttagagagagatttagcattcaagatgtccagagaaattaatacaggaagaacctgggaaagcttcaaagcttgttcatcatcaagtcactgttaatgttggtaaaattcccccaaaattgattttacatcgtcttggatatcttttatgatataaaagatggttatataattttatataatataaaaatggttatacaatgatataattgtcttgaatgatttatatattctgaaaattgaaaattcattaggaatttatgttttgttttgttttgttttgttgctttttggtgttatttatccttccttcctccctcccttcccttccttcctgttttctttctcaacacactctcttccttccttcctaagtcccttcctttccttccttcccacctgcctttttcccttatttacttccaaatttcctttcctaattcccctctcaaatcaagtgtaagctgcctgaaaacctcctctatgtcttgatcatcttggcaggactttcccacccaccacacccacctcccacacacagtgcctagcacagggcctggcatgtggtaggtgttcaataagtgttttagggtttaactcaaatagttaagccctttccatgagttctgaatctaagctgtaagggttctagtcatccgtagtgaccatacatacacaatgccatctgtattcagtttgggtggtggagggaggggaagcatttattttacaatgactagagaataataagcattgcttcatgtagatgaaaaaaacaagagaaaaaattgtaacaaaatgcaatcgcatctatgtgaaatgtatgcatgagaaaagagactaaaggaaaacagaaataaaatgtcaagtctttttcttgagtaaactcgttcttctttttgctagtcaatatttctcataatatgtatgcataatttctatttttttaaaaagataaaactatttcaaagtaaatatcatttactcttgattttcagatattaaaagagatgtaatgtcactgctattggtcactttaaaatgtcaaataagagaaagcacttttatagctataaagttttatacaaatttttattttgtataagaattattcttatcttgaatgatataatattattcttatcttggataatcataaaacaatgattcaaccttattcagcccattatactgttaaaatacctagcactactagaatttccgatcatctagcatagataattttgcatattcatttggccctaccatgacgatagcttacctcctcctcctcctctctcctgctttcctgacgatgtgtacgtttctacatattaaagaagaatttcctggtcccttaatctttaagtgaagtaagctctacactttcaggacttattagaaagcacctaagtgggacgagtgtggtgtgtggaccatggaactgtgcacaaacacaagtgcacagtcaagtcctgcatctacaacaggcaggcttttctccagatgtggagtgagtgggccatgatataatccacatctaaaaagtgggaaaatccactggattcctgtaaactgtttgttgactggatttaggaaccctggagcctgtagttagttatcatttctgttctggtgccattgaggccgaagtgaatggtgccaagagagtttcaggagacaagggcataattcagacagctcacaagaaaaagaacaaagacatctctggtagcagaagctggctctccctccctcccggctgatttggtgaagcccctgttctgtggacttccacatcagaggctgaagccgtcctagccctctgctggctgctgctcagtaaaaacaccataccattccataattttgatcattattacttcctcagttaatgaaacttaaagcatgttttcagagatgctaaggggcagaggcccgttttggctgaggtcagccttggcaggagtcaactcttcttttcctaaggttttatattcttttttaaaatcgtattatttcaagtattgaaataagaaaacattagattatgcaatggaaagtggctcatggttgctgccacagattttcatgtatatacttttagttgtattaaaaagcttaactccaagctggagttttaaataatattttccaggctcaagatctccctgaaaaattccaagccagttctgggagcctctttcattgtatatcttatttttttctaaatccttccttattataaacatataaattattcctaataccttcatgagggaaaggtaatgccaaaaattttatatccagttacagttgaccaatgtgaatgtaaacaatgttgctacgcattttggagatagcctctctaatggcagcttgggataaatgacttgggttagtagccagctttcagtggtaacatgttaagaagaatgtgaaaatggaggaaaaagggggtctctagccctgcttggtggggaacctatttgtcttaaggcaaagataaggttaggagtcaaggatgttgtggtagaagattatctattattgcctacttacggagatgacattttggaacctcctctcctcccctcatacaaatgacagctttcagcagaaccttccagaactgttctgaacttttagcaagactccatctgtttaatcatcaaattctttttattcaccatttgaatatttttttgattatgggttccatatgaaaccattcttctgtccccccttctttacctccccaaattcttccaccacacaggtcgtagtctcagttgaaatgaccctccctcctgaaagcattcctcaaccacatgactccttcccatctggaaagccccatgatacccaggtctttggtctttccttcccagagcacttaccaccctgtattataattaccagcttatcccaccaacttccttattagagtgtgagctcgactaggcagggaccatgtcactagggccagatgcagcaccctcccagagaagatgcccagtaactatttgtggaatgcacagagaaagaatgcacaatatccaaaggagatgaatcttcaaaacccgtcacaagaagagaagggggaaccgacactttcacagagaggcgagaagattctgcagcatagagtgtattgacaagaggagaggacagaactgtcctaaacactcaagggttgtgaaaaaccgaatacatcagtggcctcaaaaagcaaatgtaaaagaaccaaagaaccaggaggtgaaatgataaagttgttatagtataaaaaagagtacaatttttttttttttgagacagggtctcactctgtcacccaggctggagtgcagtggtatgatctcagctcactgcaacctctgcctcctgggttcaagcaattctcctgcctcagcctcctgagtagctgggaccacagacgcccgtcaccacgcctggctaatttttagatttttagtagagatggggtttcatcatgttggccaggttggtctcaaactcctgacttcaagtgatcctcccgcctcagcctcccaaagtgctgggattacaggcatgagccaccatacccggcagggtagacttttcaagagacagagttctctgaagaaggaatgagttccctcaatgttaagtagatttattaagacttgctacttagcaagtcttagcaatccatgctaagtgttttacatgtaccaactcatttaatgctcagaagaatcccacaggggagggaatgtgatttacacacttggccaaggtcacagagccagcagagcaggtgtagggccaagattcaaatccaagtcatttgatcccctgaagcctggacacttaccctcgtgctaatgcaaccctcatcacccaggggtcaagcagatactaagagacccattcccagggggctaaggagcccaaggagttaaggaacaccaacggatgagattacagagcagaaacactgtttccatgacgacatttaattgtcaccactcagtcttccttggctcaaagccaactctcaacagaactgtgatggacgcaaagtctgttttggtgtgggactgtggccttcacatttctcaccccatttcagataccttctctccctagcttccattgcagccagggctagaatgctgctcaagttcctgacccagctgttacggcattttgaatcaatcctctctagagcaaacagatttgaaagtcaattcaagcccaacacaaaaatctagctcaacccagtgatatccctggttacctaattgagggatatttggatatggaaaccaccccactgaccccacaaatcaccaaagtggtgtcaaagttggatgtacaatagacattcaaataatcaatactggagtaagctcccagaaagctgggactaagccatgactggatcaacatctagtacagtgggaggtcctcagttattgctcaataaatgagagttgaattaattaatgctccagagcaagcaaccatgaagaagtgaattttttcccaataaaacaggtggttttgggggtaagccaatgtgatgcttaagaaaaacagtgcaagaagctgagtggcttatgttcagacctcaccagagattcaggtgtttaatttccctacaaagaaggcttaatctcagtttcattctctgcagaaaagctaccattaatcagcatccaagaacccttaggtgtagataatgtgaccaatgatcagttcaagttcacactctgaaagttgtttcttcaaaatccggaagaggcaccattcggccaagaagttgaaaagagacaggaatttatatgcagaaatgtcaataatcataaagagataacaaaactctaacgaagatgtaattatgtcaaccctgggacatcaagacttaagcaaaatcctcaaagaatagagccaaaatcaattaaggaatgtgtcagtggtgtaatccttctgatttccccatataataccaccaaatggtccattttgctgttttacagcaatattttttaaaaaattaaaatctaagcctttcatatttgggtgccagagggtttcaactctagggggaaaggtcttcattagaattcacctctactttaaagagtttgtaatttggtgtcaagatgtttatctgaaaaaataatgtttatactgaaatatttacagatgaaatgacataatatcttagttttgcttcaaaataatctagggatgaggcaaggaagtggggaatagaaaggaaacagactggcaatgagctgataatcgctgaaattggatggaggtcatgtgggggttcactttactttagtatataattgacattttaaaaattaacagtaatttacccaagcccattggcccaacagggaagagatggtgttcctaggaatactccactccattctacagaggcatctcctgcctttggaggaagagaaaccactactcatcaacaccagactcatggtcatacctcatttgagggcttgtgtgtttctctccacatatccgcatggatgccaggcttccatgcaggcttctcatggcaatttctaaaaaaataggatttactaggggattcttaattaaccaaaattacttaaaagtctgttctccaaatataggcatttgagaaactcagctttgcaaatgcagtttacttaacttcaatagaaaagccttctcaacaaatgaaagcctgcaaaggaaagcttcgtagctatttaggaaatagttctccagaaatttgagaggcaatgcccagacatgacagtagattataaaaggttcatattggaatcagttgcatagaactgaaaaggtttatgtccccagagaaaagaaaacggctctgattgatggccaagtgtccaggatataccaccaaaggctgaatagtggaaaacgctcctctctaagctttctgaatctacctggtctgggcccctctgcctccagaggtgctgggcatgagccagtgttaaaactctactagtgccactaatacaccggctcaaggtccatatttcaggaaagagctgggccacaggtccaaggtgagaaacaacagacagatacaggctaggactagaccagctgttctcaaacaggggtgattttgccctctagaaaacttctggtggtaatgtctggagtcatttctgattgtcacaactgggggagggaaattgacactgtcatctaatgagcagaggccaggaatgctactaaacacaggataggccccacaagaaagaattatccagctcaatctcaacagggctgccctgagaaaccctggactagagcaacatttgccaaaataattcccccacagctctcctgcatggaatgatggaagtgttgatgggagccaatgcagagtgggcaggaagaaaggaaaaagagggtcatgcttctagtgtgcccacatccaaatgtattctcctcacaaaagccagaggcagggtggtgccattgttaaacacatggccaaaccacaggacaatcctgagaggttcaaatcccacctttgctgtatgacctgggactagttacttaacctctctgagcctctgttgcccgaaatgtaaaatagagatgataacagtacttatcttggaaggttgttgtgaagattaaatgaattgatatatataaagatctttacactgtagttatttgttatgattttcaaaacacaatccagtcatgtcatttccattcaatgagtttctgctttaggataaacatgaataatctgatgatggccccaaggccctgggtggtctggcctctgcccacctctccagcctcaaccaatctagttttcccctttgatctctatgctccagtcacacaggcctccactgagcaaacagaaggcaagtcagtccttctgccacagggcctttgcataggcagatcctctcttatggacaaactccccttgaccccacccaccatccccaccccttcacctaatgtagctcccagacacatctcagggtgccttcaggaagcatgggtccagggacctctcctctttcatacacttacccagctgtcattctgcattctgatgtctcatcctttgactggacattagactgttaactaggtagtcaataaataaatatttgtttattctctcaagaaataactgacttcccagcatgatttgttttatgaatgagtcagtgactaaacaaatgactgaatccatgagaaggagcgcttagcttgcctgacctcagtctagtgtgttgcattagagcagttgcaacaaaaagctgcaattgccttcagcttcctggaaaccaaaaatgctctgagcttgcctcaaagaatgctacccataccttggaggcagttgacttgtacttggccagggactcctagaatgttctctttgcttctgtctcaagaaactcagtcaaaccaactttctctaggctgaagaataaggcggggaggcttttctttgtacatggaaggagtatgggggtgttttcacttgacccaaaactgagactggctctggcaactccagccccacatctttctaaggtaggagcagcagcagtcattcatgttgaagggtcatttgaaagccattcttctttacaaaaccacagaatggtggttttgttttggtgctttgactttagtatcaatcagcttattttcctggaattacttaatatgagaaatgtaaacattttctagcaacatattctaacacttgttagaatgatttaacaatgatttgttaagtcattctaacaaatcttatgtatctgaccgcggcaccatggccttccccactgtactggtctgagtcctgaagagaacagaattcgccacagatgattccaatgaggagacttccatggagaagctacagaagtaggggtgggcagggttaatgaaagaaatgagaccttgaggcatccagacgctagcaacactggacagccgttaccacgtatcaggctgaaggagcaaagggagaaatgaatcaatcccagcgacactgggagccatgaatgggcactgctgagagggagctacagtcatggagagaagctgctatggccagagatgtggccccaaagcaagaagggaagagggagaaaatcctctagatttttttctcttccacctctcccatcacctgaagtgcctcttactggccccagaccctccccagagtcagccagcaagggatccccagtgatgctgctcacagcagtcagcttccaggaaaaatgaccaggagaggggaagcagagaataaccactgggcctacccaatcccacactgccttataataaagcattagttgacaggagccttgaaaatacattgaagggaacattttccaagaaaacttccagaggcagagccaggaagagaaagaagctccaagctcagggctcagtgaactgaacacaaaaacaccaatttcaaaatagagtggaatgacagcaattgaactgttatcataactgcatgctggcactggctgcagtgcactctgcaaatgtcttcaagtaagtgaagcatcaggggtgaggtaatagcagactctcagagttggcctcagcttcctgcaggttcgaattaagatcccagggaactggcttaaccaaaagatcaagtcaaacactgcatttcaattttcacaatctgttggttcccaaattccgtgactggaacacaaaagacttgtcccacttgactggcagcttggctttgagctatagttctcgatcgctttgctcctgggaactgagtggtcccccttaacacacctcattccccaggcaaaattgccagagccagaccctctttttctgcccctaaactcattcacacacacacacacacacacacacacacacacactctctctctctcacccctcttcccacatgtttggtctactttggtctgcctcctgcccaaaagtcaaaattacaatctagcaagataaccatgctgagacaatgcagaaagcattttgaacccctgtgcttttcaaggcaccagaacagggataggaaagggggaaaaaagacaaagaggagagagaaggatggggaaaagttaagagaagaaggaagagaggaaggaaaagaagaaacaggacatggagtggaagagaagagagagtgggtaagaaagggggaaagaaaaaagaggcagccagcaagaagcaaagtataattttcatcaacattcattcattcatttgacaaacatttattgaatgtttaggagggaccaagaacattcaaagcccacctccatgctattcctcccttaaaatcctctgagtcttcattgacatggatccttttgaaatagctcgttccagtgaggacatagatcttgaggtttaccttttcatccttagggttgagacttcacttgataatatttggactggattttaccaaggcaaagaaaatgttacaggaaggcagagaaaccctatgaattgggatttgcccaagacctgcccttcatggttgaggcaggcatctggcatccaggcagcagtttgtttcccttggatgcccacaggccctgcgctgtgttctcacttcaccagtgttctcatttctcttctatcctttctggtctaaatgaacattgtaagaagtgcttccctagaaaaagatctggctacccagagggatgttgtgaagaaggaacaaatggtaaggagaaacaaaagtggaaagagagtaaaaggggctgttataattgtgcatcaatttacaggaccagcccaacccttgaggactgtccaatttcacactctcaatttatagctgggcacactgtggaccagaaagaaccacaggttaaagaatgatggaattctggagctagacaggattatgttgtctgccaagcagcaggcattgatggaacaggtcttttggattccagccagggtttacatctcacagggagttccatcccctgaggatttgaatctgagaactgtgtcaattccactggggagctacatagtgagctggtctttaatgccaagaaagcaagctagaatcaagaggtcaaagtcatctatacagaatgggaagtccccaggccactacaacctctatgcctgatcattgtgctgaacaggaaaatatatcctgtgtgagttccatgtgaaaataagtcaagttaaatcagagatgagaccctacaaagctcttctctcttccctagtttaagaaacaccagtataaaaaatgaggctagttacaggttcctcaacctcagtaccactggtattttgggccagaaaattctttgttgttggggctgccttatgtgtcataggatatttagcagcctcctggcctctacctactggatggcagtggcacctcccctccagttgggatgaccaaaaatgtctccagaccttgccaaaggttcccctgataggtaaaaccacccccaattaaggcctcagagaatcactgaatattaatgaaatcatctgagtccacaggcctgttcacagatggaaagaccaggtcaggcgtgcctgggcttaaccaactacaactggcagagtcaggctatgaactagagtgctcagggttctcctcactgcaccgataattctttttcttttctttcttttctctttttttaatttttattttttcttttttttttttttgagacagggtctcactctgtcactcaggcaggagtgcagtgatgcaatcacagttcactgcagcctcaacctcccaggctcaagagatcctcccatctcagcctcccgagtagctgggaccacaggtacacaacaccatgcctggctaactttttgtattttttgtagagacagggttttgccatattgcccatgctggtctcgaactcctgagcccaagtgatccactggcctcagcctcccaaagtgctgagattacataaataattcttccttcaggatttgatgtgtgattcctctgtactctcggctccttagtgtttctttgtgtgatgtggctgccctgtcccttgcatcaaggggttaaatctggcaacgccccctacagtattagatcaggtactggtcagaattctttcaatatgttgctgctcttggattggaagaaagggccaagactgcctcctctgacttaccatgttttaggaggttggaaggcctgaatatttcttttcccttttcttaatgggtgaccttccctagcccccatgcggctgctgtgaagatagagataacatgaagtatggtgcttggaattatttaaactctatgattcacaagcatttagattatttaactgctgattatgattatttaggctgaaagactatacttctctagctcagaaaatgtttgtatttccattaaaaaccaccaggctgaagtcccttttgactgacatttttctctattaaaactatacatacagtgcatgtttttggccggaagacagtgtgtcccttattttgttttaagataaggaagccaacttcaaaggccttctccaactagttctcctcaggcccccttcctcccaccatctccccatcctgctgtcctcctgccccaaaaaagggaagaagcacctatctgcccactgctttctactatttaattaaaactggtgccaccattcccacacttgaaattcttacactgatatctcaagttcttcattggaagactgcactcaatggctaagactgtgaactatagtgtcaaacagacttgtatttgagttccacatatatgagcctcagtgtctccatccacagaatgggggcaataatactccccgcctcacaggaggtgacagcactatctgggtgaagtacttagtccatggaatcagtacttaataagtgttcactggtaatattaatcccatcccccaaagtctgcatgcactggatagcatatatgcctgggctaatttaattctctgaagacattttaatccaagatagtacattcctcaaggcagggatagtgaaggactcttgattctacctgacatgcaatttaactcactttaattatttctctataatgagctatgaaacacatccctgcttggctcatatatttaataacctaagagttttatgaaaaataaatgcctaaaaattcagggaaaattctattgtggatgtattagagcagtgtcctaaaccatgcagtaactttcttttttctttctttttcttttctttttttttctttttcttaatttttttttttggcagagtttctgcattcaaattaagtccctcaagggaaggaacgaaaaagagcccagcatttcctaagtttcatctacgtgacagggcatttatttagtggaattacatacaggagggtcttggagattgcctttgcctttcacttgggatgaaaatttcctctgcagcatgcaaaacaggtgagagtgttcctgctgctacagagttcttttgcactaaaagaaaaatcttcctcctctcaaattttgcctaccaactctagcacagtcatctgaggcagcatgaatcaagcccagttttcttcttacagtcacttccttaacagttaaaagaagcatctgtcttcttggacttctctggacctaataccccttataggtcagctatccccagcacaaagagattttcaggaatacctcaacttgttcactcactacatgcctcctcacagtctaccaaccatggtacccagaaatgaactcagatatgcactaaacatacatgcatacacatacatgtctgttaggaatagactagaggtgtaattgcaaagttgttttttactgctaagtgacataacataccagttgacctatttttcttcacactttattcatgttgtcagagactgccaattgcccccaatatccattctttcctttccttccttagaactggattcccagaatgcagctaaaggctatatttccctgcttggtcttgaagctaagtatgaccatgtggcttaaaaccctggccagtgggccccttcccccacacttgttctcacatctagtaaaatataagctccaccaacaggaggatttttgttcatagagtcctttctgttcactaagaacagggcttagataactgcctagggcttagaacagtgcttgcacatagcagatgctcagcaaatattgaataaactgtgaaatgactcagatgtcaatggatgggatgtgtaacttaaaggacagggaggtttctttctcgtgcctcctttctgctggttggaatagggattggatagctggaactgaagcaaaagtctcacactaagaggtgcaagcaaatgctaaaaatggcaaaatgtcaagacagaaggaacgtgagtccctagtgattacaaagctacttgtatgagcttctggaatgtggggttttctgattcttgcatttgaagctaactagaacattcctctattctaaagttattttctttatagttaagttttacttacccactataagttttatgttcagcatagtttttttgttgttttgttttgtttttgctatagactataagccatcaacttcagagttaaaagaaggaaacagaaatctggagtagtaagcaactgtgcatttatgtcactgcctgcagctaaaaccaaaattggttttgaatgagtcattttttgtgacatttattccttccctctctgctacctgtcctgactcactacaggtaactcagaaagctgcaataggctttatcagtgttctagctgatttaaatacctgttggaactgagcaggtagtaaacagaaacagatgacaaacaggacattctaggacacattaccatagtatttaatatttttaaaattggacatgttaaagtttttctcaataaactactggttaaagaaagaatagtattatagcaaaaaaaaaaaagaaaaaaaagaaattcttgaatggagaaggccaagttgtaaattaaagacaggattagtgtatgctaactgtaatgaatgtacctaacatactaatatatgtatagccttttgtgggttaaaaatcactttctcatgaatttataatctcagtcaatccccataagatctctgtgggctagcacaaccctcttgtttattgagtttatcaattttaagtaacaattggcttcaaaactcttctcccaaactccatttatcctgtccaaattgctaggcacttaggattccttcctaaagaaatgtgatttgtcttttctcatgttggcatgaagtaaaaaataaattgattttatcatttctgcacccttgctctcctttgaagggtacttacctaatgagtggctctctcagaaaggatcttagatcaaagaggccaacaggataatgccctcgaataagctgctgtcttacctcactgtaaatgtcctaaaataatccagtgtatacaaagacttgtgaggctatctggagaagacgtctaaaacccaacaatacccagtaaattaagatgaattgcaccatatcgtcagatgagttaaaaacaaaggggcctgctgaaaatgtttgtataagcataggaaatcaccacagaaagtctaaaataaacatttcaaaatatgtgactattaagcaggtatcaaaacccttattcaacttagcattttatactaaatgaaaaatatcaattaggatgcctgtctacctattaaactactatagtagtttaaatcgtcaaagcaaatgcacacagatttttaagtactgtatctcatggccctcaatttcttttagccacagatttcaactccacctgccataaattaaataactgggcttttgttactggaatgtaagcttattagctggcattaataaaatcaaacataaaatgatgttcttaatatgcttttaataaaattcctttaaaataggagtaaatgtaacaaaattgaacaattatgaaatgttttagcaagaagttttggatatattttaagtacaagaataatcttatacacaaggaaaggtgaatattatgtactatgaaaatatatggttggtaactgttagtttcttccagcagaggaataataactggcagttagaatatcaaccaataaagaccagactgaagaagggtattgctgtggtttgaatatttgtcccctccaaaactcctattgaaatttgatcccaggtggggcctaatgggaaaacggtgtttgggttgtggggtgaatcccttgaatagattaatgccctctcccttgggggtgagtgagttctcactctgctagtttccctgaaagagctgattgttaaaaagagcatggctctttccctcatctccaccttgcttcctctctccccatgtgatctctgcacatacagctttcctttcccttctgccgtaagtggaagcagcctgaggccctcaccagaagcagatgctggcaccaagctccttgtacagcctgcagaaccatgagccaaatgaaccatttttctttataaattacctagcttcagtattcctttatagcaacactaaatggactaagccaggaatgttgagggaaataatcatacacatgtatacaattggacttctgtatacataggttccacatttgtggattcaatcaaccacggatcagaaatatttttggaaaaaatgcatttgcactgaacatgtacagactttttttcttgctattatttcctaaacaatacaaatgtaacaactattttcatagcatctacattgtattaggtataagaaggcaggagatgatttaaagcatacaggaggatgtgcgtgggttatatgcaaatactatgccattttatatcagggacttcagcatctgtggattttggtatctaaaggaggccctagaaccaatcacccacagataccaagggatgactatagaatcaaggctctccttttgaatcaagttggcctcagttcctaaaagtgttcccacattacaggaaaatacaccacactttccatgtccctccatgccccaaataaacaagagggtccttacctttggaaatgactttctaagtgggattccaaacctctttggttacataagaaactactttatctatttatctattcatttatttgcttatttgtttattcatttccttcactcattttactaaaatgcaagctcaacaaggtcaagtttgttcatctaaaagagtacctagcacatagtagatcatcagtgaatatttatacattttttaactaattcatcctttcatttttcaaatactttttgagtgcctaccatgtgacagattcacaatatccaatattaaaagaaaattccactgtaaataaaatcacatcgtgagaaatctttacattggaagaatcaggcaatatttactcactctaaatccagttggcatttaaaataagagaagccaaagaagaatggtaggagaaaatgtaggtcagtgtggcacatgtcccaaaatgatataacacaaaacagaactttgggtaaaaattaaacagcctaagagtggatgtaagtataaaaggatagtaccagaggtcattgtgatgattaaacagttctgcatcttgactgtggtggtggtgacacaaatcagcacatgtaataaaagtggatataattaaacatacacacacacacacacacacacacacacacaagtgcatgtaaaactggataaattggaataatgttaaggccgggtgcagtggctcacacctgtaagcccagcactttgggaggctgaggcgggtggatcacgaggtcaggagatcgagaccatcctggctaacaaggtgaaaccctgtctctactaaaaatacaaaaattagctgggtgtggtggtgggtgcctgtagtcccagcagctcgggaggtggaggcaggagaatggtgtgaacccaggaggcagagcttgcagtgagccaagattgcaccactgcactccagcctgggcaacagagtgaggctccgtctcaaaacaacaacaacaacaacaacaacaacaacaacaacaacaccacaaaactggagaaattggaataatgttaatagatatgtaaaactggagaaatttgaagaaggctggtagattgtaccaatatcaatttcctcatgtgatgttgtactttagttatgaaagatgttaccaattagggaaatggttgaaggatatgagaaccctctttataatatttcttgcagcagcctgacaatccacaggtatttacaaatatgttaataaaataaaattaaacagcagaatgcttatcagaacactggaactgacacagatgcccaataatgatgtaaacctatatgacagtatattgagtaattaaaaataatgcaatcctatgtttgcaacatagaaggttgttcacgttcacagaagaagaggcacttgcaaaataggcaagtacagtccaattttctttacaaaataaggagcatttgcaaagatatacaccaaaatgccatcagtgtctctctctccatgttaggatcatgaataatttttttcatattgtttctttatactgcctcttttttttcccttaaaatgaacaatatcacctaacaaacatctaaacaaatatctatctttggatggggttcaggtaaattctgtatagctctggaacaaaaaccaagacaaatggaaagacatttcagttcaatataatgacaaatgagctacctgtaagagccatggaacatgaaccaccaccttatgagcccatggcctgccatgggaatggtattcaccagggcctggtgaattccttatgagtaatcctgtgaatgggagacaggcttctgcaggctgagaggttggacccagttgctttccaattctaaaactctgtgccatttggtttgcaaggaatttaacagataccacctctcctttcaaaagccccctttaggtttcaaagcactttcacatgtgctggtttatattaattttagtttgctgcttaaaaaaaaaaatcttatccctacaagagttctgtagagtaagcagggcaggtattatcacctccattttactgaagagaaaactgaggcaaccagagagtgatgtttaatgttatggggtgagacagaaattagttatgaaatcacagtttctttctcttgactcacggcctcacccctcttccctctaacatcacacagcctctcccttcccaccagggtttggaaactgggtagacctgacctaaagatgcctgtctaaagataatgggtgctggttgaatgaaaaaccaacaatgcttggcacagatgatatcaactcaccaacaatgataatacccatctgactgttcccacgaacttatgtggactcaatcaaagtcaagtaaccagtgtgtcaattcagcttaaacactgtgactgaacaaaccagtggcaaacttgaacagcccaagaggctggtgcctctagttgaggatctcagtcaatatacttgccctgtacctaagtcctcccatagtcccagggcagaagcccacaggttgggcttctaggccagttaaatagtgaatagggcccatatcaggcttaatgaagcagggctttgttactttcaccaaaggaattaacacaggaattttgtatttattttgcagtggcagcagattaagcacttcagcaataatgtggcaattcaccaaaagaggtcttagttaggtgctatctgaaaccatgaagttaagtgggaaaacatacacatggaaaaagtttatatgttttagaaaaataaatccaaattttagataaatgatactcttcacaaagtatgctaaacagaggacatattttcattggctgatagtgccatttgcatacatatatcattttctgtgtgccaaactctctgctgagaacccctcctcacaaccacccccattcaagtcattacaggaggaaactggaaggttagtgaggttaagggcatttctcccaagtcacagccaccaggtggaagcaacaggattccaccctgggtctgatgactcacaaaccagcatatttcaccattacttgttctctcaaaatgttgaaagtatacgctccttttataaacaggaagtaattaaaatttctttataatagcataataaatcacttcaggagatggagagttaacttgagaacagctggaaaacaaggagaaaaactaggctggacttgacacataacacacagggaggaagacgagagacaggtgaacaggaaagaatacaggctgattgaatcaatggacccatattgctaatgcactaatactagtattggctattgttgataaattatttttattctatactacatttattatggaaagtaaaatgcaaaaaacatcatatgataaatttttcaagggtaaaacaaacttataagttgaatttcagtatttttaatctccattcaaaaatcaaatccaaaatgaaggtggaagcatatgcaattccaaaatctttctctattcttatataaatcataacattccatattgttttctaggaaatgaattttattggtcaatatcagcaagatggaaactttctcaaataaaccattttatgaactttgtatatagacattataaaaatacataactttagattctaacatgaatacattcataaatggactttccactttgaatattgctgtttcttcaattatttaatactacactatatttttggtgtttctcagctaagtgtttacacatatattgacatttataatttttctgggtgtcatttaaattcatacacatattccacaactaattacataagttaatcttttaaacaacagtaaatattggcaaacatcaagattttatatatgctgtgcttataaacatgtatccttttaacagtgttaataaattattgatgaaggtgataatatcgcagatacttaaaatacttttcttcttagctacataaaattcagtctccagtattcaatctagtcactcactcaacaaaccattgagcacctatcacattcaagacactgttgtgggcaacaaacaatcattgagcacctcccatgtgcccagcactgctcttgtctgcataatgactacagtgactcaaacagacaaaagttctagtcttaatgagttcacataaactcctggagaaaattagatagcagaaacggaggttgaggtagaaaactggttttgtcatggccagatggccttaagcaaattatgaatctctctgagtctcagctccctcacctctgaactgagtataataatacctggttttattatattatcttttattagaaaaaatgctagtttatatgtgaaaaaaaccctatttattctttggtcttggagaaactgaggtagttgatgaggaataaatgttttgtcctcattattaaatccttcaaaatatttcattccaatattttccatgatctaagctttctgagtttaatgctaaccatgtgtaaggcttgctgggtcacgataaggtcacttccatacctagccaccaatttcaaagtctgtgttataggcttaagatgccgtaattatgtatgtttccccttactgtggagggaagttagatttaaattataatttagtgatgatttcatttaaaaacatagagacgctccttcttgactagttcttcacaaacagacctattgcaattgatatttattaaaatttctcagtaattttctttcctatgttattccatgatgatgctctttcattgtgagaatgaaacaagagtgaggtgtaggtgggtgtgtcacaggaccacaggaacaaccatttcccagcactcagccccatgtcattgattaaatcaaaggaagcaattggttccaatccaatctccctgatttagcttcccaagcccccacctaggtggggtgtggcggggtgtgggatttctaacctatttttataagcccagcaaatcaaagtttcactttctgaacaaagaggtgccaaccttgagactctgtgagagtcaacacaaaccaggcattgtgcacaagtgagaagaatataattagcaaagttacagtcacaattaggaaataactcctcagaaaagtttccacttaactctgagcagcgctcaaattaccattgtgcttaacggggcctccatctcttggctggctcagacctttccaacagatctatgaatcccagcaccatccacacaacacagacacccaaaatctagtgctggatctatatttttttcaataacagatgtgagaaatgtgcaaattgagacaccaaagttacaattaaaaaataagaaacatactttcagaaatgaccaggcaagtgtgagctaaattattctttttctgagctctttcttcatcttctctagcccttcccctttcccactctcaagagaggctagaagagagaggctaccaaagcagcaatgggtactcacttcatctccaggatctcctccagctgtttcctcctctcaatccggaggttggccaagtgcgcttctttttcggccagggactgttgtgtggaggcgaggcgtgctttggtggcatccagttcctgtctggtcttctccagtgcattcatcagttcctctatctgaaaggcacatggagctctgtgtgttatttctccttcattcaagcacaagacatcccttgttagcctgtgttccaacaacaaacacaaaggaatcacagggatccttgaactgggccgctgtgtcttggagccctttctttctttgtcattgaaactatgaaaatgcaaatgcctaagaatgatataatggactctggggagttgtggggaaaggctgggagggggttgagggataaaagactacacattgggttgagtgtatactactcgggtgatggttgcaccaaaatctcacaaatcaccactaaagagcttactcatgtaaccaaatatcacctgttcccccaaaacctatggaaagaaaaaattaaaacaaaacagaacaaaaacccttaaaaaatgtttcaaacacaagaaatgtccaaatttctccaaggtccttgttcaattggattgcccaataacctttataaaactacttaatgtgttcactagaattgggggtgagtggcttgacccaatttcaacctctgtttggcaaaagtctcagatactttctcaccattgaaggaaggcaacactcaaatgcattttgcccagcacaatatacttttgtgtgtaggccccagagtactttgaaagaaagttaatctatgtgtttcagattcagtcacgttttaacctatcaaagccgtgtttggtaaaagctattcaatgtccagggagcctcaggagtccctctcacctcacctcccagctttacattcaggaagcaaggtttggccaaaggtaaacagaattccagccacaaaaggttcaagtttggtttgcccctgaagtttgagagggttctaaacttgaaataaatgacatgtaacttttatagggtgctaatacaccatagaaataagccagactatcaaatatccacggttttcagccaggtcccaaaaaatgagacccaggagccctgaggcaaagccttatcctccccaaagctttggggactcttaaaagccaacacacaacaaagaaggctggtgtttatggttccgttccaaagacttccgtggagcaagctggtgaaatgccatcccttgcacagatgcaggctgtgtcctccctgctgatccaaaatcatgattccaggaagtttctagattccagagctgatgtttggctttctaaaataccccttccagctgaacttggcagaataggctcatccatcactaaagtcaacagaacgcccttcaaaatgtgtcaatgacatgttaagttccaattcataaagactttctacacaatttcttcagttttacatgaaatttattcagaataagcattatagttcacatccaaggtaaattatatgcttttaagattcagaaaacccttcattttgccctgataaaaagaggaaactgaatgatcatgtagtttaaatcaaagccaaaaccaaaaagagtttaaaaagcaaggaatataaagaataacctatgaaagtgacaaaaccacccctatgtaactgtagagtaaattgaattattctttaactttacaaatctatgcagtttaaaaagtattaataaacttttcagtttctcatataagttcacagaacatcacaaatatgactagaagcccaaagcaatatgtgacgaagttaaagcggagttttgagttttcctccctttttctatttttgatagaaaatagcagtgacccccaaaaaatcagaattatgatcattccatatgccaattcagatagtctgcctgaccctccatatgagatggtctgtgtcctcatgattccttttctgtcataaatcgttctttatttcaaacataatattgatttcagaggagtgggaggtctccattattctcatttgttcaatctctctctcattcatcgaagctgatctatctgcaatctatagacacagagctactcagctgggtttccaaatcttagatcacctgccactggaccgcttagggcaaacactagctagttctacattaacccaactttaaatgacactttagagtaatgatttcaggctgctccagccatttcagcaagaagcacatggagaaactgggcacctgggagacacaatacagagttgtaactgatggagaagccactggcctccaacatcagtaactgctagtatcagatgagacgaaactgctcctctcaacatcttggagacagagttttaaaataagttcccaggccaagctcctcactcttcctaatttgtgtggccctggaccgaggaccatgtggggcactggcctcagaacacatccttctagttttagcatgaccactgcttctctctgtaactttttgcaaacaatcactataccctcggaatctcagtttcctagatgatggccatgggttcttcctgtgtttaacattctagagaactgaaaactgtttcctttgctgccaaaacaagggccttagaaagcaaaaaatatctcccctgctggggtgatcattagggtggtttcacaatattctagttctcttccttacaggcacatggtaggaccccacatcccctcaccctttgaattgggtgtggctttggccaattaaaaccactgtcatttccaggtagaaacatttaagtggtagcattcaactccagtgttaccctttccctgccctggtgaccgtggaagcaagtttcagatgacatcatcttcagcctgagtccctgagtgaccacaatgaagcccagggcaaacccacatcacataggcaaaatataaacctttgttgtgctttgcctctgagattgggggtggtaactcccagcataacctggcctatcttcactggtgaactgtctggttctattttttttttttttttttttttttttttgagctggagtctcgctctgtcaccaggctaaagtgcagtggcgtgatcttggctcactgcaatctctgcctcccgggttcaagtgattctcctgcctcagcctcctgagtagctgggattatagatgcatgccaccacgcccagctaatttttgtatttttagtagagacggggtttcaccatgttggccaggatggtctgagtctcctgacctcatgatccacccgccttggcctcccaaagtgctgggattacaggcatgagccaactgtctgattcttatcaagtgctctatgcttgcctccatctccccatcacagtcatctctcaaccagaggaaagtgcttgttattcttgcggtcccatggtatttctactcttgcagaccacaagtaactcccttcttgccaaatgtcttttcttaatgtgtggtttgcacagctaaacatgcccccaagtctctgtcccttctttgaaataacattttaactgattgactgtacatatgtagtttgtgtcttcatcaccagattggaaccatggcattattacggtgtgagtgagatgagctccttcatctttctcagcttccatttcctcatccatatttacctcaacaggtaaatagggaaccctattgcttgcttatcagatgattatgggcacattaagtgagatgatgtagcccataaggcatttattcttcttcttctgatatcaagaaattaatttttttctgataataagaataaagtgtggccagggacagtggctcacacctataatcccaacactttgggaggccagggccagtggatcatttgatcacaaatggtgaccccaggagtttgagaccaggctgggcaacatggcaaaactgcatccctacaaaaagtagaaaagaaatgtagccaggcgtggtgacacgcacctagagtcccagctaccctggggggctgaggcaaggagatcacctgagcctgggaagccaaaactgtaatgagctgtgattatgccactgcactccaggctgggtgacagagtgagaccctgtctcaaagaaaagaaaaagaataaagtatattcattgtaaaaaatatgaaaaatccaggtatgaaaatgttttagctttcttctgaagattaaatactaacatcatttttagttaagatcctcccaagtcccaccacctagaagtaaacattataaacattgttataatttctctctatatttatgcacatataattgagatgctacatataaatatatacataattgtgtatataattgatatatgatgagaattttcttttgtaattaaattgtcttttggaaatacagttttaatatatgagcagtgctctatccactcctcatcttcctaaaactgatgcttctcttagtgttatggtctcaatgtttacgtacccccacaattcatatgttgaaatcttaacccccaagatgatggcattaaggggtgagacctttgggaaatgattaggtcatgggcgcagaggcctcctatatgggattagtgaccttatgaaagaagcccaatggagtctgtatgtcccctttcaccatgtagggacacggcaagacgtcagcagtttgcaacccaggagagggccctcaccagaatctgaccatgctggcaccttggtcttagacttcccagcctccagaatgtgagaaatacatttctgttatgtataagccacctactgtatggtattttgttagagcagcccaaatggactacgacacttaggaacttattcccctgtttattttgcaaattactcatcttcctgcagcccataactgggtctttctccttgtgactccatcctagaggcatttccaccatccacatagaaatacaggggatgcattgaggtctgtctctacagttctcacctctatgtagatgtctctccaaactttatctcctttttcctcacttgacctctttcacatgtacctaaccacctgttgatcacttccatctggatgtcctaatattactttaaattgaggatgaccaaaagccaactcttgacccgtgtacacctgcctaaaccaaactcctatcacctgtcctcaccctcccaacttgccactccctaacacatccaccattttggtccaaggccctgaccttttctcagtcattcctgtttaagacctcagagccacattgatcttctctttcctcttttattttccattcatcaccaactcctagagctctattttggaaatatttcttggatccatcattcccttctatcattacttttgacacccctcccacatgtataataaggtagaacataattatgcatgcatacacatatgtatgtatatgtgggctttcacatgtgtgtgcatatgctcatgtgtgtatccctagcctctgactctactcttacccctaagtgaggacatggttttgcctgatcatctgtaacaatagtacttatagtattatatgaagcaatgattgcagagctcttagtgctgagcctggcaaatatgaaaacacttagtatattcttaacacaagaggcggagcagcgtagtggcttagaaacataattcaggagctagactgccacttactagatgtataaattcactctaagtgaattataacttttttcccaggtggaaaaattgatttcatgtaagaaaaataaaatagtatttacatttaataaataatattcaataagcactattacaaagttatagaaataaactggactgtttaccttcatgaaagaacctagacaaaattttctaggtttctcaacttaaacttggaggcaaaatttgctttaaacatgtattaagcattaccattgctatgcaaaaattaggttatggtaatttttactcaaattatattaaaatgcccagaagaaggattatttggggacaatataataatagaattgacttttttaaaaaatgttagctttaggggctacatatgcatgtttgttacataggtacgttgcatgtgggaattgggcttctacgtgtacccatcacccaaatattgaacattatacccaacaggtacttcttcaaacttcatcccccttcttccctccctactttataaaaaaagaaggaaatcatgtcctttgcagcaacatggatggagctggaggccattatcctacacgaactaactcagaaggagaaaatcaagtatcacatgttctcacatgtacgtggcagctgaacaatgaattacaaaattctgagcttcaagtacctcttgtgaagtggagctaatgacataacttagctcaaagggtttttatgatgattaaatgggttcacatgggcaatgctctcagcacaatgcctagtactcagtagtgccacagaagtatcaactctttctaatacagtgcctagtaattattcagcctatctatgtctgcatattgctccattcaccaatgctcaaccacacatacacatgcacatatacccctggactgccctacattcactcctctgcttatcaaaactgcccattctttaaggccctgtctacacctgacctccttcacagcttgcagcgatcaaaagctggagctctagaagcagtcagatatgagtcaagtttgggttccacctacaagatctttgaccttaggccaatcttaacccaatgtttcccaaacttggtttaagattggttaggttactgcatgttagaatcccttgggaagcttttaaaaatgttgatgccgtggtcacactgctcctaattaaatcaaaatatttgagggcgggagccaggcatctgtattttattaaagatccaggtgattccaaaatgcagccaagtcttggaaccctagacgttactgacctctctaagcctacagatcctcccctttaaagtggagaggaagcagaagcagccacacagaattgacataagcgtaaagtgaaataatgcatggaaagtaccctgcctaataccctggaaggcaccagcacatgcccattcctagcctcactactttcacccaacccaactgccttcagttttcattgcctgcacccattctgcacaatatgtatgcttagttgctataatacaactggactgtaatccctggagggcagagactgtgtctccatcttctttgcaagccccttcagtacctgacatagcaccagtatccacactcaataaatacctatgcaatgggaggaaggggagcacaaagacgtgattctgaaacaccctcctttgacccacttagtgcaatgatggatgaagtgtaagtccaaacttgatactttcctaccccataaatcagtggtcccttcgccatcctcaacaaatacccttcaagttcttgctctctgtttgcttcaagcaccttctctttgctatggggatgagggggctcagttacttggctcctgaaaggatggaggccctatgttcgctgccaccccagcagccgcctggagaacccaggaacctgtgagtttcacagagacacaataaagatgtctcaggttctgcgctggtatagaagcatgtggcttttggtcctgctatgcattccacatgctctgtcctgggacctgggagatacacactcctttccttcattccaccacctcgctaggcatctcccacatgccaggcactctgctggacactagccacaggtctgtcttcagaagggtttccacagggaagttgggaatcaacaaattacttaatcacaatagtgattttaaagaaaagtactgggtggtgcaaaagagtaaaacagcagcccatcctgcactaggcactgtggctggcctccctaaggcaagcaagtggagtagcctggggaagcgcaggtggtggcccagctggaagatgccctgtggtcccattctttagaaaaatgctagttggagaatcacagtaattaagagacaataaaagcttttgacagtccagcaagaaagcaacccatttgtctctatttaacacagcatgtgcttcttttagaagtacatctattagtaattcaccagacaataatatttcctggggaaaaaagttttagaaaaggtgtttaattgctaaaatgtcattttcagtgaaaacaggattcacagccacctcagaagtctctagaatattccagatgtttcacttaaaataatttcctaaaaggtcctcaaatgtggcaagactggaattctgattttatatcaaagattacatttttaaaatacattggcttggtgttacatatctagaacataataattaaaggtttcttcaagctagatgttgatttagcttaatcaattacaaaaaaagaaaaaaccctgaataattgtgtgctatttctgattgtattagtcattctatgttgcagatcatatcattaaaactctcttttaaaatagttgttaccaggaaatattcaactgtatttactgtatctgaataattcataactgttcactttcagaataatgaagtcatcacctggctttctaaaaagtccagtgtttacgcatggctctggagaaatcgtcggatcttttaaagtgaacagtggagccttaaaacaataaaataaaaaacccgtttaagaccttaaatcattaacatgtgtcgacttaaacttacacatacatttgtgttgtttaactaaatatttgaaaaccagcctctctctcagttatctgccaggaccccactccaggttccatgcatctcttcctgacgcgtggcagcttcccatgcttttcaagaggcttgcttggcaagagctgatactcaaatattttgataaagctattttttcccttaaattatatgtcagcatggagttggtgtgtattttctgttaatgatttggaatttttaaagccatatttcaaaaacagacaggctcttctgagttaggctccgccatccatcctggtttcctgtcttcattccatcctgagtgcaagaggatggcagttttcagtttgcaccagaacacagaaccaatgaaatccccatatcccaggttgcagcaaatctggaatgtgaattggtcctgtgggaatagctggacttggcccagcacaactctggacacagaaggtcaccctgagatcagaaggtgaagataaacgcttaaaccccccgtcagcagcagcaactcctccgacagtgatgctggaggctgaaggacctgttaaaacaaggactactaatcttatttttccaattacccttatctgacatttctatctcttcctccttcccacctccccactgctgccttagagtgacaccttttggaaaaggttgaaactgaaaatccccagactgctttcagcctggacctgaccatccctaagactgtgtttgtgatttgttttctcctcattgaagtttaagcatcaaggagctttgcttacattggttgcctctgatccttctcctgcaaacaaatgcccacattaagaacatttgtttgggctccaactctttgattttgacaacgtttcacattctccctttcctcttctcttctcaggcctattaacaaaacttcacaccataataaaagaaggatagagaggaaatgtgcaaaaatacatacatctgacttaacagagtctgttaaatgagaaagtgtcagagtacaaatgaatgacactttctccaaaatgcccttgagcactcttcattccagatgggattgggctcagtggaagttcctcaagaaaaaggctgtgggggtgtgcttctgggtatgtggtgtaggggtatatctcgagcagctgggaggctttattacacgtgtgtcacagttctgcagtgtggcaaagagatggccttctctctaacagcctgggacattcttgagaagcagtatagggatagtaaaggatgtggactctgaagtcagaaagcctaggtccccatcaggccccagctacatgctgacggtgtgattttaggaaaggagcttgacctctatgtacgtcagcttcctcttctacaaaatgtaaataataactgcaccttccggagaccttgtgaggaatacgggcagtacaacagcaacatgcttggcacacagtaagcatgcaaccacccgagattgtcatcaacagtggtattagcttaaacactagtacttcattttcagcctataagaggatgcataagcaagacaaagggttggatttccattttttttttacattttccaaaagatgcatcacatttttcatcttcagtggaaaggtgaaaattttcaccaagaaacccgctttgtaacaaaccaaattaatcatacacaaaatatgcattgttcatattttaatcttacttaggctaaattccaaacataaagatgaaggaactggagaagaaaatagagaagcatcgcacagtagatcttcctgcaatgctggcaacgttgtaactttttctgcccaatatgtatgccactaactacatgcggcacttccaatgtgtctggtgcaaaccaggaaatgaattcttaacttaatttaacattaattaaaatttaaatgtaaatagtcacaggtctattggctactgcattagaaagaacaatatgagaacataccattttcacaactttgttgtccaatggtgatgttcagaaattatttcggtctttgtggaacatttaccttttttggtcacgggaaacaaacatttcaattcttttaaattcagtataactaatgaattactatttgatctgatgattctactttctggatttattctaaggatatataataagggattttcccagacgaatttactctaaggatataataagcatattcatcacaatgttatttataaaaatcagaataaaagtttgtatgtgtatggatatatttacatacatatacacaatacatacatacacaaacatatatgtatacaatcttcaaaaaaattagttacaaaaattatggaatacgtgtgtgagtgtgtgtgtgtgagagagagagtgtgtgtgtgatttaaaagtgttacaaagaaattaaataataaattatgggcacccaattgttgagatgttcgtcagatattaaacactaagcaaaaagatttaacgtaaaggaaagatgctcatgaaatcttaagtgaggaaagcaggtggtaaatggtagatacaatacaatctcaactatgtgttgggatttttttgcatattcgtaggagaaaagactagagggaaatgtatcaaaatattcatgatgggtttgtttctaggtttagggatttcacatactctattatatatttctttgtacttattgataaaaatatgtattacaaatgtttacaaaaagagtaattaaaccaatttcaactaagaaagatctgcctaggaaatatttctgatcccatggaaaaagcagttgcaggtaaacatagcctctaaaggacaggtatgaagcagtcctccagaaaaagatggggccctctggcggcagttacaatggcagctaactttagccaaaatgaccttaagatgggctactctttaaggcaggggtactttggttctgagagtcccttagattatactggttataatccggtggggagagcccaattgttggtgactctagagctgtcaacagtaattcctgccgcctccaccctgccccacaatgcactttactcatttcactttgttctctaataaagttcctatgggttttggaagtccaatatgttcattttctttcttattttgtttggtgctttgtttagtattgtccgattttgttattataattttgtttcttcagcactcaaaataagctgtgaggccctagaaaatcaaaaccatttgtccaggctacttggccacctccattagcagagtctgttcattcccattcaacaaatcagggtggtgttctcaaacaaacccactttcttataatgcaaggatcagtgctgggacaattccaaggaaggagaagaaaatgggtttcctttactttgagttcccctactgacttggctctggaagagacacctattgatgatgacaaatttctatcagctcaaatcaagcctgactccaagcctgatacctcaggatccttgcatcacaagatctaccttgaacaatagggagtggcttccctatatgtcaccttgctcttttaagcacacagagtccaaagcacccttgcatcctccacctggcacagcctcttctcaaacacacagtagatagtcaacagatgtgggagggaggttggaagggagaaaagaagaaaaggagccatactgtagaaaggtaatcattactggtgatttagataatatcctatttgattctcacatattcccaaagaagcagaccatttaaatgatggataacttaagctcagaaagggtaaaggattttcaagtggtttactttttaccaggatgtaagactgattgttgaatacaaatataatggaagaagtgttagaggggactctactgagaggctctgggaggaaacccaggaccacaagaccctcaagagcaagaaaatccctggctcattttctatcacatagtcagcaccaacaaatgcgtggatgaacataaattagtgatggatcttgggtctcttttgtttcactggagtagaatagtcattatctgttttgatcccagcactgttccaaaatgccttagttgatttttgtattctatttcagttttccattattgtacaataaattatagtaaacttggctgcttatagttctacaggtcagaagtctaggcaaggtgtgactggggtctccacttagagtctcataaggttgctatcaagatattggcaggctgctttctcatctggagcagctcagggtcctcttccaagctcatggagttgaaagattattcaattccttgcagatgtgggtctgaggtcaccttgtcatgtccagctcattgaagccacctgtattctttgccgcacagtcccctcaaatctttaaagccagcaaatggagaatctccctcacatcaaatccatctcatgctttaactctccttcttctgtaaaagcccagtcccatttaagggctcaccttaaggattaattaagtcaggcccaccaaagataatgtccctttcttaaagtcaactgtgccaaataacatgcttaatcacgtgagtgacatcccatcacttccacagtcactatccataagatcgatgaggccattcccatactctgaaggaagaatccctccacaaaatatcatagctttgaagacttcagcagataattttcatgttgtaaatgccatctagtcccaaggatgactacacactaggtgaagcaacattcgaatcagtgacttgataccgactgaatcaggatatgaaattgactttcttaagagtcatgtgataaaaatgtcataattgtgttccctttttataaaacaaaccatcacacacaaacacagacacatgcattttaagtgtcatgttcagcaatagctaccagtgcatcttatgctaacccatagataccaccagcaggtaccggtttccttattattataattcaggtaagtaaaaaaatcacagtaaagcttcatcatcctccaactaaatatatcctccagactgctggcttggttagctcctcagtgggaggaaagcaaaaaccagacataacgtgccagaatgaagtcttccgcttcaatttctcctttatttaaaacattttataggggctttatgttgaccctattgcttcaggagaaggaaatcctcccaaatgcgtccctagggcacagcatcccccacagtgacttggctccctcctctcggcgattactgcgacatggaaaaagttcttaattggttaaccttgggaaaaatcacttcatacagggaaaactcagaacaaagacgcccacccaaacagtcagttctccccacgtacaaagcggctggtaaggagtatgagaggcaccacatgagcaaggctgaccgacagaacttagctgcattttaaagctaaatagagggttcctatgctttccttccatctccaaatggaataagtattcacacaatcacaagagtagatccgctaaaccttgcctctcttccagtcatcagcgtgctgctcagcatcctctttgtaccccagggaaggagactgctttctggccatccagctgaactaatgagagtggggttttgacactgggctcctaggaccagttactctgcttctcacctggctccacaccagagattatcccctagcccctgccaggggctgtgatttatcccaagggagcctggcggagagtgggcggatggcaaaggtcaaattcagcccactcctataaaaacaaccaaagtacacatcctgatgtgcataattttcatgcttaaaatcagcaacttttgtctttctggattatcttgattcatggaaacattcactgttcatctgggcagaaacaaaacatactcacatcttaacatgtgacactttcacaactgggatgaaaagctatctgccagattgtaccatttatattcacctattaaactccaagcttcaccaaatacctgtatcatgctttggaaatagacatctatgttttccccaaaagacacattttctacgatgtatgtctttaaactatattttcaaaataaatgattttccctagtagctcttctctgattaaaaaaaattcaccattttcattaccaatatgagattatagtctagtctcctataaagtgattaaacataactctgcatcaaatgtaactctggtatcaaatagtctcaagacaaataaaagtgaaaacattggattccttgctttttaaatgccaaatgttcactcaaggatctgattgcttcagctgggactttttctttcttgtacagcttctgaaatatttaaattgctttgtttaaaaatatttctccttatttttcctctcatttcttcaagaatatatagctataataaaaccatgatacccagagttcaagaggaaaaacagcctcattatttaaaataagtaataattatacatatatcgaaatgaataccccattttgatgggtcacattcagaaaccttaaaggcacctctatctgggcaatagttccttttggactaaaaacaattaggctgtgtaattttgtgctgaatcccttcagataactgtgtacgcacagccaggccactttctcactggcatggaggccagggctgtcaggcccactcctctggttaatgtcagtagcactatgtataaaaggtgactccagtgtgtacaaatgttgatctttagagaagtcatgcctagactcacacacacatccactcttttgcccagtaggtcaacagcaggaacagagggcagcccaggaagggacttgccaagagcagaggcttatttgttaggttacatagccctcggggactttcttgcctgagattaatccataatcctgtttcgtgtttaaaaattcaggttctaaaagccttgcctatgagacattttcagaggtgatggagaaatgttctcatgtacagcaacaaattaagtgccagtgcaagtgagcactgacaagaaaggaactgtgtggaataggtggcacaacatttttgccctcatccaaaatcatttctttaaagttccaaaatggatacagatcatattttaatggccagagtaccataggtaaaaatagaataaacacacacacacaagttgaaaccatctatggcttttctgattgctgcacaagtaaagcaaaatcaagatgccccctgatcgaaaatacagcagaggttctgaagaaatataatattcgctgatgtgacttccaaactaaatttcatctgaataccaaatagtaagaagagccctcatctcagctttgaacaatcctatttttattacatcaaaattgtttcttcccttgccaacctcattctacccctttttgctacaaacttaatgtccagaaagcttccttttacaactctagcagacccaaccaaaaaaagcaggaattcctaatgctgcagaaaccatcatgaacatgttctcatctggatgagtctaataaagtataactcactctactcttcagtgaagaaagaaagcgtctggggggaaacacatttctgaacaagatggccatgtgaactcctcaacaccctagaccaccgaggtgtggacagagccagctggcctcgtggcatcttctccttcaatttagacagaaagaaaagcatgacagttaataatccacattgccatttcaatgtgtgactcagcccgttttcacggtcattcctgctaaggtttaacttacagtgtttggcaacagagctgaccttttaaaagccaaaggtgagcatgggaagagcattttctccccagatgcaacttctctagtctaacaaaagcagctcccgtttccaaatatgaacaaaaaaggagacaaatcaccaagcttgttgcctatgtcttgatgtgtttcacgttcttctttttgagacagagtctcactctgttgcccaagctgcagtgcagtggctcaatctcggctcactgcaacctctgcctcccgggttcaagcaattctcctgcctcagcctcctgagtagctaggaccacaggcatgcaccatcacgcccagctaatttttgtatttttagtagagatggggtttcaccatgttagtcaggttggtctcgaactcctgacctcaagcaatccacctgcctcagcctcccaaagtgctgggattacaggcgtgagccaccacgcacattcttctttttactttttttgtggacctcacagtttggagtagtggtggtggtggtggtggtggtcgtgtgtgtgtgcagcatccctcccgccccctccctccataggccctagcacacgctcttccacttaacagtaactccgaggggaagtcaccatttgtataggtggaggaagccaaaaccctacaacagagcagactaaggaattttcacacctataagcattgacttccaaaatcaaaatataattttgaaagaggcggtatagtatctattgccttgcaaataaaaccccaactccttcctgcagctgacaagggccctgtattgtcaagacccctactcaactacatcccatgcaacccttgccttgtagaatctgttctttcttaccatgccttgtttccaggccccttctcccaaactcttcaaatagcaggcatcttctaaactgtcaggtcttggcataaatgtcaccacctcccaaaggcccttctgagtcccttcagataaaggagctgcctgcctcccacctgtccctggtattcttcatctcagctccaagttggatttcctcatagcatgtgtcacaattttaaatgactttacttaagaatttccttctatgtaccttcccatttccttcacaaggctttttgctccatgtctaacttactcctcctgtatttgtaatacccatcctgaggcctggcacatggctgacacttagtaagtactcacctgactcataactagaattagcaaaaacaatacctgatgtttatgccagtggttgtcaaagtagtggcagggggggccgggcgcggtggctcacgaggtcaggagatcgagaccaccctggctaacacggtgaaaccccatctctactaaaaatacaaaaaattagccgggcatggtggcaggcgcctgtagtcccagctactcgggcggctgaggcaggagaatggcgtgaacccgggaggcggagcttgcagtgagccgagatcgcgccactgcactccagcctgggtgacagagcgagactctgtctcaaaaaaaaaaaaaaaaaaaaaagtagtggcagggggttccccaaccagcagcagcagcatcacctggaaatgtatttgaatgtacgttctcagcatcctcccatcccatgtttctacctattgaatcagaaactgaggatgcggtccaacaatatgtgttttaacaacccttctgattgattctgattctgatgcatgttcaagttccagaactactgcttcacacaatattgcccactttccaaagggcattcaaacacagatgttgtaggcctgcctgtaatcgggaaaggaagagtgagcaccattttgcaggagacttatctttacaggcaaagaggctgtgaacattcatcctggaaaagaccccatgttgatgagtgtttctgtgtttgggggagtctctgtgaaaggaaccaatttatgcaaaggattccctggctcatttctattcaatcagagggtgatcaggctgagtatgatgatgccgcagccatatcactggcatgggaatcctgccttttctgtagtgatggcccagatgataggggtgcttgcctcccagtcttcatcttgagggtaaggtttcctgaaaacagatactgccttgtcatgtatgcaccctggccttcacccaacacctagcacacagtggtgaatcagaaagtgtctgcaaaagaaccagtagctgaagtagtggtgatgtcacctgtattgctgggagaaaacatgcaagagggctttgcttgccggatttatcagtaggctagtagcttttatatggtaaagtggttcaaaaacatgctgggtagagaaagaatgcaagacttagagttaagaaagatcccagttcaaatcccggccacttgctcctgtatgtctttggccaaggtagctagccttgctgagcctctgattccttaactgtaaatggagatatcatgccctgctgcacagggctcttgtgaggattatgtgagattgcaggataaagtgtctagaatagcatcaggtacgtactcagtgccaagatgctgtaatgacccatattagcattattgcttaattgtttgactggagaaaatgaatcagaggtctttgtctctgatataatgtgtattctgtaatttgatgtaacagagctacagaagggcattcctgcccaccccatagttttcagtgtgatgggagagatccatcagtataaaacatgaggaaacacagacgctgagtttggactgatgaaggctcagatcccttctctgccacttaccagctgtgtgaccttgagcaagccacttacactctctgggcttctgcatttgtagattggagataataacacacttcactcagggtcatagcaaggactggagattaaaatatccatgaaacactcagccctgtgcctagcccttagtaagcacttgataaacgataagtattatttactaaaaccaacaataggcagggcagaattccacctctgctacagaagaggcagacagggaggagcagagtgttagaggcaaaaacaaagaggggacgatacattgggaaaagcaacacacagggagaggaggcttcccagaagtgatagcgtttaaatgacaggggtcaccaactcaaaggctggtagggcgaagcagttattgtcaaggcctgatgctggccaggaagggaaatgccctttagctgctgctaatttccaccatgtaaacatgcaggttctacatggccagatcccctgatttatcaaaagaagcaaacatatctgaattttcctgaaaaaaatcttattttttaattagtgcttcaatcaaagagaaaaatatcctgcctgaattgaactacacacattataggccacatctggatcatgaatgatcagttttgaggccttattttaaaggatgactagagttttgtcaagcagggttggtggaaagagcattctagcaaggaaagagtatgggctgggacagggaggcaggaaaggccaggaaatgttcagaaagcagaattctgctccaggggactgagagtgaacagaggaggaaaggaagagtcagggagcgatgctcagagggagaagccttccagggagagatgtgggctgggctggcaggtgagtccgagaatgctgacaaggagaaggaaggagttagaaatgatagaagagcaggcagctggccggtcactctcttcccctctttgggacgcagttttccttgctataaactgagctcatgaattagatgagctttaagccctcttctagccccatccataacattcaggggggtcaccacaactcctacacgttgggttgccatatcagctcctgtgctctaggttctggggaatgctgttctagcttaccatcaaggaagaaaagggtcacgtgcctgccccaaggaccaccttttctagccataggggacaagctaacttaagtaatgcagagaaaactgtgggcaataagtatagagtcaatcctgacatgaagtagtccctcgaataataacacatgcatcttcattgaatacccattttgagccagactctggcccacttaccggacagaacaatgtctaaggtcccactattatttccatgttacagatcaggcacaggatggttaaataggtctacagccaaaaagctggaaaatggtaggaccagcagtcaaacaggaagtcagtctaatgccagccccttccatctcggcccctctgccaagctgccttcctctagatcctttcatatccgtgtttcggtgctgcacttctttcacaatggcgtctgaaattatgtgttggtataactcaactgggaacattccttggccacatcaggacagactaaaaaccagagttccctctcctgctccagaaggtggccaaaagtttgagtcctggggagttttgtacttctcttgatacagaggagagataaaaggtctttgttcccaagaatctgggatcttggtccaaggagtcaaattgtcagaatgagtttgaataagcagggagtagctgggcttggagagatggggatttctgcctgcggtggctgtgtagatctcacagacagaaggggtttgaagtgcattccattccaagaagctctccagagcagggagacaagaagcagaggactgaaacctaagggtaaaggttcaggcagccatgggagggagtgtgtcagcaactatctttggcacggaccctgagcatcccggaggcagccaccctgggacaaagaccacaggccttccctcaatcactctgggcaaattaagagaaccctgagggacagagagggaccctcataaagtctgagatttatttttctaccaaacatgacagatgaggtgaggggttgtcaattaacatttaatttgacttagaaaacacaaaatattaggtttttgcatccaaatatcatgggataaatttggccaatgataatcatttacgtggaaaaatatttatattgagaaggcctcatttgtttgaggaattttgtccatgtgaatacaaaaagccttccctctctcacatacatatacgttatgtattcaggttgttttttttctctaaatattctgtttaggttgaatcaatgactagtctataagataaaggtaaaactctattttaagaaaacattgggctggccacagtggcttacacctgtaatctcagcactttgggaggcagatgggggcagatcacttgaagccaagagttggagaccagcctggccaacatgttgaaacctggtctctgctaaaaaatacaaaaaaaatagctggcatggtggtgtacgcctgtaatcccagctactccggaggctgaggcacaaaaatcccttggacctgggaggtggaggttgtagtgagccgagatcacaccactgcattccagcccgggtgacagagcaagactctgtctcaacaaaaaaacaaaaaaacaaaaaaaacaaaacaaaacaaaagaaagcaagaaaaacaaaacattaatgtgtgtatatatgtatatatgtagacatataaatatgtgtttctaactctgctggaaatgagagataaaccaaatattctaggggtttccctaagagtcaacatcaataccccaaaactaattaactaataagtattaatactaattaacaattgcatggcattaattttgtgccaggcatggatctaaatcttgtgagtatgaacaatcgtctgtaataccatttatttctcacagcaccctgttgagtcatcattatcattttacagatgatgaaactgagacacaaagaggttaagcaacttgcccacagtcacacagctagtgagtggcacagctgggatttgaacccaggctgtcagtctctacagtctgataaccactagaatattttgctttgtaacatctgttgtaaggattaaaggtaaaaatgtatcacttttcaagctttctagaaattctttcactaattcaacacacttattgtggcactatgccagggatgagggatgcaatccctgcactcatggtgctcatagtctagcaaataacttctcttcttcccctttccctccctccctgcgctctgtccctctctttgtcccaaggaaattatccacatgaacagactttatttcacaacttcatctaaaaactcacatgcacataccctgatgatgtaacttaacaggtctaacaaaacctcaaatttacaaatttaaaaaagaaaatcaccaacccaaagagaggaggacgtggcccaatgggaaataaacccaaattgctaagacacatacagcactaaaatctagaaggcttcaaagataacatttgccactattgagagatttcttgtgctttcaaagtccacaagcagagagtggttcataaacatcctgtctaaatgtaatattggaggcctgtctcaaggtaatattctagtaagggaaagagcattgacttcatcgtaagcggctagtctgccgctgatggcagactaagactggaatgtgcagataattatctttaaggccagtcaacggctatatgtctcctataatatcacctttaagatcaagccaagacattccagtctgaatcaaggtttatttatgaaaggatttaacacttttagatcccatattgcttggaggaccaccaatttgcattcccaaatacccaatttcttcaatttcacagagcatgaatgagatttcaggttctcatatgttagagggaaaaatttaagacactaaaattccttttcttcaatgaggtgaatttctttgctaacacctccacaaaataaaatcaccactagggacttaaagtagcaaatatcataagtcataatgccacattcatgtagatataaccaaattttcaggtatttccagctgaatggtctctcttgttccactcaaacttgaaaggtcaaaggagcaatttgattgtgggtgctctatacagaccacagacaggaggaggaatggcccttctaccagcaagggcacaacacttaaaggggcatgcagacagctgaaacccaaatgaacccccatacattggagtgatctaccaaagggaaccagttaatcaggaaggctgtatgagtttcctcattggtggtggtagggattgatcagacatccgttttaaagaaccggtataaatattggcttaaactagaccagaaccagcatagtatggggtgtggagagagaggtggtggtacctacccacaggtgaggagagagagaagaaatctcagaagagatatcccagagctggtatttcagccctacaatgatacttgatggttgccagtgcgagtgagaaagataatgatgaccatggaggttgccaacagatattaaatcaacccatcattttatagggaacatagtagcattcatttgataacatcagcacactgaaatagtttaaaaatgaagcaagaaaaaaatgaaaagtgacttcagttgaagaacagtcaaatgccttgtctttattattaccctactgtatgtatgtgtgtgcatgtgtaagtgtatatttacttttatatgaaaatccaaccctcttgatggtcatatttatcactctaaactaataaagagccattctaattttctaagacaaaattaaatgtacatatacacatatttgtacacatagtagagaaggctgtttggaaagaaatatatcagggaattaacagtggttttccttgattatgaatcatgggctctttttttctatttctcattactcaaacccaaaatagctttactgatactttgaccccaattataaaaataatgcatatttatgtcttgttaatattaaacatacaggaaagtatgagagagagaaagaaaagcaaaacaaaatcacaagcacaaacccaggacccagaggaacactgagggccatttttatagacttccaaattttttccatcagtgcttcttcttttaacaagtcaatcatgctacacatactgttttatggctttctttttttattgcatttatttatttagagatggggtcttgctctgttgcccaggctggagtataatggtgtgatcatagctcactgcagccttgaactcctgggctcaagcaatcctcccacttcagcctcctgagtagctaagactatgggtgcatgccaccacacctggctatttttctttttttagagacaggtcttgctatgttgtccagtctggtccttccttttagctcgacaaaataacatggatgttttctctatcgataaatattgatctagttcattttttcatggccacagtgtaatctataagaatcacctcctgggggtcttatggttatttccaaattttttaatttataaataagagtagataaatcatatctaaatattttctttgccaacaatctggtgattacttaagagaaattcccagaaagctacttgctggttcgaaggacatgtacatctttatggtttagtgcacatacctataaattggtctcctgaaaaaccacaaaaatccagaaacagaggtatattttattttcttctttttgtttttctgtattttttgtaacttacttttttgctgacgttatacttaaaaattgcttctacaaaaggaaaaaaaaatattttatggaaaaagaaaagggacaattggaagatgactttttccaatggagaattttgatctatgggacaggactttcccagaaagaagatggggacacaagacttgacactactgtccattaaactcaccacctcacctcccttgctcatgcccatcatccagacttttcacacacagtcatctacaggaggaaatgcagtgatgagcaagcctcagtattcactctttacatggttctagctaacactgcatcaataaaagaccactctgtaccctttttctagtagtatctcccttgaagctagagattcaaaagaatccaccttagattgaagcgggactttccaatttccttcccttattcttaaactaataaaatattcttgcccctttatgacaatttttttttttttaaagataacacagcccagctgaaccaggagtgaggaacaaggagactggatactcatcttgagaaaagtctccaaaagtgatcaatttaaaaaatattttcagttattattttcatgaagtttgttaactctgatgcaaagatgtctctgaaatctctagatatacacagaaattagtcaacaactgaggttttttctgtatgggctagtttcccaccaaccagagccacgcgctcccaaaccctttctgttcttagtctcactccctctaatgtcaaacctggctaaactaggggctggagactgggtctcttatctttaaatgttacattattcttaacactctctattggctaaaaatgaaacagaagttcagaaaactcacaggccacgaatctgcttacttcagaggtcacctttaagatttaagaatactgccagcttttcactttaacatggtacccactcctacccaaatcctctttctgttgatacacatacaacttgattcttaccacttctagaaagccatcgccctactactcgtcctctccttagatgcaaggtctgagaattcatgaactcccctgatgcaagtgacctactggctaagcttcacctcaggccagaagaaacaactggcccatgcattgcaccattttccaaccagcagatgtaaacacatgtaaacctaggcccacaaaggaagcagctacttcttaaaagttgactttgatgatctcttgaactttatcccataaaactagacacccaccattgcaagatggaaggtgaggagctagaggtgtgctttctttctggacattcttccttctaagtgctaaccataccagcagtcctctatttgggaacataggtcattattttaatgcatataaaaagcaaacaattaagatagaaccaaagattttaaaaataatctaattttgaagcatcttgcctttcagattcagtcttttataaaatctatgccgtcgtcgcatatttcatacacactttttaatttgatccaccctatcgttgaaatgctcatatccatagtgtcctgagtaagtctcaggatggacatttgtcaggatattagtaatttccatatttgtctctactttaccaagtatataaaccctatgctgtttaacattatttcagcactttttaaagcaaaaataaaatatagtgattttaaaattaatataattatacgatcattgctgtaccaacaaagattatgacgcttatgttggcttacagaagacgtttccatagaacagacagaaacggtcattttagctaattaaaaaaaaagtctgcagtacaacaaagggctgttatggaggtatgtagcatataaaatcaaactcacgagaaccaagaatcacttatattaatttataatacaccttggtttcagaaagaaatggctgtgtttttaatattttaggcctcttgataaaattctgtcacatgacagctatacatttggttatgagaaaagtgaatttggattcatgaaagacacatgacatttgagctaatggggatgtacaataacatcccatggatccttatggatgtcaatacacctgacaagtaatagctttcctaccttctgactggctgaaggattggaagcaagataaccaccctcactagtagtacatgtatacagaaagacaacagcctcaattaagatcatcgaggggagctgacttaatttggggaggtgcctatccagaggctttgtgatcacttcctaaatttattgctgtattgtagagagcaagaattctggataagtaaggtcctaaaatgtaagaagttacagatggctccaaaatttatttgaatctttaaaaaatgattacagattttaagacaaaaaaatcacttaagtccttcctagtaataaatattttcaaaatagaacatgcatattcatagtatttgtaataaggccatcccaactcacacacagagctgctgatgcaaagtcctagagcatgaactctgctgcgaggtcaagccaggccattctgagaggagtgctaagtccttcaaccactgcagacccattcagctcactgtggcaacagcgtggtgagaatatttcagtgagaatattccagtggcctggaagaatgagtgtacttcacaaagcacccaatttattcccataaaatgcctagcatgccaattgactttaggctcattttacacaaaaatctaggtttttggaaagatttactcttgggtttccaaatgtttattgccttgctgacagatttttagactggtgcttgtaacaggtgatttttcacaacacaaggaatccaaaatgcaattccaggacactaagcaaaaactatctctaagattccagttggtgtcaaatcacatagaacctagaatatgcaagcagagaagtaaaaatgcttcttcgttaataatcacatgtgcgctagtatagtatcatcaaaagttacaccgactacacctcccactcatccatgcctactggtatgttctctgttcagcaaatgcactgagcgtgttcccactgcaggtagcttgcatttgctgttcctaccacccagagttcgcccattccagtgcttgtaggttggctcctgactgttattcagcttcaggagtagccctgctgcctctccaagccacactgtatataatatggcctggctgacttccttcatagcatatattacaatctccaactctcttgttcattttaaaaacatgtattttttgttaatgagggcaagacttggtctttcttgcccttctgttcctagtacctggaatagtatttaggacaggggtgggcactcaataaatatatgctaaataaatgagtaaacagtttaattaatcaaaagtactaggggtttttttgcactaaagtgcaaagccatgaggtatgatttgtattgtattgtaattattccattattataaaaacaagatatatttgagaaaagccatatgaaaattaggtcataatctgaagaatgaagaggattccattaactcactagttcccaaaattccatcatgaaggtcccctgttgtagtttttcttccatgatgccaatggtttgaaataaaatgcttttcaaacccactggcttctagtaaatcagtttgtatacccttatacactttctaacaagatttttgcaagaaaaaataaatggcaggggtaaaaacttgttaatgaatgttcatagcaacattccttataatggccaaaagcagaaacaacccaaatgtcatcaaccaatgaacagataaataaaatatgatatatccatatagccatgcaatggaacattattcctaacaataaatgaaatactaatacatgctgccacatggatgagccttgaaaacattatcctaagaaaaagaagccagatacaaaaggccataggctatatgattccatttatatgaaatatatgaataggcaaatctataaactatataattccatttatatgaaatgtatgaataggcaaatccataaagacagaaaacagattagtggttactggaagctggggtttgaggaagggcagggggagtgtggaataactggttataggtacagagtttccttttgaggtaacaaaaatgttctaaaattgattgcacaactctgaatatgctgaaaatcattgaatgctacactttaaatggtgaattgcatggtatgtgaattatatctcaataaggctgctacatatttttctaaatgctttgtggataccagttatatctttgagaatggagctagatgattaattctcatccagaccaaaagtctacaaataaagacactatctgctaattgagagttgccttgattaagaaaatgctagctgctctaacagagaaacactgaaatctcggtggcttattataagtttatttctagctcaaattttttctgtctagtggtttcactatcctttagcctgggcctcagagtcccagtatatcttctatatctagatatcatatagagataagacaatagatcacaccaaagctatttatattccaggtctgaaaatggaaaaggataagttactttcattgaccgaagcttggtcttatggccatttctagctacaatgtaatctggaaatgtaatgtatatctaggagtaagaggaatcaggttttgttgaaggtatagcagagacttactccctcagggtttactgtcttaaaaaataaaaaggtgggggcagggtgatctatgagcatctgttttgtctcactcttcctccgaatatcttccttcttaacaataaattggtgccagtcagggaataaattggtaaaactaccttacagagaaatttggcaatatgtaataaagttaaagatgtgtgaaaattatggcccaaggtgctagattagaaaaacataaccacgagttttttcagcttttcattccttaaatctgggctggccttgggacttgcttagaccaatagaatgtggtggaaatgatgcactgtgtgcatttcagagtcaaagccttaaaaggccttgaagcttcttcttgaaacactgtcttaagaatgctgtgctgttaggaagctgatccaccctatcataggataagaagccatatggagatctgaagtgccctagctacaggcagcaccaacaaccagatatgtaagtggggccacatcagaccattcactcattctagacatcacctgactgcaactagatgaagaagactagctaaagaatcatgccaaaacacagcattgtgtaaatcattattttaagccagtaagtttggggtgttctgttatgcagcaatagattcctgatataaacaagaattttaacttcaaatacacactaaagatatattctcatacgttttctcaaagagaaatgctcaagaatgtccaccacagcattgtttgcaaaaggaaaaatacaaaaataactaatatggcaaccattaccaaaaaatggatatttaaagtatgatgtaggtaggatgcagtggttcacgcctgtaatcctaacactttgggtggccaaagtgggaggattgcttgaggccaggagttcaagaccagcctgggcaacataacaagaccttatctctacaaaaagtttcaaaattagcagggcacagtggcacatgcctgcagtcctagctacttggaagactgaagtgagaggatggcttcagcccaggagtttgaagctgtcatgagctatgaccatgccactgcactccaatctaggcaacatagtaagaccgtctctaaaaaaaatcatttaaaaaagtatgatgccaatggagcgctatgcagcaatgaaaataaaacagagctacaggtatcaattggataaacttcaaaaacatactattaagaaattaacatgaattgcccagtgatacacatttattcaatcaacaaatatttattgaacaatttgtaggtatctggaatacacccccacaacctcacaactttatcttcaacgaacatgtattctagtggtaggagacagccaaaacagaagaaaataagtaaaatgtgtaataactgagacagtgaagagtgctaaagagaataataaagcagaagaaggagatgaccgacttgcaattttaggtggggtagcccaggaaggccctaaggcagagccatgtaaataagacttgagggggtagtaaaccagccagtggctatcaggggaagggcattttaggcaaagggaattgcaagtgcaaaagccccaaggtggaagggcctcctgtgcgttcaaggaataaggaggaggccactgagtaattggcctaataagtgaagttaatgaataaagaagaaagtatgaagccatttatgttgcacttaagaatgcagaaaataatagcacatattatctgtgaattcataacatctagtaaaattacaaaaatagtctacattggttaggaatacacacatatgtcaaataagtataaaaattagtatggccggatgcacattacattttggagaggattctctttgagaaaaatggagatacatggaatcaggatggagtaaaatattttatctctttaaaaatgtcaagcaaatatgaaaaaattatttatttattaagtaaaatttaatttgtattgagtgttgggtaaatggatttcattacactattttctgtattttccattatgtttgaaatatttcataattggttttaaaaaggcactaaacgaataaatatttcatcaacaatcagcaactgttgtttaaatgagaagatctagttacacatacacacaggcacactaaaacacacacacacacacacacacacacacacaccccaagtgagaaggatattgctaactgtccaaaaactcaacaggcatctgggtgatgggcttcactgaaaaggacatcatctctccctggaggtaacaatcaacacatttcatgcataatattatgtaagatttaatccatatcttgttatcttaattctattttaataatggcatacatcaacatgaattctacttgaaccctttagtgcttctttatctgcttctaatacaattttaaagaaggatttgaatgtaaaattcattctaaataatagagcacgtgattctgcaaaactgaagaggaagtggggaggttaataatgataacagtgacaataattgtatggcattcattggatgctcagtatttgtcagtcacttttccaaattcctatcttgtttttcctaccaaccctatgaggttatcccatttgaccacagaagaacagaggggcagagtgagtgacatgcccaaggtcacacagctagaaagtgatgacactgggcttcaaacctagggggctaagtttgatggcagagactgaatcataaccactcggttctggtgggaatgcagaaacctctgagcacaccctaaaacctctctcacaatttgctgcttatgtactaaagtaaaaactgactgtgaatgtgtttgtgcaattaggcaataaattattaactacatggttcatatttgctttaattgatgggattagcggcttcaattgaatcagtgtgaaccttaattacccaccaacatgaatttgaaatctggctgactctggtaaataaaaatatatccataaaactgcacccaaaatagttatgaccctttaaactcttataaacactatcatccttattatggtgttggtgtttggggaagagggggcagggtccgatctagctctgagaattgcctcctgattctcactgaactcctcattcatttctttgaaggcggtattcccacatgtatcagtcctacagagttttatcaggcaaggtttggagattgcttctctactgggaattctcaatatgacagttcaaaattctgtcatcgcaaactgaacaatcaacctgaatatggtttttaaaaaatgagatgctgagacaatgaatacaatgcaatggcttctaagatcattatagccaaagttggaaaatgcaaattattttattttattttgagccacaaaaatgaaaaagaactagcatataacttttctactagttttgtattaataggagatttaaatatgaatgtagtccatatatggagagtattaattcttataactgaaaaatcatgttttctaggaattatgtgcaattgggaacatcaaaaaagtacttaatgggacatcttaaaaacaaattcattgttggttaatcaattctttcagataatttctactgttaatataactaatagtttcctaatttaagtgaagctttgttaaatgatatcagactctctctacctctttgctcttgctaaattctaacgattgtataatatcaacccagagatactgctttgccctacacattagctcatacagagaaatgtattcattcagaagtcttcccagacatacctcctccagtcacttagtcttcaaactaaataagtggactagaactttctagcaactgtctcagaatacttctgacccacatagtttcaaatcagttactttaagtacattaaagcttaatttaaactatttttattactgggagcaaggtaaattcatgctcccagagtgacgtttctaacaaaaccaactcaaactttgcttcactaaaatatagccacccaggggaaaaacatcataaagatagtaattatggtgagataatcaaaggcctccacactgaaaaaaaaaattgtcctaaaaatgtcacttgtgggttttgaggctttggagccttgcaaggggcttattttaaacagaaatccagcggaagcaacacacttttggtctctctgtgtctcccctcccctttctctcactcttgggaagaagaaaagatgccagtagaaaaacatcaaacagctcttctccccctacccccttctttctttgtcttaatttctacagttgcttcaaaacatccccattttacttagaatctttttcctctcagatgttcctggcttgtaattacaatcaaacagagatcctacgtaactgtcctcaagaccttccaggtcccccacagggaaattcccagctgaaactgcatctgtctcttgctctttaaagaaaccagcagtaagaattaactataaaagttgactcaatttgaatggacagctctcaaaaaaaggaaacacaataagcacatgaacaagatgctcaacatcaccagatattggggagatgcaaataaaaccacagtgagatggctgttgtcaaaaagtattggtgaggatgtgggggaattggaggcctgtgcattgccggtgaaaaagcaaaatggtgtagctactgtggaaaacagtatggcagctcctcaaaatattgggaatggaattaccatacagtccatcaattccactctgggtagatgcccaaaagaattaaaagcagggacttgaacagatatgtatatatcactgttcataggagcatgattcacaatagccaggaagtagaaacaacccaagtgtctattgaagatgaatgaataaacaaaatgtgatatatacatgcaatggaaaatattccattattcatccttaaaaaggaaaattctgacacatgctacacacagatgaaccctgaagacatcgagttaagtgaaataaaccagacataaaaagaaaaatattgtatgactcggctcatttgaggtacttagagtaattaaattcataaagccagaaaataaaacacaggttgccagggaccaggggtatgaggttattggtgagttactgtttaacagatatagagtttcagttctgggatggatgacagtgatagttacacaacactttgaatgtatttaaagccactggtaaaatggtaaatgttatgttatatatattttgccacaataaaaaaaaagttggttcagaagatataatagcaaacaaggaattattttcaatttatttataaaagcaatagcttttataaatctgtctcttcagttgcagctccaggataggctacaaataaagggattctgggttgtagaggctctcctcttagtgacctcagatcagagtctagattgtggtagacagaatcacaacaattcatgcctttaaattttctactgctttagggagaagcctctagcttaagacaaatggatctcatttcttctgtgcaccagccctgacagacatcactaatcgattacagcactgccttgcactgagtcccctgggacctcataatctttcccaacatagggttaaggcagccaccaattaatcagagctgtctcccaaaatgaaatctatttgctgtagtgatccaggtggcaatctatttattttaagccaaactaaaatgttacatattaaaaaccttattattaagctggggacacaatattatagatgtaaggagacagatttgccctactctctgttcatgccttttcaactgtttgggattctgacacataccatagaaaagcaccttggatcaaacaacacaaaaaatcagagaggtagagattctagtacatataatatactggtagaattaaagctgtccttaggaaagtcctcactgtcttctagagcaggggttggcaaactttttctgccaagggccagacagtaaaatttcggcctttgtggtccatatggcctgtgttgcaactcctcaattctttcctatgaaaacagctacagacaaatgaatgggcatggctgcattctaatgaaactatgcataaaaacaagtggcgagagggatccaggtttggcccacagaccatagttggccaaccagtgttctagatattctatcttcagtccagatctctgtaggggcctttttactctttgttttcacctacctttagatttttaaagccatttctagccccacctgagcatcaccttcctctctccgcaaaaatcctgtggacccagatatagctgaatgaagacctggcacagaaggcagaactccaagcagaaggtggagtgaggcagaaagaaagaatccaagagcacagaaatgctgtggggagagggagcagggggtggaatgtagagttagaactaaaagccaagaactaaggctttctcctagtgggaacctgaaagatggatcagcagagtaggggagtcactcctcaatttctacccacccacagaagctggatgctttaaaatataggattcaaatccattcaaaatgaaccctgtgtggatatactcttggattccctgtgtgagcttgatctgactaggggccagtttggttatagtatgcactaccttgctaaggacagtacagagaattatatcctcacatctctctgaagactggtgcaaagtagcttcaaagcttaaacaaggttatttaatctgttgccacttccaacaaactgctcaaacacaattatatacagcagggtaagcatggagcaggttgagccagaagaaacaaagagcaggatatgtttgtatagagaatggatctatttagtgttaccagatcctaaagctggaggcagattctcgtgcaaaatggggatgagagttaagccagggtaagacaacggagggcattgaatgtcccaataaatatctcagagttataccttgcattcaatggcagggttattgaacatcttaggtacggcagttatgagaaagtatagagagtaactcaaaacagaatcagggcttgaggcagagggattggtcaggaagccactgcataatctaagcaagagaagatgaagatcagaacaaagtcagggtatgaaagggatgaggaggaggttgcagattcaagaaatatttagaggctaaaatcagcaggacccagtgagcaattagatgtgagaacaggggtatgttggagacagaaaggaactaagggtggctcagatttctgtcctggacaactgggcagatgcctggaccatgtccctgtgaagccagaccaagccataccccaatatgatcttccaaattacagtgagaactacgcacccagcaaacaggaaatctggaaaaagttccaagaagaaaagatttaaagacaaaaccaagtttggaaatatcccagtaacaagtactggaaatcataattacagacgcataaataaaaggccagcagagacaaacgaccatatgatgctactattaaagctggctttactgtacacggtagtatttctactgtgtttcaatgttttgcctgtaaaatacacaaagctataaaatgtatatcacatgtgtgtctgtgtgttttacaaccaggccatgccttagatgaacaccttctgtcctgtagtatttcattagacacagcacttttaaacaatggagggaattttagcaagtacatatttccaatgacccacccagaaaagagatttgagtgggtgggcacccatttactatttaggtttatgaattattattatttctacaacttttaaaatattttcaagttgtcttaaatagtgtatacatcattaaatagatgtcaaatgattatgggaaaatgacatggaattgttgaagatttgaagcactaccagtcatgggtaactaaatttaaaaagacatgtaggatagaaaaagacaaaaatgaacagcaaaacgtccagaagcttggaaaaatatgttcccatggagtaaattcaaggtctacatgctgtgcctaaattcaaaccaagacctagcatgctggcttctacattccacctgctgccctaacagagcttgttttttgttttttgtttttaaaaaaaaaaaaactaaaagatcgaagtcctacaccttgaaggacacacaaagattttatatcatttatcaaggattgaaataaataatattcagaaacaggctcctggtcttccagtttcacctgtgaaatgtacctatgttccatggactacagaacagttgaacacaagtaagatccgggtttgaatcttgggtctgtcactagcaaactgcattccgtggaataaggcatcctcctttatcaccttctgtctctacatctgaaaaattaggaggtgaactcgagcatcatggcctcttcctgccaggtcctccagccaggcagcccctggagagtcctccacagcactccacaagtttttcattaatttcctatttcaggtctctgtggctggaaggcaaatctatgaagatgggggtcatgtaatcttcttgacttcagaatacccaatgcataatacagttcctggcactcaggaggagctcaataaatatttttaaagtaactgccttcaagtaacttccaaaggctttttttaattcatttgtttttgtgcagttagttactagcaatgccagaaataaaattcagatccctgatactgccctgagagtggagggcaaatcagttctaagttggacccctgtccattctgtttttgctatcagatcatttggggacttgcctcattagaagctttcccagtaactggttgcttgcccatctgaaggtccacattcctaaactgttccccagagcctcctgtttcttccaaaaggaaacataaaccctatttaggtttgtcttagattttacattaacaaccataaagagactgatcatgaaatggcacatactaggaaagttgcaaaggtaagcagaatctcagggtaacttctcaaaattaagccttgtcccactcaattcttctccttccctaaaaatccctagggaatgatccatcccacaaagttgcaccatccttttgtttttttgctttttatggcagggggtgtttgtactttttacatttttattttcaatttttgtgggtgcacagatgtatatatttatggggtatatgagatattttgatataggcacacaatgtgcaataatcacatcagagtaaatgaggtatctatcacctcaagcatttatcctttctttgtattacaaataattctattctattcttttagttattttaaaacatacaataaattattgttgactctagtcatcctgtcgtgttatcaaatactagatcttattcatcctatctaactatatttttgtaccagttaaccatccccactccccgactccaaccccagtacccttcccagcctctggtaaccatccttctactctctatctccatgagtttcactgttttaattttttttagctcccacaaataagtgagaacatgagaagttggtctttctgtgcctggcttattttacatcacataactacctctagttccacccatgttgttgcaaatgacaggatctcattctgtgttatggctgaatggtactccattgtgtatatgtatcacattttctttatccactcatctgttgatagacacttaggttccttccaaatcttggctattgtgaatagtactgcagtaaacatagtagtgtagatatctctttgatatatggatttcctttcttttgggtatatacctagcagtaagattgctgcattgtatggtagttccatttttagttttttaaggaacctccaaactgttctccatagtggttgtacatagtggttacactcctaccaacagtgcgtaagtcttcccttttctcacatccttcccagcatttgttattgcctgtcttttggataaaagccattttagccaggataagatgatatctccttgtagttttgctttgcctttctctgatgatcaataatgttgagtacttttttcatatacctgtttgccatttgtatgtcttcttttgagaaatgtctattcacgtcttttgcccattttttaatcgaattattcaatttttttcttatagagttgttagagctccttatatattctggttatcaatcccttttcagatggatagtttgcaaatatttcccattctgtaggctgtctcttcactttgttgattgtttcccttgtgtgtagaagctttttaacttgatgtaatcccacttgtccatttttatttagatgcctgtgcttgtggggtattactcaagaaatctttgcccagtccaatgtcctggagagtttccccagtgttttcttttaggagagtcatagtttgacaacttagatttaagtcttttctacattttgatttgatttttgtatatggcagagactgggggctagtttcattcttctgtatatggatgtccagttttcccagcaccatttactgaagagactgtcctttccccaatgtatcattcttggcaactttgttgaaaacgagttcactgtagatgtctggatctatttccaggttctctattctgttctattggtccatgtatctctttttatgccagaaccatactgttttggttactatccaccattgctttgttcctgccatggggagttaacctctttggtggggagtactccccatctccttgaccaagatccctcttcctcagccagtagagagaggctcccagtttgaaccttctctcaatttttctatctactgattgctgggtcccctcccctaagccacagggactgggaaaatagctgttgactccttcagaggaggagctccagaagagtgtaaacagagagctccccctaaaacttcctgctcagcactgccatcctgatgtccactgtctctgagtctccagaagagactccctcacaatggcagaagtaaggggctctgagccagccacacccctcacaggtactgccctgcccttctcaatttctccaagcagcttcctcttacctgctagccctggctgagttcaagttttgtatatttttttctcttgacttttgatcttccttgcatgcccacttttatttcattcctgttcttccaatgggaaaaatttgaagcttgctttcaaataaggaaagaaaaaagtggacaaagctaagttataatatatagggataggcaaatggataataaaaattacaaaggaaggtgatataatttgtatttgtgtccccacccaaatcacgtgtctgactgtaatccccagtgttgaaggaagggcctagtgggaggggactggatcatgggaacggacttcccccttgctgttcttgtgataatgagttctcaggagatctgcttgtttaaaagtgtgtagcactgtccccttcgctctcttccttctgctgcagccatataagaagacatgcctgcgttcccttccccttctgccatgattgaagatttcttgaggcctcctcagccatgcttcctgtacagcctgtggaactgtgaggcaattaaacttcttttatttataaattactcagtcttggctggacaccatggctcatgcctgtaatccagcactttggaaggccaaggcacgtagatcacttgaggtcaggaattcgagaccagcctggccaacatggtgaaacccaatctcaacaaaaaatataaaaattagccaggcatagtggtgggcacctgtaatcccagccacttgggaggctgaggcaggagaattgcttgaccctgggaggcagaggacgcagtgagctgagatggcaccactgcactccagcctgggtgacagagtgagactccgtctcaagaaaataaataaataaataaataaataaataacccagtctcaggtagttttttacagcaatgcaagaacagactaatacagaaagtaaggcagagattaccacagaagtcaggagagtggttattcttgaaatcaaaacagcatggtactggtaccaaaacagagatatagatcaatggaacagaacagaggcctcagaaataacaccacacatctacaaccatctgatctttgacaaacctgataaaaacaagcaatggggaaaggagtccctatttaataaatggtgttgggaaaacgggctagccatatgcagaaaactgaaactggaccccttccttacaccttataaaaaaattagctcaagatggattaaagagttaaacgtaagatctaaaaccataaaaaccctagaagaaaaccttggcaatactattcaggacataggcatgggcaaagccttcatgactaaaacaccaaaagcaatggcgacaaaagccaaaattgacaaatgggatctaattaaactaaagagcttttgcacagcaaaagaaactaccatcacagtgaacaggcaacctacagaatgggagaaaatttttgcaatctatccatctgacaaagggctaatatccagaatctacaaagaacttaaacaaatttacaggaaaaaaaacaaccccaacaaaatgtgggtgaaggatatgaacagacacttctcaaaagaagacatttatgcggccaacaagaatattaaaaaaggcttatcatcactggtcattagagaaatgcaaatcaaaaccacaatgagataacatctcatgccagttagaatggcgatcattaaaaagtcaggaaacaacagatgctggagaggacatggagaaatagggaggcttttacactgttggtgagagtgtaaattagttcaaccattgtggaagacagtgtggcaattcctcaaggatctagaacctgaaataacatttgacccagcaatcccattactgggtgtatacccaaaggattataaatcattccactataaagacacctgcacatgtatgtttattccagcactgttcacaatagcaaagacttggaaccaacccaaatgcccatcagtgatagactggataaagaaaacatggcacatatacactatggaatactatgcagccataaaaaagaatgagttcatgtccttttcagggacatggatgaagctggaaacgatcattctcagcaaactaacacaggaacagaaaaccaaacagcacatgttctcattcataaatgcaaattgaacaatgagaacacatggacacagggaggggaacaccacacactggggcctgtcggggtgtggggggctaggggagggatagcattaggaaaaatacttaatgtagatgatgggttgatgggtgcagcaaaccagcatggcacatgtatacctatgtaataaacctgcatgttctgcacatgtatcccagaacttaaagtataatttaaaaaaaaaaagaaaggaggaagtggtgtggtttgagcaagacctcttggagaggttctggggtaactaaaaagttctaggtccttacatgagtgttggctcaaaggtgttcatcttataaaaatcatttgctgtgcatgtgcttaagctgttttctgcatttgtactgtacttaaaatttttacttcttttttcaactctcatcatcttggattctataacttaactatggaataacgatcaactggatttgtgtagaatttgttctgtaaatagagaacctaacaagtctcctcccatgttttcataagttctcattgctgcaataaatatttcatatccaacttccatttgcttgtctctattcatgaatcaaagcagatctgcttgaagacagacagtatgtctaagtaaggaaagctaggctagagaaaagcttccatgatggataacctagggtctaaaaggcctgagtagtcactaaaaatataatgcctctttccttttatgtctgttaaagtattttaaagaatttctatgtaccgagaagaactttaaagcagatgaaggcaataatgatgttattattatgacatctattgctattgcttgcctggggctaagtatttaatgcacttcatcaaatttaatctttataacaaccctaagagatggatatcatgttttcttagtaattctgcctggttcatactgttatgaacaggctgtgctcgttctcacctctggacctttgtacatgctgtttcctttacctgaaatgcactgcccccaaatatttgcatggctggcttctgctctgccttcagatcttagcttgaatactgcacactcctcatttcacaatcatccctcttttcctttctggtaccccttaaaatatattcccaatacattcaccactcataaaagcaagtgtccagtgggattctttattccttgacagaactatagtaaaatcttccaaaagtaacagatgactctgatgactgagccatcctggaaatttttttcagcgaatactcagctagaatgaggcaaactatcttgagatacttaccttttaataaggagccatgaaaaaaagaaggcaattaatacataggtctggccagcaaaaatggtattgttaattactttgaagaataaagaaagcactgggcgtggtagctcacgcctgtaattgcaacactttcggaggccaaggtgggtggatcacttgaggtcaggagtttgagaccagcctagccaacaaggtgaaaccttgcctctactaaaactacaaaaattaaccaggcatggtggtgagtgcctgtaatcccacctactcgagaggctgaggcaggagaatagcttgaacctgggaggtggaggctgcagtgagtagagatcgcgccactgcactccaacctgggtgaaagagcaagactttgtctcaaaaaaaaaaaaaagagagagaataaagaaagtaaccatgcccaatctcaaatgccaacctttaggcttagaagtgagaaagcctaccctctgtgcaaaaatgaaaccaaagaaaagaatcttaaattctcattgaaacagctgtacatgggttttggcaagtcaagttttaattgcaaaatttaagcaacaataaagatagcaaacacaattcttcagccatgagaagaaagaataacgatacctgtatgcacttaaaccaacagggaagtatacagtgtttctaaaatttatttcatggctaaaatttgtgtttagcttggttttgtggctgcctttgcagcctatatgtgcagggctatataaatactcttcagggatcctgcctccccatagcatcaatcaaattaaccaagtagccgtcaaagtccgtttggagagctctatgtggctcaaaccaactgcaggcaaaccgcgtggccacaggagccgtgccatttcctcctcagtcacctcactcctgtggcctctggactggagacggtgtccagcctctcgatttacaggaaccctttgcccacctccagtgcgtgggtatgcaaggccatatttagctcaacctacgcatagttcactttgcccaaccaggtgaagccagacaccaagtgagcacaaagaagaaagggctttctgtctcaagtatctgtctgtgtgaagtcagtggccactttggtgcctatgtgtcaaattctttgggtttttaatttagaggtggaaaatacagccatctaactctagcaagcaaaattaaggaggccatgatgtttcatggcaagaaaataaaaccatttgaaaatggatatgcatatgtgtatatatatctatatacgcgcatatataccatatgtgcatgtgtgctcaatgagggtatggctagctgccaaacattaagaaaagttctaaaaatttatgatgctgggaaaaagtatacaaagacataaatcttgcatttttctcccagtcagtgcaaaagtatcagaacaggcatgcaaatcttcaatacagtttaaccctaagagtttcgagttaaaacatatcagaatatgactgaatatttggtcaatgctaggtgtagtaatgataatgatgacaacagtaattgtgactgtcatttccagagtacactcccatgcataaagaactgtgacaatgactttacattgagaagtcattgattcatacaaactgatgaggtagctagtcttcttatccccattttaaagataagaaaactgaggcatagcaagagtaagcaatctcaaaatcacacagctgtgaagtgctagaagaaggaatggattccaggcctacgtaactctagattgaagaatgaaaagagatggccactgacatgcagcctcccttctgaaatggggaatggaaaagaaacaacatccagatctagacaaagaaaaaaaattgggaagaactcaggaaatttctggataatttaggcctttaaggaatcaacatcatccacaatgtctacataattttggcaatatgaagtctttttgtgattacaaatgactttgaattttctgcagtatagaaggagccatttgaaaagttcaaaacccaatcagtatattatttatatgatgcttaaaaattagcttgcttcatttcaaataaaaaaatcatgcggtctgggggaaaaaaagataaggttacaaaacatgccagactgttcccatctctgtgcacataatccccattctaagcagtgaccttggaggctgtgacctactccaaagatgtagcctttactccatgacattttgggaaacagctttggaaccatcttcagagttaggcacagtaccctgccagaagcataactttatagccacatgttttttagaaccaagtctggagaataaggctgctgatcaaaataggaaatgctgggttttaggtaagaacatgtgattacaaaagagtatgatctcttgcatggctttcaaggtggccagaggagttccagaaagcttttgagtaatagtcgccatgctgggaagtgaataccagttccacggggtgatagctgagaaggaaaacattcatttgaaatgtgagtgccaaaaactagactattgaagatggtggctgtgacgtagtcctagtgcttacacaggtttagtgttccctgcatggagcccggcacacagcaggtgaccactgtgcatttgctgaatagctcaattactccatccatctgtcaattagacaatgaacaaactcttggctagtgagaaaattccttgctcacataagtgctattggccaagatctaaacactcagaaaaagtatggcttcacttagagaaccaaagtatgaagaaaaagttgctctgagaacctgctggctcattttgccacctttctgaaaatttttccagtctgcaggccatgtgccctacatgtgtgcatacagggtgcctgccacacaaggccattgctctgaggacagggtggaaattaggtttcctctggcccctttgttacgctgccctccctgctctccagacagccattccaagcagcttctaatgaggaaggtgccctctgcaacttcaaggagaaatgaaaaacagctagggtagctcaacaataatgcacatcttcaaatgccaacaagaatgcctcttgcagaaaatctctgttcaaacaaacttcatgacaaaatctaaatagtgcattctttattcatggttagcctatctgattattcagttattcatgcatctcattttatgaataattaatagtaattatcttattacctatcaggcactgaaaagacacaggtcctcacttcgaaggaggtctccattgagtctcaggcagaacacacactcctgctctctcccgagccccctgcatgggctgattggcgttggcactcttctcttccctcacagatacagcctcagtccttctctcctgcatgctgagaagccactaccaatcctcagagctgctatggaagcttatttgcaactctgctcacttataataactcatgtattcagttagtcaaaaagtatttattgaatgtctaccaagggccaactctgttttggatacgtaagatagtcctacattctaggaggagggatgatggacaaagtgcctatgtgctcatgggaaagacagataagtatacaaataactgtacattattattttaggctgtgatataagtgatgaagaaaaataaagacagaaacataaagaaagacaagaactattaattagaaagagcattcagagaaagcctgtctgagaaaacgacatggcagcagaaacctacatgaaatgaagaagtaactcacacacatacctgaagaaagaaccttctagctaagggaccagcttgttccaagggcagggagggtttggagactggagtgctggagcagtcagtgagggaaacaatgggaggacaacagggggtcccaaagagagccagggccaatggcacagggtgctataggctatggtaagtaaggtctttacagagccctcaccagtgtaaatgctgaaaaacaacatgacatcatcagcatcctagcaacatcatcacggcatcaacctgcatttactctgtgccggatgctgttttctaaatgaccacacaacactaggaggcaagtactaccatcacccgaaacttatcaaccttgttgcacaacacacagctagtaagtgacagcatcgggagtcaacacagaagccaatgatcttaacccacgtggtaaaaacatcccttagaaaagcaattacaggccgggcacagtggctcacgcctgtaattccagcattttgggaggccaagtggggcagatcacttgacatcaggagtttgagaccagcctggccaacatggtgaaaccttgtctctactaaaaatacaaaaattagccagttagtagatgagccaggctcaggcctctaatcccagctacttggaagtctgagacaggcgaatcacttgaacctgggaggcggaggttgcagtgagccaagatcacactactgcactctagcctgggtgacagagtgagactccgtctcaaaaacaaaacaaaacaaaaaagcaattacagcccggcctggtaaagagataaaaaacattcacacctactcaaaacctgtaaaacaagctaatgatctgagtagatggctgtggctttgttcaagactccagctacttggtcacacatgggttcctaaggtactggggtcaaacctctcagaggggaagataaggtgcagggaaggctgcaccagatgatggaaaagcacctccaggggggtcactgactgttaggcagaggaggcttgtggagagttcaggtgacattgttccatgaaatacaagagtaaaaaaaagcacatgttgtgtaataaatgattttgaatgtaactaaactgataatataaatgtcataagtagacatcttgattattttatctatatctctgtaagtttctatattgaaacttgaaaatttatctttgagaaatagtagatgagtttgtattcagggtggcttatgtttgggtacatgagattatatttactgactcataaatgacgggaagaagtggtcatcagagccagggatagaggcctagctcttagcctagaaacacatgcagggagccccagcaatgctgcaggagctgacttgggtggaaaaactcaagctgcctttacttagaaggttcatgttttaaacttgtagtgctgcttagtccaatctaccaaaaagccctacgcccacatttcctagtatgtcttatgattaggtcttcatggttctgtctgtccattagacagggcatgagagagaagcaagaacccagcctcgaaaaaccaagaggttctttcagagcccaacatgatgcctgtggaatgaatgaatagattaaaactttcatttcagaagcatttaaaatatagagctatgtccttatttttatatgggaaacaataagctttgagaattaaaaacattacagaaaagaatgtccttgcccaactgccatatatctcccagacttcatagctaactatgatctcattctaactactaccctggtctcaaccactggactctaacgtacatgtggtaattcctgtgaagtgaaactttattctggtgaaccaagcaacagtcaagaacgaccttaatctctcatttccactaggaggaaaataaccttgcaagatgagtaaaaggtaaagccgtcattaagtcaggttaagagaggtgcagttcattcagaaatcacaggcccatgtctgaacagacccaggcatctaggagatgtacactcaaggttatattgtttaacagttaacatttttaaatgtgcggttttctaatttcttataaggatcctttcacagccaaaaaagtacaaccaaaataaaaacaagtctgctggtaatgacacagggacgctctgtgcttcattttcaacccgtataattgactttgacagcataacatgagcctagagcactatattccatattgccttagcagaaaaaaaggtaaaattgcatccaagttacaattaacaatggatacttaaaaatttcaattttatattttaaacctggaaatatttccacaccttcccccaaaacagtcatcaatttttttaaaaaaaatttatcagatttggatttggagtatagcataatgtgaacttgtaattagaaatcaatgtggattctgggatcaagaaataatagatgaaaatattactgtacctttcataaacatttttcaatttgcttcatatcagttttcttaatgaggtacaattttttaaaagtacattagaattagaattttcttggttaatcattataacagagctgtttttcaacaaagtggcaggggcaatccaggtgaattttgattcagcaaagacaatattatgcttaataaagtatcaccgcagaatttgaccaacctcaaactctaatccaagaagtaattgcatatgtcagttatcatcagtaagaattgcctaaatcggcatttgcccaagttccataaaatgctaatactttgcaatgttaataaatgccctagtgggaaagaaaagggctccctttgtcaagtgatttagagaaattctggattgaagaatatcaaacatttcttttgactgcaggacttctcagagcctttaacatgttaatatgcacagtattcttaacctaaaagaatatgtattattttccagaggcatttgacaaatgaaaccccttttccttatagtattccatagaaccatcactctgataaacatgttttgtgaaatgtgaatctagattatatcaaccctcttttagtcaaattagtctctattctattttcccacagctcactatgacctgaacaattaggagaaaaatagcccctgctgacatagtggcttattaaaacaataatctacttcacaaacaattacattttaaagccacatagttccttcccttgagaaatgtctgtaagccaggtggctcaattctgagaagttcctgcactgtgtatcttgtgtccagactgtcagagttctaatccatcttgcaccaaaaaagtaacaattggtggatgtattattataaccgattgctctaaagaaaacaaaatgtgttagtgcacactatgaaattctcaaaatggcagaccctgcactccagatggaaaacagagttcttagagtgacttacatttaaagccaggtattctatattaccaggatggtgccaagaagactgacttccctagattcccaatgggaggacatccctgctcctgacctgcatgttctattttggcagcagcctcactagttggcccatgagcctcccctgcttggaaggtgcttttaaatcaccacatatgtgcacccttcaattagtccccagaccccaggatttcagagttgaaagggccttacttcaatacaagcccctcttttgtagatgagaaaactgaggcttagagaaaaaaaaatcactcgagcctagactaaaacccagatcccctcacttcctgcttgatacattcgtctctcacccactcagaagctcagggccccacggatgacctgaggtccaaaaggccttccagaagcttctgttctagcatgcaagagccaagagtccagctgcagccacaacttcattgttacctctttcaaatactcttctgtctcagagcacgcagcagcccagtaatgcatgttctggtttactttcagaagctactgcaaatcaaatgctggggggaggacatctttagtcagaagaaaagatcttgagatattcaaatgtaaggaattttgtcttacttgttgttacatctcagtaggttgcacagtgcctagcacacaaaaaagtcctcaaaaaacatcattgggaatgcttgatgaactgaaggcagagtcttacacacatttaagaagcatttaagtctaactcactacttaaaataaagcttaatccgtttccataaaatccatgcaaaaccccgttacccaagtttatgccacctaatttttctatgtttttggaggggcctgaccagcatcttcactgttgatacagttactgtgcccaataaaaggcatgcaaagaaacagttccactcaggagaaagaaaggtgtccagtttatgactgagacctgagaaacagcatcggctctttctcttgcttaaattaacatcactaagtctcaatcttcttatctgtaaagtggtttcaaagatagtaacatcttcattagtttgttgggacaattaaacaattcattgtgtgtacacagcaacttggccaactatgattgctttttttaatggctgctaatattgaaaagaattattaagctgggtgggtaagacttgtcttgggatcagttgcgtgtacctgccatgggtgtcaatgaagagggtgcaacagacacatcaggtgtttgctgtacatgtagatgcactgccctgatgccccttcaggaccaagacagtctccaagtgccagggatgtgctttccctgagagctgccttgtctaagattacacccttctcctggcattgcccacctctattgactcaattagagtcaacagccctccaaatggctatctcagctccagagcaactgatagggactgctacggcctttgctgcaactacattacagtttgacttttccctgtgcctaatcccacttccctccctttctgagagcaccctcaataaacttcttgcatgttcatctcagagtctcaatttcccagggaacacaactgaagacattatccttggcctacttcattgctcaataaaaagcagctattattcttttggttgaattttctaaaatatccacacttgttttccatcacaagagacttcctgactctctttatgggtgacatcctttcatggatggagaaaaatggcaaagatataaataacttaaactaatttttatttattatctaaagagtcctaaactctgtactctgttctcacagtaattatctccaccaccgatttactacttctttagttaccctagttttaaagacataagagaggcacaggaaatgatagaatatcctgttataaaatatacataaagcttagtttattcacaataactaactaattttatataattttagatgctcaatctaatacccaatgctgaggggcacaagccttaggtataagcttgaagattttaaccattcaaatcctatcaaaggtagtcttaccttatggaaccagtgggttgcacaaatggcactgggcaaggatgcagaaggcttgggatctggtctcccctctgccaataactccctctaggatcgtgggcaggtcatttgcctttgctgggccctacttccttcatcggcaaaacaaggagcttgtattaaatgaagtctaaggtcctttctttttttttttttttttttttttttttttttttttttgttgagacggagtctcgctctgtcgcccaggctggagtgcagtggcgggatctcggctcactgcaagctccgcctcccgggttcacgccattctcctacctcagcctcccaagtagctgggactacaggcgcccgccactacgcccggctaatttttttttttttttgtatttttagtagagacggggtttcaccgttttagccgggatggtctcgatctcctgacctcgtgatccgcccgcctcggcctcccaaagtgctgggattacaggcgtgagccaccgcgcccggcccgtctaaggtcctttctagtaagaaaaacttatgattgctcaaaccttgtagggctttttccaggcaacataaataagatgtagagggaaagtgtaatagcagagaagaaattaaaagtgtcataaattcaagttaccaacttcccaaatgtgtattacaggacagacgattaagtgaataggaactgatttaatagttgtattttccttttgcaagatttccatctaaatcattgcctatgtcattgattgtcatttccttaatctggagtgtttgaatatatagtttggcaatgctttggacaagccataagtcaaagttaacatttttagaagttaaccatgcccaggtctctgccttgggcagtgatgtgctgaaataccagcatctatttgagctattggaaagaggttattgatgtcagtgtgtcatgcactgtaatttgcaggtgcccccctgactaacctctggtagcgataactcagggtaaacctgaggtaattatcctggccagggagagctggtttaactagactggcccttttgatgcatgttgaacacgattgcaccctagggattacacaagtcctgtgtgtgagttattacataaattctaccttggaaaaagtaagaaggtatgctgtcagaatttttttcttctcccagtccttttgctttcaatgtttgggttcttcagtaatgccttcaccgtatttactttgaaaatgatactgcacgtgttatggagtaaaatagaatagaagaagatatagatgctcccaaacacacacctcagaggtctcccttcccagtggcttttgaagcatgattctggttccgagtcttttgcctgaggaagcgttttttttttcagtgtacgaaacctgaggcttggtctaatcttcacaggaagaactctcaagcttttggtacctccttaaggctttatcttcaatgagactcacgactgcagaccagtcactgaacaattgtctgactctcagtttcctcatctataaaataaagatagataaactggtcctaccaatcctcaaggccagaaaaaggatccagcatgaagatcaccccacgaaagcattttagaaagcacacaggactctggcttagatgggcttgttttattattgactaaacgaatcatcagcagtggttttaatgaacatacaaaaatggggtctccagtttatagtccaagcttcacctcaaaataagcccatagatcagagtcaggggtaaacagaggcaagacagactctacaagcccagccctcctctctctctagaactgagcatagcatttcttttaggaaaggatccacgtctgcttctagttttcactggagctcacaaaaggatgacacttattgattttcccttattgatttctatttcagggaccaaaagccacaaaataggataacgtctaaaaaatagtgtgagtttgcttagaaagccccctcaaaataaataagagatgactataccattcaagcaagatttctttttccaaaacccccaccccaaggcttgtcatttcaaactctacccccataataacaatgattacatttgagaaatatgttgcgtttcattcagcaggatcttcagccttcggcaaacaaacattcactttgccaaggactgctgaagagccactaatggagtgaaacctgaaaaccctttggaaaagaataatgaaccccactctgtcttcagggggtaatttagtaggtagcttaggcaacacttgattaagagtaaacctctcttttccatagaaatatattgtgtttgtacagaaagcctatatgaagtggaggattaggtcagaaatccacaggaaaaagcagaagatgtttctcagaagaaatatgcaagttactgcacatttggaaaaacaagtcatactttagtgggaggaaagaagaaaaactccacatataacagttttatttacacgattgcacttggcttcttggaacatttctaacaaatagttagttcccaaatacattgcacaggatgtcttgttgcccctgacagtctatgagttactacaaagagtaatgattttaactcaaggctacctgaaactgattgtcaaataagattttctgagaccgcctacaggggcctgctatagcaaaagtcgtttttttggctcgcggaggattatagtgtgaaagaaaaacaaatgtcaaaataaatccccaaggaaagaaagcacttctgtgctgaccctcagtcctactcgtcaacattccttgtcctctgtagactaacaaatacttgagtatttctcttcgtctgaaaccatgaacagagtctgaaaaaattagatgagggtcagttcatatttcaacaatgtgataggatttatccataacttaatggaacttcccaatctctacccatcaaggtagaaaactgcaaaacaaataaataaaacacttcacagcattaaaaacaaatcatgatgttaaattctaataaaaatttaaacaaatgtggattctcttttaaacctgggttaggatgacctttctcatcttttccatatgttgaaaatgatggctgaaatgaagcctccctaaatcactctacaccatgcctaccaaacagccatggaaaactaggaactaaataaactcattttgacaatgatgaatctcttaactctgctggtcaggtttcttctaatggcagtacttaggtaagtgtaccataacacatgaacatagatcacatttaaagtaacaattttaagctcagggaattgaaaaagaaatgaatttaacttagtggcttggagagatgaacatttagatatgaagcttaaaaaattgctgcttaagatatacacgtccttctgcaaagaaacaacttagcaaaccttgggaactccataatgaactatatgttttgctgaaagctatgcatttttgaggtttatgttgtttgttacacttcctctgttagctgattccaactctaattggaggaggaaagtaaaggaagtccccttcgaaaaaagatattggctgtacagggttgcacaaattaaaaaataaaattgcctttctagcttttttttttagaattctattaaaaggacaagaataaatgagaacattcatttgctttttaaaatgatcacacttgggtttaaccacgggcagagaagaaactttacggttccctgggaacctataatttggaaacggaagcacacaagaacagactttagttttcaggcaataaattgaagagaattctgcagacatataacagaaaaggagcacaaaacattggcttgtacattttttagaaagttagtttattaactcgataagctacacatagaaaaatgcagccaaaatctacaaggatatccactggggtttcaaattggtatatttactcagtgagaaatagctagagctttaaaaagaaaaaaataaataaaaataaaaaaataaaaaaaaaaggcatcccattctggaaatgacgatttagtgtgaatctctggaaagacaccttgttgaaaaacctccatgtgggctctgatgggacacacagaagcccaaagccccaaggtcagacataaatatcatgcccaataatctgtgttctgggaaaagctctacagaattatacaagaaaatcacgatctttcacatccacctttcacacacaattcaacattaacttgaagaatgttttaattttcctccttattgcccaaaatgtttttttaatgctttattgggaatttccatttactggtgtgtgttctatatctgtattactcatcagtgtaaaatagttgcaaagaatttgttggttgatactcccaatggtcactgtcttctatgactaaaagctcattatcagtctctctgggagaaaactctagtaactgaagtccacatatgtcaggtactgtgctagattctttcataaaccttattttatttaacctgcccagggaggtaaagattgtaatccccatttacagatgaaaaaagtaagggtcagagagattctctgccatactcaaggccctaagctaataataataagggccagtatttgaacactggccagttcaactccacggttctgcatccttcccttcctgttctccttgtcaatgctccaaaaaaaatgatttgagaagctaaatcaagaacattccctattcctgtagatagtggtgatttcctctgagaaacaataattcaaggtatcttcaaacaaaattgggactcagaacaaatactaaactgccacctctttccaatgagtcaagttcggctaactagggtgtattcttagtcactttatttacacaatgtagacccactgggatcagagtgccaggccatgcagcagaggccgcaagccaatgggcaactcatgtgcacatgtgcttcacaggatcccagagtgtttaaaaattcaactaactttctaaaatctatagatttcacatacaaattcccattttatggactgtcttggataatcggaggtcccatcaccctaggcccacctttacagcagtgttcaaccagagcttagtggccactactcccatagatgagtaagggttcttgagttccctatagctccccaccaccctcaactatatccacacactaaggccacctacagctgaaatttttcattatgcatatgctatttttcttataatagagaaatatttctccagggcttgtctcttttgatagactgaatgattggcctcagttctccacctctcctcgtatctactcccgtacatttttgtctttgtgagtcaagtgaacttttccaatctgtgacttggtcatgtgctttgctttgggccaatgccaagggtgaaaatcacaatatcagttcaagagtaggccttatgaggcctagtatgtttttgctcattctcttgtgcttcagcaactgtcattagttttccctgggttgctgacacctggcctcagaatgaacacgtgtaacagagctgccccaggcaccacgacagatgtgcagtgagtagaagtgcccagccaaacccaccctagagcagctgggccagttagtcaacctgcaaatctgtaagaataaactattggtactaaaaagccactgcgttttgggtgatttgttgcacagcacagcattattatggcaattgctaactgacacatctctaccaaaaataaacaataaaaaacaggcagaaagaaccagacatcattatttttcctacacacaagcctgtttcttatgttaaaagcctagaccctgaagacatttgagtttgcaatttctgtcggaaaactgtaaacttatgaaataaagaagactggatttgtaaaatatttcgtactgtgctatatatccaggtttgactgaggtgacgcaggttttgtctattgccttttgtgttctggtttgaacaataaaaagcatagtcactctatcttcattcaactttgtttccgactttcataccaactagttgaatctcttggtgctcttctttgaagcctgatccactagctattattgttgtaggcaatactctacatgatatttttctggatataatacctgttgggttggttgaaatcatgaagccagtgtatccaattgttaccaaatgcttgtgtagaataaatcaaaattaacaggtgccaatgccacaaccaccaaccagccaagctaaatcctggctgactgacacttaaagcttaacaggctaacttgtaaacaggaaatgctcaaaacaatagcaatattaaaaaaggcaagtgcctccagaaagttttggcagtaattactacatctgagcacatctgcttaacaatccaggaaagtgggaggtttactctctattaaccttaaccagagacattttcatcaaaattaatcgtgattactttttattgcatttcaaatgctatcctttatttggggtggtcaggaatgcaactaagcaattccagaccatgctatcttttatgaagaggttatgaggtagttatcaaggcctcttatgaaaatattgctatacaaaagttcatgggccaaaacaagacattaatttccataactatatgtgtcctcagaaaagaagaaattactatatatagaaaagacaaaaactttgatgctcattgtatatcagattagaactgtagaaatacctctgcatatagtaaacaaatcgtttttaatgtttcatttgccttttccttgttattataacaaccattagtcatgaatgcttattttgggcatggtctgtacccaagtacaattctaaattatttatatgccttgactctttaactctcacaactactctggagcagatgcaattattatccttgttttacggaataatacaccatagcaaggtgagccctaaggtcaggtcgtctttaaagttctgggcccacctggacaggcgcagtggttcacacctgtaatcccagcactttgggaggccgaggcgggcggatcatgaggtcacgagatggagaccatcctggctaacacagtgaaaccccgtctctactaaaaatacaaaaaaaatagcggggcatggtggcgggagcctgtagtcccagctactcgggaggttgaggcacgagaatggtgtgaacccgggaggtggagcttgcagtgacccaagatcgcgccactgctctccagtctgggcgacagggggagactccatctcaaaaagaaaaaaaaaagttttgggcccacctactattgtctcactattcagtgaacactccaaatcaagcatcaatgtaaagggccttcagtgacaccagaaggcatgtctaggacacagagaaaggaaaaaaaaaatacctaatattgactaactagtcctcatgtgccatgctctatgcaaggtatttccttgtatttcctacactggaataattactgatttctcttttggccaattaaaaagatgaactatgagtacatattgaaattatctaacttctcctatctccaaggaggaaacctaatatataactggagaaagacactaattaataaccaaaatttaacatgaactccggccaacttgaactgctctgtttaaaggcacactggaataaataaagaaacttcaaagcaaatgccctgttttagcttgaatgttttattgagtacatggggagcactccttggccaaaaataagggtggttaatgaggaaaaattggtgtttccagtgagttggtttgtttctaagatatggctgtccattgaaagataactatattcacagagaagacagaataatgatctgtgtctgagcttcacagtcttgaacaaaacaaaactggttttgtaaactgtctgggatcagctgaatgtatcctcacccaaataccttctgtgataatacacacacatttgccttcttctattcccaaaacaatttaaatataaattgaaaaggaagacatttctatgttttaagtttcttgccaactatataaatgcagcccttaccttttaaggtgaggtacaggaaccaaaagactctgccttgtatttccaggctctaccgtaattggcttttcatggccaccattctgaaaatgatgaccctccctgggaaagacctactgggttccctgttagtgctagactcagggcaaaggcaaagtccaccatttctgtgcatattttctggcaccaatggtgacatttctgagagagtccatctctagttatttagcgattaagaagagaagcctgtgcttacctgcaaatgctgtgagttgtcagccatgctgtcttctcgcctgcgcacttcttctagtaactgagcatttttcttcttttccaactgttgattgtgcttgaggttggccaccttcttattctgatctttcatatgcctgagaaaagtcagcacagcttggttaaattctaccactggaagatcatatgttatcacaaatagattcaggaagtactaagtataggctatctggataagggcttgggaaaaagatgatacttctgaataatccattcattcaactacaaatatgtattgagcatccacttaataccaggtcccaggacggcactggggctgcagtggcaaatggggcaggtataatcttcactctcatggagcttagaggccagtgggcaagatggacaagtaccaaggaaacacaacttaggtttcttaacgttgaaggaaacaaatagcatgctgtgagagacagtgatgtgcatgtgtggacaggtggtggagtggaaggagatgactttagatgctgtggccagggaaagcctccctagcaaagtgagactgtgggtgagactacaaggagctaaccaagagaaacaccagtggcagagctcccaagtagagagaacaatgcgtgtaatttccaagacaggaaagaagaaactggaaggctgcagtgaggctaatccagggaagggtggatgtgggtgggagatgggactgcacaggtaggcagggcccaggctcatagggcctctggtccatgatacagcatttattttcttctaattggttgctgttctaattattattattattcttttggatcatgttcttattctgagatcataatccattactttgattttaaaataacaattatgaggctccaatcaaatacattgtcatcacttagctcaaacacaataacagtttggctaatcataatgttaaataaagctctggggcttggagtaaaacttcttaatgaatctacaggatgtcaaagtgcaaaatcataaagtgatcaagtgagtaaaagactaaagataaagaatgggttcaagaaaacaacaatgggaattataagcttaatgtgtactattgcaccagcagcttttagcaaaacattccacagatttaggcaaccatgtccacagcagctgtcataaatctaatccaacacatgaggaggtaggagggcagtacggagggctcgggagcattgacacaagaggagggacgagcagcagaatcatttggggtcctttcggatccctttcccccataccacagcattgccaggtcaaccactgttactgagccctgactcagtaaaaaacatactgagaatcactgctgttttaaaatgtaaacaagatgagaactagatgataaacagcaaacgtgaaattgaaacaattaaaatcaaatgaaaactgctctccgcaagaaactcttatttctagtcctcataaattatgtacccccctactctctcccattccaagcaaacgaagcacaagagcattgtttagttagtagaataatattatctagtactaacagtgtactccttgctaataaaaacagtccgagggtgcagcggctcatgcctgtagtcccagctactcggaagtctgaggcaggaggatcgcttgagcccaggagttagaccaccctgtgcaacatagcaaggccccatctctaaaacacacacacacacacacacacacacacacacacacacacacactctctctctctctctctctatatatatatatatatattctgaacactttgtcttcttatgaatatttacactaactgaagccatgatttaaatattattggtagcacttattaagaggacataaagtatgatataataaccatctccttagtctttgagttgcattaatttttgtccaatatttctccatttttacctgatacagcaacatacacacgtgaagccaccaagtcaaacttgcatgctaatccactttgaggaaattatcttttggttagtataaagatgttaagaatgccctcttgctttctaattgaatgaggacacagtatttccaaagcccatgctaacctaaggcaggcgcattttccagttccttaggaaataaggccagagctcagtaacaggatgttatggagaggtcaggatgattagtgtgattgtttaattagagggtacttttaaaaagaaataatcttattactttagaatacagtgttaaatagaaccaactgctaaaagtccccctgccccaagtatgggtgacaaatacagattattattacaaacatcatttgcacagtgaaagagctcccacaaagttcttggagcagtctgaacacagtgaccttactttcagggatactgcaatgttttttcaatcccaaagaaaaaagcatattctaaacccacgtgtcccttaaagctttcctgaattaagaaagagtggcggccgggcacggtggctcacacctgtaatcccagcactttgggaggccgaggtgggcagatcatgaggtcgggagatcgagaccatcctggctaacatggtgaaaccccatctctactaaaaatacaaacaaacaaacaaaaaaatagccaggcatggtggcaggcacctgtagtcccaggtactcgggaggctgaggcaggagaacggcgtgaacccgggaggcacaggttgcagtgagccaagatcacaccactgcactccagcctgggtgacagagtgaaactccatctcaaaaaaaaaaaaaaagaatgagtggctgagaaaaatggggtactctagttttgacattatgatggaggcctatctccagccattcctttaaacactcccttatttaagacaacagtgactgaaaatggaaagttgggttttgaatggcactgcttaggatttgggccaattagagagatgcagagcaaggtggatgagaatgatcatcttgtctttgttcatgaaactgtcaatagctacatatagtgtccacactctcctgaagtagttccacagttttcacacatatttctagcagttgaagcctttcttttacttaatgcttacttgaaagtcaaaagggaaaagaaggatttctctggcacaggtaggaaagaagcaagaagtggggtggaataggtgagcagagcctcactaccagataacccctctctcaagtgtttctcagggaagccctaaggctacctgaaacacatgttaaaatggcaatttataagggatacaggtagaggagtcatgaaatttaaaaatactagatctcttagagaagagaaaatgccctcacagatgctcagtgaaaaaatgaccacagtgatttttgctagcaacaacttcagcatttgtaagaataaaatctataagtgacctatcagtctccacatcttcccctacctgcagaagtacacccacactgaatgaatcaaagtgctaaattcagtacagctttcaaatgtctccacaatctagaaggtaaggcccctggtcgtggagactgcaatgccttcttactatcctgccccagaaccaagtatcactcttttccaaatccccatccacttggcaaggctctgcaagagactgacttgctccattatttaaaaaaaaaaaaaaaaaaaaaaaaaaaaaaaggtttctttggggtgaaatttttctccagaaaaaaaaaaacagcattacgaatacatgcaaaatgcaaatcttaaaaagataaaaacaattatggtaaaagaagtatttggaaaatatagtggtaaggttagttttcaatgtttaatttaaatttaccagtttcataaatcaagggatgtcactattcaaaattcagttgccatcaaggaatttgaattaaattaaaaatttccaacaggttcaaggtcaacaatgactaccatattaagaaagcatgtcagagagaacagaatcctgccattttcactagaattatctgtcaaattctaagaataaagtgttctctaacttgctggtgagaacgtgtcagactctgagacctctagaattacatagctaggagtgcaggacaggagatgcatatgtttgtccaagggcatatgcatatttgcaaaacaaggagaaaatcaaaacttattttaaaatctcaatagaaacaaaaagatgccacttttttacccatctgctttcaaaaacttttaaagattggtaatattcattgttggaaagaatgcaggaatctagctctctcatattggtcaggaggagtataattaacgaaagtatttttggaaatcaatttggcaatttccaccaaagcatgccttccttttgcccaagtaaacccttcttctagtaaaacagcctacaaaagtgcttgcacatgtgcacaaatatatatatataaataatatataaacatttccattacaactgtaaaagtaaaaatttgaaaattgcctaatcatccatcagaaggaaactgaagaaattaagtatattcataatataaaatcaggctcgctaaaaagattaaggcaaaggacatggaaaagccttcaggatatactgttactcaaaaaagcaggtagcagaaatataaataatacatatagtctgatcttatttatgttaaaataggaatgcctatttggatgtatatagacacacatgcatatgaacggaaactcctggaaactccacaccagtctataaaaacagtggtcatgactgaagaagggaatagttttgggaggaaatgggatcttcaatttatactgtatggtggtgtgtttgtgtgtgtgtgtgtgtgtgtgtgtgtgtgtgtgtgtgtgtaagtggggtataaatacacacatgaagatgcacaaatattaagtgtacaagtcaaaggtttttgttcaatcaaaatatagagcattgccatcaccctgcctcatggcccttccctcttcccagaagtgatcactactctaatctttatttatatggatttcttttgtttactcttgaactttatatacatggaatcatatcgtacataaccttttgtatctgtcatcttttgcttagcataaaggtttgagatttattattcatattgttgtttgtattacagttcattgcttattgctgagtactattccattatatgaatacactataatttgattagctatttccttgttaatggatatttgggctgtttcattttcttttactgtgaagaataaagttgcaatgaacattcttataccagtctttttgtggatatatgcattcatttctcttggacaaataagtagatgcatgtttaactgcaagtgtaaaatggcacaatcccatgaaagactatttctcagccatatgaatcttctagggagagcagtggctaaacctcggaagcagactgcctgggctcccatcagaagtctgccatttctagctgcgtggccgtgggcaagcttcttaacctttgtgcctaagcttcctcacatatacaaggaaaacaataactgtatctaactcatagggtgattgtgaggggttgatgagttagtactggtaaaatgtttagaacagaccgcagcatgttcactctttcactcttagcttacagtaagaagaatgtaatcatgtcttgtgcaatattgtgcacacatatttagtgtctttttacccatttcagaacagcaagtattccaaatacctcaaacaatggactttggaatgcattattgaatgctttatgtcacacatttagctcccacttacactctccttaataatgagatgagttacattcctagcaggttatcctaatggaagcattgcaggaagctcatgacagccataggtaagtaagctgggatcctgaaatgactgctcaagtagatgggccacacacacacgacagaagctgacaatgcacattgcatgcagaatttccaataatagaagcttttacttgtaaccactgagattatttcattttttttttgaagcttgtaaataccattcagtactccagcaaagctataaattttaggaagctttcataaatattctaaggatttttttttatagcaagcataaatgtgctaaatgtcatgagcatgatatcctttccaggaagagaaaggatctggcctgctgtggcaacttgaacctaactctcctcccagcaaagagccagaagccagagcaaggtctgaagacttagctccaggataagccagatctcatggacttttgcaccttgtggcagcctctccagaacagcccagctgtttggctactagttttgatcatggtcaactgcataagtccttgtccaagccatgcagcaggatgcccaagcccacatccccacattttccatcctggcttccctccttgctttattcttcctcctctccctaccgatggtccttgctcccctgaggtgagtaccatcgcgcattgtgtcttccacctcctctgtggtgcttggggctacacaagggcccagagacaaagccaccctcagttaaatctcacaacgccaacatacttaaaaaagacatcatttgtcatttaccaggccagcaggacacaccaagaacatgataacatagcataagatagctaaaagaaaggtgtcaaagggagtgtccagatttgaaaacttgagaagtagaacgtcctggagggaaagacaattttagcctccaccttgtagcatcaggccccactagcaaaaccctccttcaggaagatgttcctattccttgttcagcctgataaaatggttgaatcatatgtgaccaaggggaccaagaggcagtgcagtaagatgtccaagatcaaggactttgttgccaggtcagctgcattcttattgcagcggcatcccttaccaagtctgtaaccctagtcaagttatctcattaggggatggggacatgaaatgatttaataaacctaaggctcttaaaatagttcctggcacacagtgagtgctttataaataacagtgtcacaggatccttagggtgttcctccaccagctggaaacctctgtggccagccgcacccctgcttgggttttgcttgaggccacaagcaaagtgggttcgttcaacccacttgacccagcaggctgtgctcggctcacactaccacctcagatcccatgcctgccaagggcaagccaggcatggagtgatgaggggtgtgtgagcaagcatggggtctgactactacgcacagccaggtgttccagctgcagtggggaggaggggggggcagctccaggcgcctgctccgtgtgaggctgcagctggaccaggtgtaccacaagcaacttccactgcgggcaccaggaaatgcggtggtacctggaagcttggagacaccaggtaccacagagcctcagagagggtgtcacagccctggctccgggagaccctaggtctgggcttcccaaagagccgcagctgttctctccttctcaccgcccactatatggtgagttgggggtgtgtttcagtcctgtttctgttcagctctttctgtcccaccattcagtgggtcgtaagttcttgtcccacttccaggaagaatgaagtatatggacaactggagggtgagcaaggtagagaggagcttcactgagtgacagaacggctctcaggagacccgaaatgggtagctcttttctgcaggcaggtcatcccaatgagtgttcagctctcagcaggtagctcctggctactcgtggcaggtagctcctatccacaggcaggttgtcctgaagagtcgaggagatctgaagcaggtagctccttcccacagctggtagtcccaacatctgtgtgaatctggatgagtccagggttttcatgggctcagaagggagaaagtgcatgctgattgttccatgggtggccatgggcaggcccagaaaaggcatcataagttctcactctgggcttcagactccacccagaacaggcagcccagcccccaggcttcagtctgtccctggcttgaaggtggggcttcaccagggatctgtccctttctgcccagaaacctgtctgcctcccactgccatcaacatgccatccacagtgcccaggatattcatgtagaggggtgcctgcaggcccatgccaagccatcctcagcacccctggcctcccacctgtgctcgtcagcacccaaagtctagagagggccgaggcaacaggaagctggagtgtcagtgctgccctgagcatgcgcgcacctggccaggttgcagcagcgcccaggcttggccacaactttgctccacacaggagcaggcaccaggagtgggaagaggacagggagcaggaacaggcacttctgagcctgtgggcactgggggcttcccggcccctgagagcgcagggatgcatgggcccagagccacagctgggaagctgcagctgtgcccaggagcatggagcttctgctgtgccaactcagtaaggggcagggctccagcctgttcttggatcccgctggacccacagagcatgcaaccccagctgtgcctccccactgcagccagtatctttgcagcagccactccagacggtccactgcagccatcaagagcctgatccccctgccccaaccctcttctagagcacttatctactcccccacttcactcaccattgactttcctacccaagccaagaaaaccttgggagcaatcttagcaggtgacacagcagaaggtaacaattagcaaaagaagggtttattttccttgtagatatttcactctggcggaggttctgaagggctgattccttctaacattctcccgtattctgaccctgaaacctcccccaaatatggatgtaacaccaccttaaatgtaaacagaacccagtgcctgaaagccaatgctaagaaatgatagagcctattcaggaagaccccaaggatggagagcagagagatcctgggtgactgcagatgccctcctacccctcctgatggacttggtaagattggcatgagcccacaggaaactccaaggaaaaaggcaagccagctttctcatcctcctcagaactcaatgttgaacccacaggcatctaataataagatgctcttccttgcgagcagaccacacacagatgtcagggccacgtgattaactaacgagcctggctctgatttactatttaccaaacaaatttcttatcacttggcctcccatctaggtctggtgagccagagagcacagggtggtcatgtagggctgagaatagtggccctgggatggttatttttcacattgttaagcattaaatatgttgtcacagtacatcgctctcactgtagactagactatatgctccggattcctggtccacatggtcaaagctggtggcagatgcacttccaggagggttcaaagcagggttcctctgccatctgtgcccgcatgaaaatatcccctgcttcagtatgttgtggctccacatatccacctggtgcctcaaagccctgcccagagccaatagcgcaggagtgcaaacagggaaacattgctcctgcttccatgagagctgaagccaccatcacattttgcctggaccacaggtctcttcttgcctccctggtctccctgcttccactcttgcttctcttttcatccattctccatccaacagcaagattgggtgtttcaaagtaagtcagatcatgcacttgttggcatacaatcttccaacggcttccctttcccaaagaataaaattgcacaccagtgaactttgctggccagtctcatcccacaccatcctcaccgttagccccagaatcaggaattcagtctcctttcagttgcaataacacagcagctccttcccactggaaggtataggcacaggctattttccctgtctgggattcctctccacagccaccactcctcccacagctgacttttaccctttaagtctcagttgaagtaatgcctcctcagaaggcccttttttgggcatcaaatgcaaggatgcccctcctatcactgagaatctctgacagcaccccatgcacttgtttcacagcactcggccaatttgtaagcatatatttatttgcattttgaattccttatggactattccaccaccagacaagcaggagtccatccccaggatattcactggagtgaagtaatgagtcctacccatgtcctctctggcccaagctaccatcatgtccaagttggacgaggatgctggctccaattgtccacccaatccactctctgctgggcagcagaaagtatacaaatagattatatcttcctccctcgaaaaacatttcattggatctccactgcctgtaaaaccacccatgtgttggccgggcatggtggctcatgcctgtaatcctagcactttgggaggccgagggaggtggatcacctgaggtcaggagttcgagacaagcctggccaacatggcaaaaccccgtctctattcaaatacaaaaattagccaggtgtggtggcaggcacctataatcccagctactcaggaggctgagctactccgctggggcggaggttgcagtgagccaagatcgtgccacttcactccagcctgaatgaaagaacaaaactttgtctcaaaaaaatatacatatccatatgtcttcacactgacttctaccagatctaactcctactgtgcaagtcttatctcaccctactcccccaagctacactggccttccatttgcactctgacatgccaagccctatagtcctctgcggctctgaacaagcagtttcctcttctagaaactgtttacctcacccccaccctgccccttccttcatcactgataactcatatttattttttcaccccagtataagcatgatatcctctggaagctgtcttggcctatcaagaaatttaggtcctcctgttactaactcccaaatcacaccatgcctgtcttgccatgaactcaccacacttctgctccttttctgtcttccttgttctgctataggcaccctctgtacagtgatcacacctaccttcttgtcttctctacactaagggtctagcacaatgcctagtccattgccaccaacagatttctgctggtgacaatttaatttaatttatttctggaactgaccctcactttggtcaatggatgaaacaagtcccccttttttgccacatgctttatgtgaattcttaaaattatttaggaatgtgcatccagggatttacatgaattaagtttgctctcttacatctgttttcagaaaggcactttctattaaaaaaaattcaatttcataaaatgattgtcagttcctcaccaatgaaatgatacccagtcaaaaaaaaaaaaaaagccacaaaaaacctggactgattcttcacattgacttctaccagatctaactcctaccatccaagtcttatcttatcctccaccgccaagccacactggccttccatttgcaccctgacatgccaagtcctactgtcctcagggtggtaggtgatgatgaatactagtgagtactgttagctggtgctaacaatgacaacctagagttatcattcctagaaagctaattttcaaaattaaactggaaatctaagaggccgaggtcaaaaaagaaaaaaaagcctgggtaactctttctgaatttaatttgtattcaacagatgatttttaaaatctacatagttcacagcagactgatggcttgttctcatttatgctgctgagaaagtctttccaaagtctggaaaagtggtcagcaatctttttctgtaagtggccagatagtaaatatcttagacttcacaggccatatggcctctgtcaaaactacttaactttgcctctactttctcatgtagtacaaaagtagccacagacaatatatacactaatatatacactaacaatatatacattaatatatacactgtgttccaataaaactttatttgcaagaacaagtagcagggtcagatttggcctgtgggcctgaatttgctgaaccctggtctagaacatgagaccagggctatataatcaccacagcagcaaatgctcatattacttactctgtgacatcacatgatgtgctctaggcactttacatatattaacttacttaattcttgcaaaggccttactaggtaggtcctatttgtttactccttttacagatgagggaaccgtcgaaagttacagagctagtgaatatcagagccaagattctcaatcattctggctccagagactatctccaactcttaacctctatgctatgccaaccaactgtgcagaatgttgcagagttccttcccaccactgtcccactttcccttccccaaatcaaccctacaaagctctatggagcacaaatgggaaatctcaggatactatgtctgttctgtagttcagccacttcaagacacaccactccaaacttcacaggacgcccctggccagtagcttggttgactattagagaactagatacagatgaggtcattatttgggaacattagctttccaccagaagagcttcaggatggaaggtgagagctcagcagctttaatgccacagggcagcaacagttattgaaatgaggactcagctatgaagcagaacacaaaaccaacaagggaacactgcaatttccctgttaatttccattctctgaacccattaatctcaaggtgatcaccttttgaaaaaattataaggttctatggatggatatagccccaaaagcagaaatttgtattgtatttcacatcctggaacctaagtgtatcacaatgagtttgattcttcttcctgtacagacagattaaatctgagacaaagagtttggagataacaaagtaagtgaagataaaaacagaagctcaacacaacgttccctttttgtaagagaaggacaaaagggcaaggactatagagatactaggtaacgggtctgaggacagagcttcaggaccaaaggggcaaacccaagacagggacaagacataagataaaaactcctgccctcttcccacctcatatctcctctttgcacattatttacctcttttcaaattaaaaaaatggaatctgaacactttgaaaacaaaacattcatttaattgccacaattccatggagtactgtatcattctaaaagcctacgactccactgttagacacagccacattagggccaatttggtagggtgtcagctgtatttacagtttggagcaatataaaaacatatggcaactgtgaaaattgaccccctgggggctaacgctggaggaaaccaacattccgcagtctggccagaggttgagggcgatttgcccagacaatatacagccaaggcagcctataagcacaaggggcacttcgtgtatgcaagacctacttttattgcatcccatctgaaattgggctgcagtggtccagacataaaataaaacggaggtataagaagataaaaatcttatatgatgattttccaaattagagtatggaagtaatgtgttggcgtttatattatttgctatcagaaatcaattttaaaacattgttaagtaataaaagcatcttccatgttcaaatgttggattatgcatcagatgctgtgctaaacactgtaaaaatataatctcagttaaatgaaacaacatccttacatggagggcacttcatccccattttacagatgaagaagcagacgcttagagaggttatataatatgcccaacatcatatacttaaaaagttagggatgcagaatttgaactattgttctgatgatgccaaagatcatggcatctattatgctatataaaaataataaaatactatcgtacattactgaggccttggccacaaaagagaatggaacataataactaggcctagacattcccttttgaaagctacaatctttttttttttctatgaggtaggcaaagcaccagctgcaataaagcaagttatacactctttaggatctggtccatctgaggtgtggcttactggatcaacccaaaaataatttaaaccagcactgaattaggtttctattggtacataacaaattcctacaaacttagcagcctaaaaccacatttatttattatctcacagcttctgtgggtcagaagtccaggcacagctcagctggtccctctgttcatggtcttaccaggctgaaatcagggtgtcagccagactgcaattctcatctgcaggcttaaccggggaataatgtgcttccaagctcattcaggtcgttggcaggattcctttccttgcagttctatgcctgaggttcccagcttttaactggctattagctagagactggaggcttctctctggtctgaaaggccacccaaagttccttgccatgtggccttctacctaagcagttcataacatgcctgtttgattctttgaggctagcaggagaatctccactctgctgagatgaagtttcatataatataacataatcatggcagtggtactccatcacctttaccatatgatataccctatttaagggaatggcaaccatcacctttgccatattctatcagctagatgcaagtcacaagacctgcccacactcaagtggaggaaattatacaagggtgtgaaaaccagggggtggagatcatgggaccatgtcagaatcctgtctctcatatgcaatatccaatagaactttctgcaattatggaaatcttctacttctacgctatccagtagactagccatgagccacatgtgactattggacatttaaaatgcagcccatgcaactgtaaaagtgatttttaaatattatttaattttaactaatttaaatttaagtagtctcatgtggctaatggctgccctattggacagcacagatttgaacattaaccaatgtccatattatatgttagctattttttaaaacttcttaaacctttgttttatttttgtgtttgtgttcttctttctaaatatttcataatcattttactgcccatttcaaacagttcttagggactattcacattagtatctacctaacagacttcatttttccattgtccaaaacttcttccaaactattttcattaatgcaacttaaggcatctggaaggcttaacttatgctcaatggggggttacggtaatttatgcatccttacactttcccaagtatttatccccatgacaacacactacaaaaataaatggctgatctttccactcttcttctcgtaactcaaacctcttctcttagtctgatgtgaatgagtaaaacagaatcagtggtgggtggtggatgaagcaaaaatcaatgaaggataacaaagtggcagaattatcggcaaagagggcataaaccacttccccctgattaaatgagaagacagaacaaaccacttccccacacaattgcctcaacacaaccacttccaaaatccaccgctaaaatgtcacctgtttcagtttcacttgatgacatatttttcctaacccagtggtttccaaatagcgttctaccagtactagctctagggtatgttaataacgttaccaaaaaacaaaaacaaaaccaacaaacaaggggctagggtcaaataagtcttgagagcccatgtacagattcctgacccctggaacataagccttccctcttcttgaccaagcctatttcctcaatggacataatcctccatactagagtcatgacaggaactttacctagtgggattcatgaaaatcctgggtacccacagtttttcatgccctttctagtttccacctggatggcaatgtttctagagctcccaggggcagggtggccaaacatttaggaatgttaccctatctaaaacccacagagcagccactaggatctccaactcaggtgcctaagcatgtatgccatagaatgtagcatttgatcagcatctctttggaccaggcaatgttcatgttgtatatacacctcatttaatcctcacgacaatcttatgacatagatattacatagaccagaaaaatgaggaagagcaggaaagcaacgtgcttagaaggctcatctagctagagggaggcagtgctggagctccaccccaatctattagactccaaaattcatgtcactttcctaactgaatacctctgatttaccacacttcctaattccctgttatcagagctaaccatgataatcctaccaccaaaaagaaaaaattcactgggcagctgtaagactgtttatccaaagctacatgactcccacccaccatgggctgttccaagtgctttctctccttctcaccacagaaaactcagtaaatacccattttttcccatcagaggacaaacacacaatcacatgcatacatatatatttatatttatttcacacacacatatccctaaacagtgcttgtgaggcatctctcttttacatgtaggctctgccttctgtataacagagacattgcaaagactaaaaactatctgatactccttgaaaatagacagacaggagtaagcttactctaacattcttcatacagcatctaaggaaacgttatcagtgaatagctgagatttgagaaataactaaagttttcgaaaattcctatgggataatgtatggataactctttattaaatgtagctgtagcataatttagaaatgagaaataatttaaagtcatattgtatagatggatttttctatactagtaggtaataagtcaaattttttaagaaaaacaccaacactaattagatgaatatgaaaaatatttcattaagattcaagataaagcagaaaaaaggaactgatttgcaaaaattaggtgttttcctgatgatagggtctcaacctcgtatttctcagcccatgcagtgattctgattactattaggccctttttctggtataaatcctaaattatttcttgttgtaccttataaaatcagaattcttccttcaaagaagaaatttataagaaaaacttgcccctttctcagctgaagaaactgaaaacccttatgaaatcaacatcttcaaagcccaacccatgaagaaagcaacattttatctgctgtggtttaaatgtgtcccccaaagttcatgagtaggaaacttgatcgcctatgcagcaatgctggaaggtgggggcctaatgggaggtgtttgggtcatggaggcaccgtccttatgaatggattaatgctgttgtcctgggagtgggttccttatgaaaggacaagttcagccctctctcaccgtttctgttgtactctcttgccctctcttgcctttctgcctttctgcctttctgcctttcaccatgggctgaagcagcaagaaggccctcaccagatgccagcttcctgatcttggactttccatcctatagaaatgtgagaagtaaacttctgttcagtataaattacccagtctgtggtatatatagcaccacaaaacagatactattcaaaaataaagtgtcaaattcttaataacttgttgtttcatagtgaactcaaatctgctttccttatatttttaattacttgattttctattattttctttttttaacattatattttaatatggatcttctagaaaatcagagtattggcttacattccaaatgtagaagtgaaatgacaaggaacagtaatttccctggctgttgatgtttattttctatgttgctgtttgaaggaaactgattaaaagaaaactcctggcaacacctgaaaacatgatgactcagaaaaagaatcacagttttctcaccgaacaaattgttgggagtagaatatttctgatatagatttagaaatctctatgaactgaaggcatttcctgggcaattaatcaagagaaacttttacataaaaacacatctcgattgagctatttgcgtaagagcccacaagctgcaatgactaattataagtctcagacctgtgcagtttgctgaaatgcttttctccaggccgtcaaaaacaccatgacaacacacaaattcaacaagaataaactaacaatgggaagctacaattacagaaaggaattattcaaagtatgtgacctttgcacaaaaatgatacacgtttatttgatactactgactctcctctatttccgccctttgataggtctgtgtaattctcattaacaataatgagagatatgtgctaaaaatgaatagctgctaactccagccatctgtgcattcctggtacaaataaaattgaatgtcatcactaccctattggatttctcagtaatgctctttgctgataagaactttaaaaaaataccaatggctttttttctttttctaactcataaaaaacatgcccattccccttgctacataaaggggtctattctactcggaatccaggcagccactgagaggtgagggtgagataaatccttgcttatcaagataactgtttccccagtcagtataaatggagacaaagtatacccagactcgaatgattaaaatggccaaattcttagcaggttaactcattacttttcatccttctcttgccagccctgaaagctaagtagctgtcttaacagcctgcagcaatcacttccaaacaactctcctgccctacaggagaaaattaaaggtaaaatggacttaattcatttttcctttatgaattactggctgtcaaaaatttgagaaaggtcccaagctttaatggatacttttggaaagagagatcatgtgctatagaacccaagatggtatgctggagagccagaaaagctggaaaactggaaagtcgctggtcaggaattttatacacatacacacacacacacacacacacacacacacacacacacacacacccttcaccactgtatatacaggaagagagaagccagtatgaccatctccagtcccagccaaatgtctctgcagtgacaactgaagaacacatagcatcacagggccacatggttctaccttcacttccctaagcagccagttgacctgcagtaagccagcctttgcaagagcacctccatacacccctttcagggttgagtgttaagtcctgcttccgaaaacccaagggtctaatgatcaggtgaattgcttcttcctctagagccacacagaaggctgtagtgcttgggatcctctcttaggtttgatcattagatctagttttatatgacatacgatgacagaactgctaagaatatttattagcttggctaacaactaaagaaaaaaatggtaatcacagctctctggagaggctttttaaatttcattttatggcactataaaatgaggccataccctgagcatttaaatgggcaaattatttggttggaagtagctcaaattttgaagttcagtcacactggtagacataaaaactaagcaaatattcaaggtaagcatccatttcaaaggtaactaagacattaccaaaagagaggaagcatttatttcatataaatggccgcatgtgtgttgcaggagcatatatgtttggggtcaaggttcgctttattttaaagttttggcaaaatgtagtacctcattgaaccatcaaaaaagcagtgccaatataaagctgtcagctagtaatttatttgtaaacaacatgtttaattataatagcgcaaataacaaatcacaaatcaacttactttctctgagagcaaaatttttaaaactattccctttacaacttattaaaaaaatttagtattgtgtattaaacaggattttaaaaggacatatcaaatactaataattactaattagtaatattactaattactatagtagtattagtaataaaaattactaatatacaagaaaaactaacagtcatatatttaataagggtctagcatctagaatatataaataccacaactcaacaataaaaagacaaataacctaattaaacatgggcacagaatttgaatagacatttctccaaataagatatacaaatggccaataagaccatgaaaagatcttcaatctcactagtcattagaaaaatgtaaatcaaaaccacaatgagataccacttcatacccaataggatggctatggtcaaaaagaaaaataagaagaagtgttggtgagaatgcagagaatttagaacaattatttattgctagcgggaatgtaaaatggcacagccacttttgaatacaatttggcagttcctcaacaagctaaacatagttaccacgggacacagcaattccacttgcagatatacagccatgagaagtgaaaacatatattcaaacaacaacttgcacatgaatgtccatagcaatatttttcatatcagctaaaaactggaaacaacctaaaagtcaatcaactgatgaaaagataaacaaaatgtggtatacccacacaatggaatattatcaatagaaaggaatgagatggtgatacatactataacatggatgaaactcaaatacattatgctaagtaaaagaagtcagtcacacaaaaacacataatatataatcccaattaaataaaaggtctcaaatactcaaatacttagattagtcgttgccaggggctgggggaaagagggaataaatgagggagaggggagtgactgctaatgggtatggggtttctttctggggtgattaaattttaattctagaattagagggtggtgatggttgcacaaccttgtgaatataccaacaatcacttaattatacactttaaaagggtgaattttatggtatgcaaatatatcttaattaaaaaattacaaatgctagtaataaaaaattaaatgctataaaaaagtttataaaaagaaaacttatattgtccctccatcttccccaataaaccactctcactgttaagggttttctgtcaatctttctagaaattttttaggcataatgcaagcatagacacatctttaaaaatacagtggacaatactatacattttacagtatgtcttggacatctttccatgtcagtaacatatagattggggtatgaagaagggggctggagagagagaatggagctgaaagaaggaatgccagaaaggaactgaaatcaccctctgggtggtggaggagtaaggatcagtacctttctcaaattttcaaatgtctgttgaacaatcctggatatcctacatacatcttaatatattgaaattaaaatctcaactgttgcctcctcatagccaaaatcaccctccttcttctgtaccctttatcttcattaaaccacccaagattgggagtcaaagaggagtgagtcttccatattcccagaacatcacacacaatagatcactgtgctctaccattttaatttaaaatatctatcaaaatagttacctcctctcaattcttattgatactagctcagttcatgcctttgttttcattgtccagacactgaaatagctcccatttggcttccctgatgccaatctatgtacctatcattccatccatccttccatccatccatccacctagtcatccaacaaaatatttctgaaacatgagccatgggtcaggcattgagaacacaaaaacaaagaagttatcatctttatcattagaccattcaaagtttagtgaaagggagaaacatggagctgggaaatgataacaaaatgctttttatttgtgattttcttaaaattttactttaagttctgggatacatgtgcagaacgtgcaggtttgttgcacaggtatacatgtgccatggtggtttgctgcacctatcaacccatcatctagtttttaagccccacatgcattagatatttgtcctaatgctctcccttcccttgtccccaacaccccaacaggccacggtgtgtgatgttctcctccctgtgtccatggattctcactattcaactcccacctatgagtgagaacatgcagtgtttggttttctgttcctgtgttagtttgctgagaatgatggtttccagcttcatccaagcccctgcaaaggacatgaactcactgtttttatggctgcatagtattccatggtgtatatgtgtcacattttctttatcgagtataacattgatgggcatttgggttggttccaagtctttgctattgtaaatagtgctgcagtaaacatatgtgtgcatgtgtctttatagcagaccaggtggaactatcgtcttttgagagaaatcagggagtaacattaaatttgaacttcaaggatgtatagaggtttgcaggtatatagaaagaaagggccatttaggcaatgggaaacgtatgctccaatatagagagatgggaatggtctgtcaagtgcaaacaatgagaaaacattgggtgaaggcaaacactgaatggggaatgagggggtagagtgacattttatgtacttagggtttaagatgagacttgaaaacaactcaaggccagattgtgaagagcttataaagccaggaggtggagttggatattctgcccatcctgcgaggaggagggaacaggggcctccagacacagggtgttgcctcactgattttatctggagtagaggacagagactgggacagattgtgactctctggaggctactgcaattgtccaaattaccaagtgggacagcaacattgagagtggggaaacaaaaggaaagaaatggaatctgttggattagttacagtgagggatgagctacaggccacttagagttttctatcttagataaacaggtgaacgttgtgccacttccacacctaagtgccaaatatatagagtagtgggaggatgagtgaaagaagtggtgatgagtcctattttggttgcatgggaagtaacaggtagacatctttctaaaacacaatcctgttccccactgccttcagaataagttttttaaaattgtttttatgatgccatgcaagggaatatccatgtgtgcctgttcccacatgccccttgctcttgagattatctaggttcaaatccagagtgaccttgagcagattacaaataacctcactaacctcagtttagtcatatgcccattgcaaatcatactacccttccagggttgttgggattagaaaaattcttgcacaccagtgttttgcacagacactggcccattaaaactgcttaacaaatgagagtgcagttttccaagaaaggcacttagaattatttttcccccaaattacattaaaaatacagaggtaatatagggttttagaaaggtcttgtgtgtttttaaactttacaaaacttagttgatcgtatgataaaaacagcctaaaaatagcatttaaaatgtagggaagtttagttagtcactttacccaaacattttaattttagaaaactatataaaagtaagatgtctatcagagatgagaagagaaaccaaacaaactgaaaaacaaaacaaggaaagaaatcccactctctctagcagccgggagaactgagaagccagcacagatcctttctatcaggcataccgacaaagtaatctcagcttaaaagtttaaagtttaaaagtttaaggaaaaaaataaaaaacacctaagctctgtaggaggaagatgctacatcttgatggcatgatacctaccctctgacctgacataacgatgaggaaggaacgattccacagtgtgattactagccggacaggggctaatacgtggtttgagttctcagtccttgtcttcgttatgtgctgccagcactcccacttgtatcagacaagatcaaggcagatacagatactgtgctgcagagaagtccatctccccttcagagagttgttttccaaaaggaaaaccatcatatatcaaaacaaaggccttcatttcttttcggctttgatgctgctgcggttctctaatcacactgtgtggggccatgaagaactgtcccaaaaaatgattcctggaacaggcataaaacccctcctggaaatacatcttttctcttggctgcttccccagaattccccgcagggaaccatcttaagcaggcagaaggatggatgaccgaggtcttcccccatctctgccgtccacgatccttgaagcgcatccagagctgactgtctccagtctacgaagccactgcctccatgaaggcccactcaccaggcccactcaaactcacttcaaaaacaggaatttcacattccggctcaagagagggcaaagactcggaccagcagctcaaaaaagctgctagaactgccaacacaaacagcttctcaacttccattataagaggttttcatcaacgcctggaatcctttgtattatagaaatagctttccaccccaaaagaagcacattaaaaagtagtccctatggtcccaggagtgcttgagccaaaccaattcatactagcacaaaaagccttgctttggaatcagacacagtgtttatgattctggccctggaaccgaaatggctaagtttgaatcctggctccactacttaatagctgtataagagtggacaagttacttaacttccctgagccttggtttcccgatctcaaaaatgggactgagtaatagcacctactgtcttggagttgctataaaaaaaaaaaacatgaattaaaccttgcagaatgcataggaccagggctaacagcaaataggtactcgacaaagcctgttcttatttctgctgcaattataggaacataatttcctatagtttcttccatattccatatagtttccatattccatatagtttcttccaatttccatagtttcttccaccatgcctttattttcttcctgctctcttagtagctaggtttttttgtctgtttatttgtttcttctgtcttgctggctgttgtggaaacatggccttgttcttctggaaacaaggaggatagagatacaggctgaagatttttgtacttttgtcttttaaaaaaatttcattaattatccctacatcccctaaaactgtgtcttcttattcatcattattgcttctagcttgggctactgcctatctctccagcacagagatggttcaggattaatcctcccagaagatactcctcgttatgttcatcccaggctcaaaaagttcaaaatcttttatctcagtactcaaggctttcctctgtcctgatcagccctttctgcccttcttctccctaccgcagagtctaagctacagacagccccgtttcttctgagcatgccttctatcttcctacctctcttgccattgcttaggctccccatctagttctacatctggtaaaatcttttccatttttctagtccagcacaaataccaccacattcatagaaatttcccaactcctctctcctctgaatgtccatgacattcatatagaatttgtcaccctgcgccatgggtaatgcctctttgccaaatttcagattttcattccaatctgcctactgggcagggctacctagcgatcccaaagcatctaaaacacagcctggccaagatctctttgttcttaactctggtcatattttccatacttgttcctacatcctgccacagttagccagggatctcgattatacaggtgggtctcaccgaaaccaaggaaatctgagaaattggccttcccaagaggaaaaagaagaaaattatattccttctgggtctcacagagaagagtacggaaaacccatcctgggtccaaggtgactctggacccagggttgttttattgtctcatgaagcaagagttggctcacctttcaccccctgttgacttggttcccctccatcactgccttgatgactcacattccactccgaatgccttttttacagcttcaaattacgcataatttctacctccttataactccatttctttacaactcacattatttcttcattctgtaaatgtttattaagtgtctactatttttgcaggcactggttggataagacaggtcctttctagatcaaagttctactctagactgaaagacagatattgaacaagcaagtaagagtgtgccctattttctagtgggaaactacgtgaacttagacaaacctaacttgggcctgtctagctccagtgaagagcaaatgatgaaagtgacatttaaagttcacttggcctaggaaaaaaaataaatttatatccatgcttcatacctcacactaagataaattccatgtggttcaaagacttaaatgcagaaaatcagaacataaaaatactaagagactgtgtccccagaaaattcatccattgaaatcctaacctccaaagtgatcgtatgaggaggtggggccttttgggaggtgactagcaatgggatgagtgcctttataaaagaagtcaaagggagcctatttgccccttccaccttgttctcacacagagagaaggctctatccatgagtcagaaagcaggcgctcaccagacactgaatctgttggtacctttgatcttggactttccactctccagaactgtgagaaatacatttccactgttcagaagctccccagtttatattttgttatagcagcctgaacagactaagacacaaatcataaaattactaaaagaaaccacaggacaattgttcttatagtcttgtagtgtggaaggggcttctaagtatgatacaaaattcagaagacataaaagagatgactgaatacatttgactatgtaaaataattttgtaaagaaaacctgcataacaaaaaccaccattagccaaataaaagaaaagtgacaaatgtcagatcaaagacaaacgtatcattttcctaatatataaaaagctcttacaaatatataagaaaaagaccaataaaagaatatgacaaagtataaacacatttaaacatgtctattgtcacttgtaataaaataaaagcaaatcaaaactgcacttaagggtcattttccacctaccatattaacaaagataaagtttgaaaagcgcattgcactggcagagtttatggaaaaagaggcattcttacacattgttgatgggtctgtaaatggtttagcctctgtagaggacgagtggtaaaatctagaaaaattataagcatagtaccctagcaattccacatttaggaatttatcctacagatatattcacatacacttgaaatcaagtctattcaaagttattaattatagcagactgcatgagaggaaaagactagaaacaacctaaaagtccttcaaaaggagacagactcaattaaatagtatgcagaggtgaaaaagagtagaaagcctttaggtatagatatgggaagatctccaaaatagtttgccaagaaaaaaaagccaaggtgtagaacagtgtgaattacattataccacttgcacagatatcatattataaatactacggatctgcttctgtctctcacgatgctgcttctgggtgtagtgccagttacatcccagtgcctgatacagagcagacataccatcactatttgatgaaagcaaataagttaacgaataaaggagataaatgtttaaggaacacacttaaatacttggcccatcctctaaacgcaatatcagatctttttatacatgaatacagaaaggcagtagctgaatcctggatctctagttccaggaaaatttaaaataagtccttatataggacaaacaaggattgtatgaattagtttacatatttatatataaagattacttttcaataagcataagttcatttttctatgttcacttattcatatccctggggtcaagggaagcatgcagcaggattctgttttcaaccttttcctcaaaaatctctcaatggcttgggagaaaatgtctaaagtctttattctggcaactcaggtttttacaactagaaaagcaacggaggcagccggcttctctctcgtatcaactccctactctcacctgttactcttggcatgaaaatctttgtcacatccacaatcactgccacttactgagcatctcctatgtgccttgactgtgttccacgctcagtgtgcatctcaaccacatgcacatgagaggtaagctataatataattgtctccactttacagatacagagataggcttaaagaaaggaagtactgtgtcccaagtgctatagcaatgatgatgttgtttcttaggaggtagtctatttagttttctacactgaatgttctaacaatagataatgtcttgaataacttggactgtgaatgaaatattaatataaactaataataggtctgtgagagacaacacaagtgaaatcctagaacactgcttctttatctgcttaggaatccctaaaaagcccctgctttgcgtatttaggtggcagaagagcacccacactcagcaaggcgataggacacctatctgccaattacccagtgagtgtttctcaccaaggcccattcatcgcaggttatcagaagattcttcagttattcattattataaccaactcattctctccacggtaattatctgtgagcaacatatcatgctgcccttggaaccatcaaactgacatatgattaaatagcagagggctctgcagttaaatttaaaaccactctcttacacttcaactcacacatcacatcaagatctgttcagccacgagaatattccagttgaccaacaccaatggctggtgagagactatttcgttacttcatgctcccatgtgagacgggtggtggttatgttctcaaaacctgaaaaagggatttttcccaggacctaaagtaaaaatttgccaagcaattctatgtatgaaatcctgcattcatcccaggttaaaatgtctcaagacttgctaatattcaccattatgtcttcaaaattatgggtggaatctcactagaaatagtacattccatcaaaacactgtgagaatcacacactttacacctttcactgaaaaaagttacttaaaagcataaattattgtacatacagctccgtatatgccagtaagagaggtacttatattaacatggctaccaatctacaaaaatgctggatgagaacgtcaatctgcaagctggagttaaaacatgagtctcactgttcttggactggaaaaggagccacaccaggagtttgagatcagtctgagcaacatagtgagaccccacctctgcaaaaaaaaaaaaaaattcaattagctgtgcatggtggtaggcctgtagttctagctacttgagaggctgaggagggagcatcactgggcccagtagttcaagggtgcagcaagctgcaatcacaccactgtactccagtctgggaaacagagcgagaccctatctcttcttctttttttttcttttttttttttttttaaggaaccatagaggctcttcaagggaaaatttattcccatccccaaacacagtctacaatttctaaaactaaagttcttatgcaaaaataattctatagaacccactatgtttgcacgaagtgtaaattagaaaaaaaaaaaaaaaagctttttgtctatccccaataaaatagttgtacccaaagtaaaatcagctgatttctgggttctgttttatttttcacatctatttagcttaatattactctgaatctagagtaaaatgagagagcagcaaatattaaaatcatcaaaatcctccacaaaaaaaatgtcgaaagcatttgttatacgtaacaacaatgtattttcctcagacaaacatacacagtgcccactcatttttaaataggtccccccaaaatgtagacttcacaaagatgtgacactacacagtgtggaaattccaagcaccttcacccaatatggaagaaagtccagtcacaggatggttgggtttctctacaacctgagctagtattgtgcataatgaagtgatagaattcacatttcataagaaaagccatataaaggaaataagatattatttttctagaaagtgatttataataatactaagaaactatttttttaaattccttccccttctcagcatttacagaaaaagctaacacatcttgagagatttactatttgctgatattcatccatatggtagtaccaaccaaaagccaagaggatgagagaaacagggaaaagaaaaggttttagaaaaaaaaaaaagtacagatgaatgattaactcttaccgacttggtatctcttattctgggtcatgacttataaggcctacctggggccatccttcaattttgctgttgttgtttctccaaggaatctcagacacacactgaactataaaacgtttcaactacagtgccaattgtgttccttcagtcttcaccattctagagggtatagagtgccagaacagcaactcaagcaaaagctaaagagaaaaacaacatgcagcataaagccctagttctataaatcggagctggctcagcaaaacattagtcatggcaagtcccaccaaggctaggatcggaaaggtgtaagcaccaatccctggctacgcctcaagggttcaaaaccatttctaaatatagaacccactttatgtctgcaggagttataaatcagggaaaacaacttttttccatccccaataaaatatttgcacctaaagcaaaatcagccgatttctggctttctaccagttttgcttgggcataaaattttctgacacttcaccagaaatgtcagcattagaataaggcagctttaaagaaggatataattttctgacctgtggataaccccttcaaccccaacaggaaaaagggggaaaagcacacctgaaacctggtttttccaattattagtataactgatacaaattatttttcttagtggccaaattcttccttacaggaagtattggtctctgaatttggtgaggggagggatcatgtcagttttactgctatatccccaacacccagccagcacagactctcacttgcagaaggatttcaatgaatagtcaaggaagaagaggaaggaggagggggaggagagggagagagaggaaaagaaggaaatagggattgaaagtgagagaagttcagatgaagatcttttcccctctccttttatttctgtcttcatttttcttgaacttacaagcattcgacttgatagaaaaccaatgacatcttttctcagggcctcatgtctgaagccagacatgacatccagtgtagacaactcagcttccagaaagagccccagcaactctccatggggacaaagaaaagaaagagtggggtgagacaaacccaatggttgctcctttgttcaacagcattaaagagcatgactgccgcctcccatgtgtggcacaacacactgtacagagcccacacagtcagtgggctcagggaaggctttggtggaagaggcaactcctgccctggctttagaggggcaggatctgtacaggaagaaccagaggcattcaatctcagcataaaaggagaggctggctggagaggggagataaatctcagaatgaaaggagaggctggctgcacagctggcaggacagtttttccccaaagtgcttcatggaatatattcaatgaacaccatattcagaaaaccgaggattgaacagaactgcacaggtttccttactgcagaccttctcagtgcttttactatgcaactggagcagaagtggcaaaagatcccatctgtaaatcaaaatggattgatttagggggtaaaaaaaccaatgccttttcttactaactgtataaatttagcacaatgttcaactttgatgaacacgtttcctcttacctaatatggaaaaaaaataatagtcccaacctcagttgttatgagaagtgaacattaaaaagaacactaaaaaaaaaaagtaattaattcagtgctggcacttaattaacaccaaatgtattactgttgctgcttctgctcctgttgtttctattattattattgttatcaacctatgtcatgaatataaaaaagaaaaatgtcacaccgcatttcttaaatggtttggtcagtttttcgtcaggtattttttggaaatgctgggccagcacacagtgcctagcctattacacagtaggcactcactatatatttgtggagggaatggggcaaaatactgaccctagcaaagaacaaattgcaggacactaaagggatgctctggcaaaggtgtttttcattatttatttgggcaacagacctctgagttctgggaggagtgacttcaccttttgctagaagaatgagggattgaaaacacagtgttcagctttggggaaacatcacaaagagtttattttggtacaagtgtttgaagtgactctataataacgagctcacgcctgctgccaggcgccagccatcagcttgagcctgcttgcagggcagtgcacgcggtccatcaccaacagccccttcatcaaacaggtgatgcccatgtgcaggcaggatcccagaagacttgctccaaagatggctccctcttctccaagaggggacactgaggcccaaacaaggaatcagctgacctgggatccaaagtgggctgaagaccgagagggcctgggagaagtctatgtcttctggttttacttggttgattctctggcaggactttgaactgaatcccaaaggatactttttatttttttagtcaattgctgcatacatttttggagataacctcatctgtcataagtcacatgctaatctcacaaatagttactagaaatataaaagtttcacgtaaaccctcccccgagtacaatacagagatcctgacaaacctctccagcttcccacctgtttgtgtatgaagacattcttgacagacatggagtttactggagtggagacctgaacagatttggaatatgatgcttgcattttaccaaacccagtacttaatatctgtccacctgaatttaagcatgagagtctacatagagtttgaagaggaaatgaagtcatctgaaaaagtagttggagggagaacttcccatggagtccacagcacacagaaaagtctcaagagttactgcagtttccaaacttcagattaggaggtggggatgtgcagggcaaaccataaactatggtaagaaagactagatacaatttttctaaaatacatgatatgtgtatacacatacacacatatatatacatatatgcacacacatacatatgtatctcaactgtatgccatataaagaaagtacatagtcagagatcctgcattcagttcaattattacattttatcttattttaactggtaaacctggaagtcattgggaataaagcacagttaattctggaaacttgtcaaagttgaacaaagcttctaggactctaaagactttttgtttccaagagggcagagctgcccaattcttcctacactaaaaatataaccagagatgattattcacaatgattgcacattttcatcatgttcatttgaggcaacaggttaaatgatattggaatgatatgaaccttgatgtaactcctatagttcatccaactagatttggcatgtgcattttgccacatcctatcaacacaccctgccccttgtccagagaaccactggacatccatcaccccttccagccctgtcttctgagagtcagagttcatgttctttcaccatgaaataggaaaaaaaaaacaaaaaaactaccacacaataagttcctagagcataaaaaaccacagtagtgtataggtaaaaaactaaaggccctgacaggaagcttgaggtgtgggagcaaaagggatccctggatctcaagtgcttcaatattaagaggtacaggttagggcagcaaagggaaggcaaaaggagggggatacaggcaggcaaggagaaaagcttgaagcttcattaaatgagtgaatcaaaaacttggagaaaaggtttggatgcatgtttctaagccttccccatcccacccttccctaccgcccattatgatgtctgtgtttctgcacacagatgcaccagatttgttctgctccagaaagtaaattaagagtcattaaatttgagaataagagcagttctctgggggccatgcttttaatctctgatcagatctcttggaacttttgagaatgacgctttcctgcaccgcgatgaagttcaggcagttcttgggggatacgcagtgtggtatgtgagagtggcagagaagtattcaaggactatgagccaccaggattggaagccagcagtgggacaaaatcagtagatgagcaggtttgtgtataaagacatgccttgttttgaaataacttggtactgtagtcaatggattggcctggtggtttgggtgatggggcagaataaagggttgcagaccctgtgtacagagaagaaaataattatcgcttgcctctcaatagagcaactatactgactgccacattgatgtgatgctttctttttttgaagtttagatagcctcaaatcctagaatgagcatcctttagtaaactcattgattgaatgataaagaaatcactacatattactatgttttattggaaagagaagttgtccttgacttaaggaagaagaaattatgggcttgggcctcctacattggaggaatcaagcctgggatgcattttcagacaaaacgcccatttcatttcttaatattggggtacacacagtcaacaatgaatcaggtcttacacttggttccatatgctatgccctaggtaattaaagtatgccttatggataataaaattgaagttagaaagttaaaaccaaaacaatgtcaggaaataacatgtgtgtacaatatgttactaacacattgataattttcaaaagtgactttttaaacagtattatacatctttcagaacacagtgatttattaaatgaaaagtctgaacagtttgcactgttaaatttagcttttaagttgctgtgtcatgggcagatattttgttctcctaggttaaattcagcatcctgcattatgtttttatccatggctccacgttgtatcatcctgcagtcaattttctgaactgctcaggagaaatgcactggggagttatcatgaaaatttctctcatggattttataatccagaaatagaattaaataatccaacactgacttatttccatctttttccttgccttttcccacctatacatccttttcataaaataaaccttcccaaggcatggaatgaaatgagcggggggaaatgcagtggcccgaggaaaaccatttcagaaatgtgtttgttaaacaagtgcaagccataaattgagcttaggagggaaaggcagttagaagaaaaactgaaattactgacctgagagtcaagctgattggagcaagggtgaaagcagcaatttggaggataagcagaaaggaaaagggatagcaaaagagaataaaaggaaggaaatgcattagttttaaacatatagccaacagatgttatatcagcaggtttataactaaacgaagcaaacttttatcttatattacccccaaaagccctgggcacacactgtaagctgttgtattaaatatcataccaaagaaactggtagctgctctgatatgtataattacaaaaagcactgatgtgaaccagaggtgtgctcccacagtacaatgacagcatcagcccttctctggaggaatatttatagagaaagttcctatctgtgtgcatataaaattttattatttaataaactgaaatggaaactactaaggtattagacctgggtaagtgctcatgtcagaaagatttttatttgaaccagtaagttggatggttatatcctatgagatatttttccttcatccttgaaaaccaaaaggagctgagcaatttggctttcggttcaaagatttccattttagatgcttacagagcactgcacatagcaatgatcaaagaccccctgaggagggcttttggtggtgtgccacccacctatcagcttccgcagcaaggacagagtaactttccaagctgagagtgatttttttcagtcagaaatacgaagttccgacttcattactgaaaatatcaagttataatactttttaatttgtttgtataaaaatatctagcatgtccgtctcattggttaaaacaataatctctattgtcaagcaaaaaaaataaaaacaagcaaacaaacaaaaaaccatattcatcttccaggctactataggagcacatagtggacattcattttgttgatctgtaaaatgccctttgcaaaaacaaagtggataaacaaatacttttccagctttctgctcaatggggccccaccattccatactataaaaaagtagttttaggtatttcacatgggaaggaaaaacaaaacaaaataaaataaatcctcaggataaagcttaagctagaacatttcaaatgaaaacagtgttgattacaatgatacaactgaaagagaaaatttaagattaaccacacggggaaagtgttgatttgataatcccttgtatctgaaatccccctgcagagtgttttgtgatcataaatgcgcaactgatctaaaatgagagttatgtcaggacacgatcactgtggggactttggcaacactggcccaagctgccatttcaaatccttctggatcaaaggtaattaaatcaaggtctgtggccaagccttaggaaatcctaaactgaaatagcaagcacacatttcagatgtagttgcctctttcaagggctcccagttttcatcaaattctcaaaggtgtctgtgatgtccgtgaccttccccaaaaagttgctaggaatggcatatagccatctgccacttgttttcaagaaattctttcaaatacattaacaaatgtaagtgaaaattactcggcaagaaacatttatatcaaaacaaataaaactggcatcaagttttttccatgtaccatgaaacttctaaaagatattatcataatttaaaaataataataatgctcaagtttacattttgaatggagctctgaaaggcatcaaggaaattatgttagtacattattgagcaaatcagaagaaaaaataacattctcttcctcaaacttagataaggctcttttaggcatctaaaatgatttctcagtgtccaaatgtctggtgatattatttctccaaccagataattaagtggaaggctgttttccattctgatgttatgtcttacgagtggaacccccagggatccagcctcctctccgcattggggaggtatgtgattgagggctcaatttgggcattctccatcctctagacaaataccaacaaaatccctaacatatttaagataattacatgaaaggtcacccaaactgattccttcccatgggcgggatgtgagaaatatagtggcagcaggtcttacttgacagattctattaacctctctctttcccctaagtcaccaaaggattaattctgaaactctaaataaaactcagagaccttgatgggcactgacacagaagcactgcatatttcactgcctctaaggtttaattagacactaggttctgtaatatacgtgacatctgacattggagatggaataaagacttcagctgaatttggaccaactctcagagacttgctcaaggcccaccacccacctagtagcaaactcccctgagctgcctgcagtccaaggcagaagctccccactgggccgtgcaagagtttacaggcataactgcacgtgggaccacactagagcaacatgcactttaaaaagcaaaatctttaatggctgatgagaaacaccacgcacatggaatttaagaggtaaatgcattgtgtaaatgccagccatgtgctatctggaatgggaagattaacagaatagaaagtaaacacatactgccttctgagagaggagggggccagtgtcaaggttgtctgagttattcctaaccctgtaccttttgttgcatacaattgaagttctggaatattttagaacatttcctccttttaaaagaggtcctttcactctggtaggtcacattacaagccagagaccacaaatctatttcaagttcaatttttggttttcaaaattacaaatttaattgcaaacatttctccatggctccaaaatggagatacatgtcacattgctaagaactctttagttgtcaatattgtgaggtatgaattttgtagttttatccagcaaatgacaatattgcccaatttgaaaaaggttgcttgacaactggaagaagatgttttggtcagaatacacatgtagcacagcagataatgcttcagaaaggcaggccaaggctgagccctttttttcccaagaaacttcccctctgaatctccacccccacctccttaggggcctgggctggggctgaagctcagacatttcccagacaatgctctgctgctggacgcaagacacgggcaggcagagtactgggacagactcaggtcccaccacacgttttatgaattacagtgcctgggaggcatcagctttaaggggaggcaaaggcagagataaagaaaatgtgcagaaagtacataaagataaatgcctgtaaaatcactgctgctttaatgcattccatattgaagaaataaaaatctgaatattcttgatgatttaaaggcaatagtgtccagctaagacctgtttgtccaattagaccattaagctgtttatatgtaaatgtttatagtagcttgtcctgattttcaattacagttctggggggctggtttagcatagaaaaaatgccatctaagcgtgaagcacatcactttctctcctgtatgctaataaagaggtagatctcttgcagcccagcagcaatgcctgctcaggaaggctgtatgctggctgcttgactgtttagtgctgctgtactagcttctttcttctggcccattagcggaagggattgttctcaatggctcatctgtcagccctgagtttgaatcctgattagattcttatgagctctgcaacctggaggaagttacttaatctgtataaatcatagtttctcatctgtaaaatgagaataatgacagtttctgtattgtgggtgagactaaaaggtacacagtattgcacgtcaagtgcttcccagagtacctggcacacagtgagcatagaatatacatacaatatacataccctagtattacaaataaaactactataatttttaatattattatctagggcatcctccacatagctcaccacttctcagagcagtggactaggaatcaggaaacccatattacagtttcacatctttctgactacaggcccaatctcaggaaggtcatttaacttttcaagatctcagtttcctaatcaatgaaagagacatgatcataactttcctgtgatctcatgtcagtttttctaagaaaaattttggttctaaaatgtagttccaaaatagatccatctaaaatcacagtgctccccactttttaagaaccagcagactagcagaacatcctcacattttaaaattaaaacaaagccctttaaggattctatttgggatagttacctcaaaaaaaaatgaaatccttgactttactgctaaaattggtcacaatgaataaaaatcagattatcatcaaactaatgctattatgaagagaaatattaattgatttggaatttgaatgtaccaaatattataccggaaaatgttgaaattttattggaaattaacctacttgtttaatacagagacaaagttgagatttttttttcttttcttagagagaggaatcttgaccccaggctggagtgcagtggctcataatttactgcagccttgaactcctggactcaagtgatcctcctgtctcagccttctgagtagctgggaccacaggcacacattaccatacccggctaattattgtagatacaaggtctccctgtgttgaccaggctggcctcaaacccctaggctcaagccatcctctcaccttggcctcccaaagtgctgggattatagatacgagccaccatatctggccttgataatttatttgttttagcatttgttcataatgatatacatgttccactttacctggggaccaattgcttgcaaagcatcatttgaataggttgttagagattcactcacttctaacaagattcaaggccatgaaaggctaaggacagatgattgcttgagtccaggaattggagaccagcctgggtaacacagtgagacctgatctctacgaaagatttttaaaaattagccaggtgtagtggcgtgcacctgtagtcccagctactcagggggccgaggcagaaggatcacttgagcctagaacttcgaggctgcagtgagttgtgaccatgccactgcactccagcctgcacagctggcaaaaagcagaggcaaaatttgaactcaggtctttctgtcactgaagcccatgatctttccacaagatgatagagagctactctgtgtatgtcttgaagtcctttagggcctcacaagtgtctcgatcaaagctggctaacattcacaggtttattcaaaatttggtgatctcttccatatggattgaatctgggaaagacaaattctgccttactgctgaaccaataagaaatctgcagaggttatggagttatgtaggatttttcagaaagttttttccttacatgaagtacaggaaaagacattgatagcaagcttatttttagcatccacactatacataaatacaatacggatatgatttatctgaaaatctaaatactctgatgcaacactccctgtttttacacagaatttgctatcatgcaggacctattcaagtatatgtatttaaaaggtcctcttaagagataaacctccaggatgaatttgtcatgatgtgccaagagacatccaaaggatatgagctccttccttcttccgctatcttgaatgaagaattcccaactatattcttcggtttttggtgttggtggtggtgttgttgttgtttgatcaagacaaaactaaaccacaaatatttacctgtgatggaaaagaactgaggttttgggtagtcaaagccccaatttcttacacacttcgctggaaaaacgctagatcatggacatcactcaagaaagttgaccactattttcttcaacactgaagaagtatataatccctcagaagataagccaattgcattcttagtattccacagaaacgtcatctttcacaggccatattcctcatttatgacttgtttctaacttgtaatatgaatgtacagtccaaatccaccacaaccggagatgggcaaccacgcagtccatgttctctcactgccaacaatttatataactgtaaaatttacctctccagttctgcgatcttcttgtccttgtcattcttctcattctccacctccttgaggatctccagcaaccggtccacttccgcttgggccttgccacactcgtcgcggtagtaagacgcctctttatcgagctgttttatttggtctgcaaactcagggttcatcctggagtcatcttcaatattatgtgccttcaacattacatttttaaagaatgtagttaagacaacaatttagaacaatagacagtgctgtcaccaatggtccagaaattaactttggagagaaaatcaccaccaagatttatgggtatattgtcagtgaaaaggcaaaatagaaaaatcacacatttcagctaccttagaagaatgctgattttaaaataatattagagtttcacaggggagtttcttcaattattgatattttgttccattaaatgttgctacttttagcttttctttccaccaaaaagtagggttagatactgtgatgtctttattcccggtcatttgataagcagacctaagacaattcaactcctcacagttaaggaggtgattcatacaaaatgcttccatttccaatacaaagacaccaaaacaacacaatattggattattttccaagaactatcaagggcacatgtaaagccagataacatataagagactgattaactaataattgaacatgtcattccactgagaaatttcagcaggaaatatagtttgaaaggaggcttggaggtgaggaagggctttccagctaacagttatacccataaatcctcattctcttaaataaatttaacctaaaccaggaggaggatgagctaattcatgaacaagtacacagacaagaatctgcaaacacatgcatgggtgggtggcagcttcacacacaagaaaagacacaggcaacaacacagcaacaacattgcagaataatttgcagccaaagtatttgtgggtttgtgtgtgagagagtgcgttacagcttttttttttcccaaaataaacttttggctgaaatattcccagacagatagaaataacactgcactgcaatgttttgcctaccccttgtttcccattattcctaattgacttcttcaaagagcaggcagggaaaaaacaagtagtttatacaacagtgcacattcaacatagaaagttcagataagtcatatacgtatgtatctccaaaatccatgggtgatataatcaaatgttaacaatttttaaggacttaagtttttctgctgtcttgctacatggagcagatatttattgtgtttttatatacttttttgaaaatttcagggaaaaaacaaggcaagcaagctacagctactgtgggattgaatgaatcatgcatggttagaaaaattaatactaatactacggttagaaggtttgacagtctttgcaatgatttaatagaaaaaaaattcaaaaattagtataaataaaataaatttcatatgacaaaataatcattttagaaataatatttttgcatgtaacatattatttaagcatgaggataaaggggaaaaagttgctttcatgttcttaaacctaagatttccttatttaagaaataaactcaattacacaaaaaaaaaacaagaaaaatatgtcaattcaacacactatcaggtactggtttattcccttttaccaacatttttcagaaaacatttattttcatttatttactatgcactctgtgtttcattataatagattattaaactttttcagtacaattaaaataatctgaaagagaatcctgagctaacatacctttaggagtatatttatctaataatttcattttaagcttaagtaatgaataaatttcctaatctccactttaaaaatgtagagcagaaattctattttaaaagaaagtaactactccatatacctgcttctatttgtgacaatatgaatcattacttttgttacagaaaagcatttaaaatacacagcttttaaattgctaaagaaaaacttcgtgttaacctctctttcattttcatactgtattaccattcttttacagcagttaaaaaccttttcatgacatttcttgaactatccaaacaaggctattaagatttttaaaaaagaattaatgactgagtaatgagcagctggaagccctcaaaacaaatgaatacgtatattttgattgcctgtttcttaggacagttaaaactcctttcctgatgctaatttttaaaagttcacaaatagctagcagttagttgctgtggcttattttggttgtttttcttattattatagtccgtttttaataagtgggtacaggattactagttgcaagaccaagattctaaatccagtcctgcatcttatatttacaaaagattaggcaaattaattagcctaaaaaccatgaaaactacaaaatgacaaacacggggggagatattactcacttttgtttttattataattattatttcataatatgcatcccagaaatacagcttgttactcagctaagttaatagatttatttgattttcattgacaagatactacatactccctaaaaaaaaaaaaaaaaaaaaaaaaagcctccctgataggtttacagagacagcgtagtctgctagagataggtatgtacacatattccttattttagctccatgaagaaaagatgattattcaacgccacttttcaacagtgggtgaaatcagatgaattcatagtcttttcaaacaagtaagtaagtatggtgaaaggactcatgggatgtttagaagcacagaaagcctaggaaaaaaagtgcctgaatctagactgtaccactgttgacatcatttgatgctgaagttaggtcatgtcattagaatgaagaccagagccaagtttacgactggcctggtatctattattaacagaacacacttcaagtgctaatgagacttttaaaataaatagacaacctcggccgggtgcggtggctcacgcctgtaaacccagcactttgggaggccaaggtgggtggatcacaaggtcaagagatcgagaccatcctggccaatatggtaacaccccatctctactaaaaatacaaaaattaactgggcattgaggcacacgcctgtagtcccagctattcaggaggctgaggcaagagaattgcttgaacccaggaggcggaggtttcagtgagccaagatcatgccactatactccagcctggcgacagagcgatactccatctcaatcaatcaatcaatcaatcaatcaatcaaatgaatagacaacctcaagaatacctgtgagttaaatctctctatctctatatcaatatctactgattttcaggcaaaagaacttatgtcaagccactttcaatcttggtgccagaattgttgggagagctattaaaatgtcatttaaatgtttttaaatcaacagaaagctttaagaaaaagtcatataaagatgacagggaaaccgctgcttcttggatcattactagggtccatgtaaagactcaatgaaagagagtttcacatgactgggaaggctggtgagtccccagctaagcttaggtattggaggcaaaagcctctaaagaatttacaaaagatattgtacataaccagctctattcagcctgagtcacaacttttcagaggatgggctgaaatttttaactagtaaccagcatgaatgtgttctaccatgatctacagacatgagtgattctacactaaataaaatagtggaggaaattgagcttattaaagccaatgcttccttcaaaattatgagtcctgagcttcctccaaaaatggaatgaaataagcactttatttgtatttaggcaatattctcgccttttcaaataacaacatgagttctttaatctgactagcagctcccgatagagatcaaaagtaggtaacagacttggatctatcatactttagacactacagcgaaaaaagcagatttgaataaatcatgatcacagtaaattcctgccatggcattctaatgcattcaagacataaattgaaaatgcacagtaatatttttccttaagaatatgttggtttgcaattagctccccaacaaggtctgggaaggcttgccctttctatacttctaaggaacatcaactttgtcctcctattttcattagtcaggaatttacctcttaaaaacacaaattggtgtgagttttcttttgatggtttcagatcttatttaccatgaatatagcaagctcatcgtcactttcaaggacatccaccatcattaaaactaaaggaatatcaataagcattctttcattaatatagagatttaattccactgattaaacaggtcagtttaaaggcaaatccaggtatccgattctgctcaaaaatatttcttaaaacatttagagcaactctcaagcatcttatagaaacacaaaaaaatgggaaaaggacatttcagaaatgtctgcatcgcatactacatcagtaagttttgagggactcccaattatatttcttgtatttccatatgtaaggaaatgtccccgcaaatgggaataaccaaaacaaactctggagtctcactgatgtgggcaggcctctgggttttgatgtgaactgactttgaaagcctagatcaggcattaagaggactctgaccatggcttgggatgagcagtatattaacttatagttataataacctagtagttattttagtgaaagaatttataactacttcaggaaataaggcaaaacttcagattaatactatatgtaaatgaaagttaagaagccaaaaatggctaaagccaaactatggggttgtcaagtatcaaaatcatacgtctatttacatttaatcttctaaagactggtcattgattatttccaataaaatggcagttcatcaatccagatccctagaaaggaaagtattaactttggtccagaaacctgctgtgaaacaaggcagggaacattcaattattacattatataacacgttccctttgaaataaaccctaccaattttaattaaaaatcatttccctcaaaataaacaaataattaatcatgaccataaaataaaagcagaatgttaacgaatgtatttgatgacttttcttccctgctgtttctgggttttagcaataatttgctaaatttaggcagtgtagaaatatgatttcgattgtggcatgttggtggtttaatgtccattgacagcgctttaatattcctttcatatcttaacagcagaacagggtatagaaactattttgaaaattatatttgactacagtcttctaaaagaatttcaatcttctcataattctaagttataaataaaatattacattttaaaagaaaatttttaaggtgattattgagttataatatttatattatatattatatatgttatatataacatattataactctataatagactgatataactctattatagactgatgaaacatacatattattgtttagaatgaagaaccaagggaagaaaaagaacccaactgaagataacctgcatagtgtttctaataataagacaaaactccaggagtagaatgatagttaagctgcagaaaggttacaaaaaaaaattacaatatcaaggcaaaactttaggttcctaatttagaaaattaaatttcatttaaaatatatcaataccaggcatcattgctgagcctaaataatacatttggaaactaataatgatgtattttgaaatgttatacatcttaattctgtttttttttttttttttttttttttttgtgtgtgtgtgtgtgttttttgttttttttttttttttggtagagatggggtttgctatgttgcccagcctggtctccaactcctgagctcaagtgatcctccagccctgacctcccaaagtgctgggattacaggcacaagccgccacacccagcccctatatatcttagttctaaaggaaattattcactcacaattcaagctaactgcattcagaatattcaaaaatttgtgtattaaaacaaccacaccaaaaaaattattttcatagatggaacaaataggatatgtataaataaatataaataaatattcttatgtctctctctctttctctctctctcacacacacacacatacacacaaaagaacaactgtatgcttaatacttctaaagatcccccaaacaaaactgtaattattaatgcaatcctttttaattatgggatttcctaaaattagcaatgtagagaactgaggtaattatctggatgtcctcaaacaaaacatgtagcttcaaatgttgagtgttattgcaaatattagttgagttttttagacactgaaagcctggatcaattatagggtatgtgtttgtgtgtatgcatgtgtttacacatgctatgtgcatgcctggaattatctcttaaatagttgtaactttccactgtgctgggagataactggtttaagagtgagtcgaatacttttcagaaataggcttcaaaaatcataaaaagaaactgctatatccaaacaatgactgtgaaagcatttataattcagcccattacgttcctgggactatactgtcctgtaatgacctacaaagcaggacattaacaagattttttttctatctctctggaatgaaacatgcctgctttttggcttttgttatgttttttgtaaacacttacgtaaaatgtgagccctgctaaatatgtgttgagaagagataggatttcaaatggatacctactaggcactgggtaccccaagtgtggggaacatcagaggggtctcaaatgtgccctggccaacagcaaggttgcacccagtgcctccaaatcagtcatttgccttttagcaacaagggtattatatgaagcactaaattgagggacccagaaggtctaaagatttattaaaattttttgaaagactcccgataccatctctgcatacaatgaccacaagggctacagcaaacaaggtatttgagactgatgaaacacgcatattatttgtttagaattaagaaccaagggaagaaaaagaacccaactgaagataacctgcacagtgttataataataagacaaaactccaggagtagaatgatagttaagctgcagaaaggttataagaaaaataatgatatcaaggcaaaattttaggttcctaagaaatgtcattagatattactttgtgcaatagagtgactaaagtaaaaggagataaaaagtaaaaggttcctttcgaccctagaaataaaaatacttgcagaagcacttaaaagcttaatccttgtttactctgacatagtgtagactgtcagacagaattgactataaaattatcttatttaacaaaaaacaactatactataattcaccaaaaatttgttatgtggccatatagaaaataaacatacaaaaataaaagaaatttcctagctatgataactgattagaaaataaaataataagtatatcatttacaatagcaacctaaaaattaaatatatatagatatgcttaagactatctttaagaagaaatatcatgggaaaatattaaacttcactgtaaaaagccactggaataaatacaagttggatcaggtttatgaatggaaagaaataatattgggaacatataaatagttctaaaattattttatagattaaatatatttaaaattaaaatcaacaattttgtgttttaattgacaaagtgatcctaaaatttacttggaatgatagaaaattaaaggctaaagacttaagacaaaatgaaaagcagaaataattaaggtgtaatttgttttactagatatttaaaaatataataaagatacaataattaaaattttgacccaacaaattagagacatcaataaaactgaacagatgcttagaaactaagacactcacccaaatgagaacttcatattcaataaaatagtatcaagatcagtggataaagagagaattgtttgataaatcatgctggataattagttgataatttagaaaaatataattagaacctcacctctcaacatgaataaaaatgaactaaagatggataaagggcttaacttgataccaaaagcaaaattaaaacattttaaatataggtaagtgaaatcagagaatagtttccagaataaaggtagtgaggaaagcctaaagaaaagtacaggtcaagaacctaaaaattgttctctatatacataaaaaaatttaggctaaataaaactgccataaatctggcaaaaattctatataaaacacagaataactcatataaaccaatgaacaaaacagtaaactcaaaagcaagtgcttaactgatttaaactacttacgtaagaaaaaatacaaaaagctaataaatgtactggaaaacctcaacttcagtagttattaaagaaagaaaagttaaaaaggcaaaaaaaaattccacctaaacatgtgtcaaagttatgtaaaatgacaattctcaatgttggccagggtgcggcagaaaggccatttttaatcagtgctggaagaagcatgctttggtggaattcctaggaaacttaagatagtaggaactattgggatctttacaaatcactggcacaggaaggaggcaagcacggtggcacatgtttgtagtctcagcaactccagaggctgaggcaggaggatcccttgagcccaggagtttgagaccagtcttaggcaacagagcgagacttcgtcttaagtttaaaaaaaaaaaaaaagtgatgggggaagaaattaccaacattagaggaataagcaaatagagtagaatagtatacaatcattaaaatagtattttggaggaatagttcattatatgagaaaattctaataatgtaaaaaaaaatagaatagaaacccaaataaacactttgaagtagagtgttagataagaaaaagaaaaagtaacacaagagtgagagaaggaaaggaggaataaagggaaggagaaggcaagaggagagaggaaagaaagaagaaaagaaaaagagagaagaagaacagcaacaacaaaaagatgtctaggtggagaacaatccaaatgttccagcaattatttctgtgccgtgagatgtcctgttattttttaattttcctctataggcttccatatggttgcaaattctctactgtgaccatatattatttttacaactaagaaaaacatagtcatttttaaaagacaattaagggtagaaaatccatcatgctgcatccctatcagtccaaaaaacaattggacaccaagacagggggagttaaaataatgagagtttggctatattcccgggatgccaaaccaatgggttagtttaattaacttgaggagaaaagtcagtcaatgacttttgaattagtcactgaaaagactgaaaagttcacgctggcatattagagacgcaccactggggtgaagtgaagtaaaagttgatgatgccatgtcactgatatttctagaaatggtctaaaagctaactgagagttatttctttggtcctacctatcctgacagggagagtgaactcctagcatggtcctggtatatttttgctgctgcaggaacaaggctctccccatctgtcatgcacacacccaaaacatgacattctttggttttcttcctgttcctaactagtaagtatgaaacaattgcagtgggattatttcgcttattttttaaacaactttttttaaacactcattttttcccagggtgttttcgagcttgaagatattccagtcttatttgtctttcttcacatctccactgtcctgagcctgcttattagcacttctattcaaatgttaagggaaaagaaacttaagctgattattttttgcttctctgctaaaatctgcattttgaaaaagaggttaacaaagatgctccagcagggttttaggaattctgtttgcaaaaataaaatgtgttgtaaagaatggagggtggaggctgaatctaactaagtacacctgaacatcttgcagatcaagctgtatgtatcctgaagcagtggcttaacaaataaaaagttgtgggtgcaattgtttcctttatccatgctattcattttctccataaggggatttatacataggaggtgattagaatgcatgatagcacagatcacatctgccaaatgataaactctagccatctttatgaagtattttcccagtaagccacttaagttcactgaacaaaaaagcttttcttctttaataagtttaaaaaacaaactgcttcatatattaataaatgcacacaagtcactaggataaaaaaaattcgtggtggcacctggctcattttacaaatatttttactagttacctttttgtactctattaagctataatcagaattgttactatctgttattaggagactatattatggtttgtcctcagccaaatggcatgcctttaactgttacaaaatccacagtaatgtcaagtatttaccaatctcaaagagcgtaaccctgtttttaaatctaaacctgttttaacttctgtcacttgaataaaacagatattgaattgtttgctattttacaaatgttgttatccctttcggcctagatatgcttgtgtttgaaggatttaaggaagagttccataagcctagatcttcagctgacttttgtttttctatagtctttgggctgaggttaagaaggaggtaatatcagagttggcaatattttcttgagttattaatttttaaatttcacattcaaaagaaatggcagtggcctcagcacagatcatttcttttgacagaacggaaaggggaagaaactcaaatattttcaaaacctccccagtatggcacaccgtgactggtgatcaatggatcctcatgctttgatatgttacagcgggaactttcagaaatgacttactgggttgtacatctgattgaacaactgctcagcttgctacattgcaaagttggggaggcattgaggcacagacagggaaagaaggaaagatccagaaaaacagcattagctcaacaaaatccatgcattcgcacagacgagttggttgttaaaaaagaagaaatttcagtttctaaacattccacagtgaaagcgagatgctctagggaaatacaaatgttgactttggctcctaaaaaagaatagctggaataagaaatgtaaggtttgtgttactttccctttctcaagttaaataacccatgaaataaagaaagctgtccacttttgatgatacatgaagtgctggcctccagcaatgaatcagaagaagtacttttggccaagtctgcaatttattacctgaacttcaaagatggtaataataaaagattaattaaacgttatcattgaatttatagctcttcttttacattaacacaagcctgaattttctattcggtctatcttcagaaaaatacagatcagcaaacagcaggttagcaatagcaaaatatcagtcagactttattggattaacttaaatgggaaaagaagaaaaatttaaatcagcaggaccaaaatactgtattatccattgcctattaccaacttctactgttgtctccggattaatagaaaacataattttcaaagatatcctattatgttccaagtgctttagaatctataatgttttcttgtctattttgtgttgaagatttaaatttttgtgggtttaaatgtgctgaatattattttaaactgcactctcaacttatattttctaaatacctgcactatttatctggggctcaatgtcaaggtgtacagggtgaaatattgtagaaactgttactttgctttaagctaagacacactttttaagagcctctattactttttccttcaacttgaatgaagtaaatgacaatgttatcatggtttaaagaaactccctcctcaggtataatattaattgaaaaattactaaagagcataaatcatattttgaattgccattgcttctcaattgatttctaatcacatagggtaaatttactcccccattttgaacctcaaatactcttttgaaagacaaaatgatccatacgtcaattatcagcctcttctcaactcttgggtgtctacttaagatggatgaatgcgcttaattacaaagcacacttataatttgcaattatgcattatttggttagtatcattttatcagcctcactaatatcagtaaaaatttcctcacacatgaacatttataagtagtgggatggaatgtataagggagttccttttctgcctataaccatttgtcatcacaaagtattgaaggcatcttaaattaacacagtataataaagggttaaagtaatcatgtgtctgaatgttctccacaaacttttatgtaaaaactccctttaccaatgtcaagcattgtttacaagacaaaaataagtttaaatcaccgtttggatttcattgccactggcagacaaggtttctgttcaacgacacacatctacaatgttgtgtagattttataggaaaaatacctggacactcacaaaccttgagcaaaattccattgggaatttttggtgtatttatgacataataaaactattatgttttcagctttcatttagtaaacttttatatttaattcacaagtcacgtacccttttatttaaaaagaggcccagacacacttaagcttttatagctgcttatttttccatgagtaaatgatgtgtttatatgtatattcacatactgttggcttatattttcaaatatttcatgtagatctcaatttttttaaggtgatgggtatttgaggtttttacggaactatttattagcagaaattaaagactactgaaaaaatattttaaacttttgaatttagttaatgctagacagccaaaaataacaaaatagcatttgcaggttagacataaatatatttaaattataattaccctatttaaactcactgcactatgcatttaggagatagtataagcaaagattatgtatatacttagaaataagttatcttttcataaatgaaataggtcctttacagcaagacaaccatatttgttactttaattctagtgacgtggtagaatgttaaaatgctgtcaggaataatgctacaatgtttacaggatttggtctgtgaatttcagtgtgtggtgtctacctgcgagtcaaaggaaaccacacactctgagtgatctcaggggcaaaccacagctatgttgaaagaaactatactgaattgcataaatgttgatttattaaactagtcaagtcattacacgaaaagtataagcaacaatatgtgaatctcttccttttaattactagtggatttcaaattcccatagatgatttacactaaaaaggaaggtgtcaagcatgtacctatagaaataataaatggagcccccgatctccataacaatgactcatcagagtaggtggaggacatctttcatgcccaggtctatttgaggccgtctttcttctcgactcagcacactgtgactaaggtaaaataatgcagggaatggtcataaggagccaatgaatttctctctttcacaaagctagcttaaagcctgccttatgatcacaaaacttttattaaataaaaaatattcttcataagttcatcccttaatatgcatatcatagataatattttgaagagcacatttatataggtcaggaatgtatgtcatatacccaatacatcatagccaagtcaatctccatttaaacaccctcaaatgggcaatttaaattcttttatttattgttcaagatttctgcttaactaaatattgcttgaaataagtgagatgatgagtggattgggaaatatattttgcaatatagagattttcttgctgttttgttattaaaggatttgatcggtgtatttatctttttctgtattagcaagtagactttcttagtgtgaaatttctcatgacaatttcctaaacatctctgtaaagtgaataccatatagtaacatttcagttatatattgcatcatacaaaatagtatattaaattttaagatatctagagtaattccttcacagatatgtgattccttcacatccttgaccatccatgtcatatttttcataactttagccaataaatccccatcccggtgtgtgctatgaattatacatagtcaaattgtattatatgctttgattgattgtttagattcttatcatctcttttgaataagtttatgagttgtcaaagggaaacaaaatgcttaaactcataatgttatgagttttatgtgaacaatgagtgcagacataccaaacaacacagggaaaaagtcaaagtaacaatgcatgactggaaatgcactccacaaaaatgtctgggtcagagaaaacatgttaatgccgccatgtaaatatcctatttcttttccaaagccttctatctacaacaagctttcttagacagtaaggccattttgatcaaatataaatagtcattctacagagatgggacttgacaattttggtgaacttctagaaagttaacaatgtcagaaaagctttttgcaaagttctggtacaaaaaaatgacctacatctgaaagtagcaaaagtttattaatatctaatgtggcttccggattctgtgatttgttgaaaacatttctatttttctttgctgatagttgagatttgcccagagagtaatggctggtttttataatatttttaacttctgctactattttgatctatttttcaagtttttcttaaacaggaaatctgagataatttttcaggtttacagacagatttgatagacttcttagcaataaagttaagagtatttaattaattcttttatcagcagacagcaacagataaggggtttgtttctttttaaaaacgtctcttcctgttccattttataaattcatttttaaataagcatgattctttttcttagacttcacttaccttttttaactgtgcttccaatttgctacattcctctttcttttgttcaatggctatttctagagattttaatttggaatcccttttcagccccgcagaggctaatgaagatgcatgttctttgaggtcaattaaactagactgaaagagaaagaatgtgagtgagtaaaacactgaaatttctactagcaatgccttcaatttgaacacattgattctatacatagcaataaagtgtgcagtagacagaaagggtaaatataatcttactaaggtaacaatagtcagctctggtcaggaaattaaagttggccagcttacagaacgagtaggatctaattgccgtagaatcaaatgtgaccaaatggtgtggtcagtaaatgcatgtttcacgtctcaaagtcatgctaatgatgtaagtcccaaggtggtctttacatgtcatagcaaaacagacaccctgaaccttccgtttacatttattgctgtcagactatgcagacattgagacaaatacgaaagaaaatactgactttaatgcatccgctcccaagagcaagtcaaatataaaagaagcctcctactacatttttatcaaatcccatttctttaacagataaatgatcaatggttttacaaacatcttctggaaaattaacataaaattattttaaaatttagagtaaattttatgtttgcgtcctttgcaatctagatttgacagatatgatgaatctttccaactcagacatagggttacctaaattgttccagtcactaatcatgtccagaaaccaacaggctccacatatagtttgaattccaaaaactacagaaataaataacttgcatatatcactgaacataactttgcaacctaaaagagcaatgtttgtcatcaaatatgaaatagcaacatctaactatgtgactcagatgtacaggttttaccccaaaacagactccatgtatttccttcttgatcatttgcatcacctaggaagatactaaagacacaatggtctctctgtaaacaacgttggctaataatttacactgggttgcttcatggacactggaataaccttgatgataaaaatcaccatcatccagcaaggtgcttctaaagccctctggggaacaggtgagccattctcattcttcacatcaggaaactgaggctcacaagagctgagcatcttgtcaaagatcacttagctagtaaaggcagatacaggtctcaaacccaggtctacaattccaatttcaatgacttttgtcatatcattcccacagaaataacaaaggatattataatccagtcactttgtcatggtgaagacatatcttcactccaattaaattataagctccctgctgacggcaactgcatattgttttcctttataaattttaaattgccagatgcaatagccagttttagtcaacttggctaggctctagtcctcagttattaatctaggagttgctaatagaaggcattttgtagacatgactaaaatctaccatcagttgactttaagtaaaggagattattctcagtattctgcatgggcctgatcccatcaagtgaaaggcctatgagcagaattcaggtttccctgaggaagaacaaattccacctattgattgcaacatcagcttctgtctaagaccttccagtcggcttttgctgatggcctgttctgcgaattttgaaaatgcctagcctctgtaactgtgtaagccaattccttatgataaagttcttaatctgtagaaaatgtttaacgtggttctgtttttcttgcagaaccctgactgacacacccagcccagtgccaagcacatcatgcagaaacaacaagtgtttaccaaaatgtctatctgaaagtcatacaatgttggcattatttacaaaactattttcacttacagcttatgctccaccacttcatcaagatctcttttcattagaagtatatacattgattttaaggtgcaaaccgacaaataacacttgcaaccggtgaagaatgctataaacaaagtcaaagcttccatatcttctgtcgcatacaaacaacagtcatcacagatcctccaactcagaatcagcagtggaagctaggaagagaactccattctttatattcataacaaagaaataagctcctttctaaaaagcaagtaggtttaaattttaggaaatacggattttctttctgattttcctcgaaactcctcttactcatccattcttttccttcttcatctagattcctaatttattcaggactttagtttgtgtggaattatcagtaccacacgagtgaggaaatactgcggagctaggagatagataactgtgctgtggtaccgtccagcagggtgaaaggtctataacagctctaaagaagatggacagttacagcagacaaaagtaagtgtgaaggggccaattgcaggcaatctccacgcatctcagagctgtgaggattaaataaaataatgtgtaattactgctgctcatacttctccaccgaactatccccaagaaaactgagagggttacagggatcccttgaagaatgggggaatagcccaaagcatcctcttcataacccccaagcaagaatttcttcaaagtataagattttactttaaaaacacaggtggcatttatattctgtattcatgtttgctatggtataaaaatacagctctaaattatttactataatgtaaaaataatatgccagaagagcagccacacttaagctctaccttggggtccagcatggtaccacatctcctaatctgagagtattgggtggtccctttgaaaagtacagatgaatgcaaagcacttgacacaaggaatagtacatagcagacacccaataaagtagagctattgttactatcatcatcgctgctgttgttatctcaagcaagggatcatgggcctgtgaaaaatacagaatcctttaagctgtgcaaatgtggtaagacataaagaaaagtttcaaggagctacattgtatatggttagcagagcagagaagataggcatagggcatcacagatgaaggaagttacaaaaaaaaaaattcctttaaattcaggcagctttacaaaagaaaggttactacattccccaagccttcatacagtgcctcctactaagtctctagtctcttgcagcttcattgaatatgggtttatgaggactatcaatgtggttcatttgtttttccagactcacctctttctcagtcagttcagcctgtaaagcattgaccttctctttcaggtctttgttctcttttcggaaggattctatctcttctagtctttcccgatcatctctttctcgctgttctttcaagcgctcaattattctctcctgtaaggcaattaacaaaaaagaagaggtgagaacccatcagtgtatatgccaaagcatactgtaaaagaaaataagaggcagtacatctaagaaatgctgtacaggaatcaacacacacaagaaaatcaaaattggattcgtggggaggctgtgcataacagcacttgggaaggacaaccaataacagcttttgacttgttaataaaagttaatatcacagggttgcaaaggaacgtaatgttcaagttctgtggttgctcttggttcatggtagtatccagcaaatttctagagcagctctagaagagggagcttcagacaccaagactccagacctaccacagccttgcacaggaaaggggaagaagtagaacatgcctcttggctccgccctctttgcttagcctctccatttgtcatcaaagagccttcattggtttctgaagactgttctctggctagatgggaatgaagtggggcaggacccaaaccctccaggacttagagctgggactcattgtgagaacttgagacaaagaatcagtccattgtgtatgtgattttccagtgtgtctgaggatgtttacttctgtgttttttcagtggtttcttgatagtcagcagagaatccaaaacactggctgagtttgaacgaagttcagcagcagctttattttattgagggcttactacatgctaggcactgtgatgtgctctcctcatcagccctcatcacaagcgcaagggcagatccagtgctcttggtgacggtgtagaggtgaggaaacccagagctccgagatgcaaggtggcccaggtcataaacagaacgcctcccacatcccaggctctctgactgtcagccacacccatgagaccacactgccacaaacatacacctggagccattcaaggaggtctgcctttgactttcacactgaaatgaaaacactgctttgtagacttgttttccaaaaatagggaatctgcctgatatcaaagtaagaaacttaaacacacacacacacacacacacacacacacatgcacacgaaaattccatctgcgtaaagcttgagttagatttctgaaattagtttgaaattatccaacacatatctaaacttcctctcggatggccatgttaaaaaatactggtgcaacaactgtggccaaggatcctgatactatcttttatattcttataattgcatagtgcaagacaatgcctgataaataagacaactgtaaaatagtatttaatgcagagggaagttagtttgaacagttagcctgtgatttaagatcccccgaggaagcaactgttctaccccactgacaataatttatatatctaatgctttcagcggaggaggtaccattactattttccaattatttaaaaacactttaaatgaaatatattattataagagaggaggcagaaatataacaaatgaaactattaattgcctatatttgtttcttcttgatcccagacctagtttacctacctgtgacaatggtgagtggatgactatgtgatccacaagagaaggaaatggccacagtacatggtcaatctctcaagggtttttaatgatttcagcaaccaagaccttgctgccttttgcccacactacaaccaattacccagccacctctccgtcccatcccttccactacatggctgttggagcgacatttctaaagctccaaaaggacctgtcgtctcactatttggaaaccttcccaggaatccctctggctggatcacgtggcacttattcccactcggcagccttcacgtggtttcactgcatgatcatcctcccagccccactttcaagagggcagcactaaaatcctatgagtcttcttgacccacagctgggcaaatcatctggcatacaacaagcaattaaaagagctgaaggaaggaaggagaactcaattagggatcatcttggcttcaaagaaaaggtaataaaattaagcagacatgttaacagccagaaggtgtcagaatcgtttggaaagtaggtcgatttgctctaagcactcgtactattgactgggcattgatgacaaaaaaaatcaacaagcactataatgtttttaagtgttattgatgattcaatactacaacatatttctccgtcaatcacaaaaccaatttaactgtcagccgcgcagggccagatgtcaaaaacatgtgttaaaaggccctaatataccatgatgtacttgattaaaaactaacttgcagaaattccaacaatgtgttcttgttttagtcttatttgcattggcaagcattccttgtgcactcatctggctctgcacaggtctaatctatttgtgctttatcacagggtgggaactaaattacagtggcctccagctccactatctggctttctcaactgcttatctgctatgtggctacagcaaggctttgcgagaccagctttataaatacagtgggttccatctcttgagcttctgtgtgtcaatcctagaaccaagtcatattcaatcttaactcacggagaggcattattctttgcactctgttaatagttgaataagttcctggaaagtaaaaggaataacatactccctaggatgccataatccaggggaaatggtgaatactgcctgatggattcttttcatcagccaagagacagcaaataattaaatgtacttaaaaattcatgagtttttattaatcattttgtttcacagcatgccttgttacagggggatttgtgcaattaaatgtggataaaaatgggacttgtgagcaaaactccatttaaagaagattgtgatgttgccaaaagcacaaagatctttgagttttagtcttattctatcacctgtgagctactggccttgggatagtccagaggaggcagcaaagtctcaacgaaggaccagcttagacagggtggaaacagcttccaggagcggtgggttgagaagttagcatgtgccatgattaattaatgatgtctctctaggcccagaaatgggggatgatgctgtacatgtcgatatttttatttctgggcaaatcatttcacctcattgagcccatttcccatcttaaaatggaagagcatagatttagtgtttctcaaagtgtagccttctgaccacttggatcagaacccttcggtatatttaaaaatcagaggttcctgggctccacagcagagcagctgaatcagaatctctaggaaataggacccaggaaactgtattttaagaaacctcctagatgataagattatttggatatatacaaaggtttgatgcatactggaatacttagaataaatcttctattatttgtcctaagatagagaaccttgccagttcctatccaacggttttatctgtgctttccaaatacattaggcattctgattttggcacctttaaaaaattccctccacatccattgctctatatctgcttttattcttcatcgctatgaaaagttaaaaaaaaacagatgcaaacagagtttggaaataaatagctcacaaagctggtacatagagctcttttgtttgacttgagcatcataatttttaaaaatctgaacttgaatgttttgaaatagaccagggatctgcagcttaccatagctaccagtagtccctactacacttcagcaaagccacatccctcatttttgttccctccctggcccttctagtcgtctaagttctcaactcctcatctgttgtccaattcagatgccatgagcctgagattgcagatcagcaaactgaataattcattgtcaagggagttccaggacagcatgaaacttagaggtcagctaataaaaatgtgtattttgaagatgaggtactgagacgctgagagaagaggcttgcccaggtgatgcaactgtcaagcagtaaagacagtccaaggggccagactcccacagacctcagattccttcccagacaccccctcagcctcaaaggaagtacttaaataaagggagtagtttcagatttgggaattactttgggatttaagctagaataaatcaaatcttaatagggtccagaaaaaaaaataaaatcctgccaagaattcatgacatgaaaaattatatggtatatgtttacttctgtgaattttaagaaagaaatcaagaggtagaaatagggtgatatcatacaacccaaatatgctaaatgaacacataagcagtaatagtttttgaacaaacatcccctcattccaatgttacaaataaaactactgcagagagctctggaaataaattattaaaagatgaaaagagaatatctctccccaaaaagtcatcttattaaatattcttataagctttcaagtaaaaccttatcattcttataatttaatcctgaagttataatctttcaatgtttaaattgttacaggatttataactttattaaccagcaactgtttctcctccatggtttttttagcaaaattaatttggaaatacatactaaatatgatgtcaaataaggtaactcaatgtcaaaatgtacattctttatcttacaaaagcctcattttaattgtttgctatattttattttatttacattctgggatacatgtgcacgatgtgtaggtttgttacataggtaaacgtgtgtaatggtggtttgctgcacctatcaacccatcacctaggtattaagctcagcatgcattagctatttttcctaatgctctccctcccccgaccccttccaacaggccccagtgtgtgttgttcccttccctgtgtccatgtgttcacattgctcagctcccacttataagtgagaataggcagtgtttcgttttctgttcctgcattagtttgctgaggttaatggcttccagttccatccatgtccctgcaaataacatgatctcattccttttcatggctgcatagtattccatggtatatatgtaccacattttctttattcagtctatcattgatggacatttgggttggttccatgtctttgctattgtggatagtactgcaatgaacatatgcatgcacctttataatagaatgatttatattcctttgggtatatacccagtaatgggattgctgggtcaaatggtatttgttgttctaggtctttgaggaattgccacactgtcttccacaatggttgaactaatttagattcccaccaacaatgtaaaagcattcctttttctgcccagcctcaccagcatctgttgtttcttgacattttaatacctgccattctgactggcatgagatggtatctcactgtggttttgatttgcatttctctaatgatcagtgatgttgagctctttttcatgtgtgttggctgcataaatgtcttcttttgagaagtgtctgttcatgtcttttgaccacttgttagtggggttgtttgtttgtttcttgtaaacttgtttaagttccttgcatattctggatattagacctttgtcagatggatagattgcaaaaattttctcccattctgtaggttgtctgtttgctctgatgatagtttcttttgctgtgcaaaagctctttagtctaattagatcctatctgtcaatttttgcttttgttgcaattgctttagacattttcatcatgaaatctttgcctgtgcctgtgtcctgaagggtattgcctagattttcttctagagtttttacagttctgggttttacgtttaaatctcacaatttttaataggaccatgaagactagccctagagtcatgggtctttttgtagcttcctttttttttctttttttttttttaataactttttaatttaactccaaaaatatgcttacccatctttttagagctcctaggtttttatcatagagccttggttctcagactagagtttacatcacgatgacttggggaacttgctaaagtgcagattcccaggccctatgaggttctgatttggtaggtatagatggggcctaacaatagagactttcaacaggagcttcctggtaattctgaagtaacagaagagaagcctcctttaggatacactggcctaggaaacccatgggcatttaatctaattcccccattcatcaaatgggaaatttgaggccctgagagaggcaattacttgccaggctcacccagttaattaatggctccccagttaattagtggcttaggtgggactggcccctaggtctccttccaattacttcattaccccagagtttataggctactgtaacagggaatataggagataatgctattactctagtagggcatcccagaggaaaaccctcacaacatcccatgcatgtgtggacaaatcctgcaaagtgctgcaggatcaaaaatgatgggaaagatgaagaaaaagaacataataaaatctactcccacacttcaaaagttaacatttcttttcttggtttcaagctaaatttgaaaataatgccaataacatgggcctaaaaactgcgccagcacttccatgtccaaccaacaaacaagccgtccctcctgagaattcctagagaactttacctgcactggctctttgacattcaggaagtgttggaggagaggagagagcatatgcaaactcaactccagggtctgatacctacaataggtgcccagagaatgaatgaactcatttagccagaatgaaatggactggaaatcattttaaaagtaagtaaacatcagaatgagctgtttgcctaaaggattttattcattcattcattcttttattcaaattaatccccttaaatgtaagtcagaaggaaaccctcaggatggcatcccatccccttcaaagtaaaagccaatttttaaaaatcttgtctcacaagggcctgtgaaatctgctgcccttcctctcacccacacccttgtacttgctctcccctctgccagggctttctccctccacaagggctcctggctcaccactcactttcttcaagtgtttccttaagtgtcaccttctcagcaagctcctacctggccattctactccagcactccctgtacccctccctgccttctcttcttttgtagaaaatattaccctctgaaatcctaggaatgtcacgtatttattgtctgtctccccatcacctccactagagtctaaactccattagagccaggattttcacccattttcttctctgctgcatcccaaggctcaaaagaggacctgtcacatggtgggggctcactccaccagtatccagtactgagtgagcatccccaatgcaggttatgctgggcacagggaatggaaagataacacacacatagcatatgtttcttgggtttggagtctagcagagaagagaaattaaaaacagataaatgaacaattaagaatgtgacatgagctctggggagtttgtggtgttcctgagacataacggggatacctaggaggtgtccccaaggaaatgataaaataataataatagtgataacattacatctactattctaaacacattccatattttcatgcattttctcctcaatataatccactgaggtggctactattattaccctcttttacaaatgaagaaactgagaggttaagtaatttgtccaaagtagaaagtatcagacctaggatttgatcccaggcagtctagctccaaagtccacattcttgactactgcacaatacaacttctcatgaagctgacctctcagaagaggaggaattaaattagcagagagtgaggaatatcctcagctggggaatagcatctgaggcaggaaggagtatggtacagttgaaaatctagaagccccacataactagggaacagagaacctggaaaaagagaaatgggggatgaggctggaaatgaaagaaagaatgagggagggagcaggcacacagagtgggggcttgccagatcagatgggagaagggaccctgggggccaggtagaggatttcaaattatatcatcgtaagagcaatggcaagctagtgaaggtttttaaggaaagccaagagtgatgtaatcagatttgcatttcagaaaatgcccctgactgtagtatgccaagtccactgaagagggcttgtgtgggaagaacaaggaccagctgggactaaaggtagtgttagcaaaagaagaaaagcaggcacatttaaatgcattgggatcaactttccccaactctgtttccccatatcctgattccccagtttttgagtgcatgctcaccttctctgacagagcttcctctagcgtcgccagtgcagtatctgtattactggaatccgtctgcaaggacttcactctgtctttcaggttggtcagttgcttgtctttatccctaagttgttcttgcaagttttcaatctaaaaataaaaatcaatattttaatgcatatttgattacatatcctaggccaaaattcctgaagtggatctattaataaaaaaagaaagaaaaagacctgaaatgatagaaattgtcagtagctttgacttagacaaaaggccattttgatgaaatcttcatttctccatttagttcaagtctgtctttaaatggtgatacagaggagcagagtatctccctccatacaacggtaagcccttctgacacgtacgtaatcactattatttctttgtatttctatcccttttaccagccttttaggtctcaagtcgataggcttgaacttggtacactgaaccagggaaatattatgcaagattaattcattgattaaacagacatttactggagagcccattctgcaccaagtaccatatcagtatatggcagatcccatgtagccattcacttactcctttatttcagtattaaagtttgtgatatgccaaatgttgtcaagtggctgtttcaaagtaaccacatgaaaagccaagtaggttatcaccagcagactgttaatgggaagaacttgtgatataagtcaaatgtaacaagtactaaacactccatttggcaactaagtcatgtgctggcaaccaaccagccacttttatccactatctgcagcctgaaataaacacgccaaatagccgattacaatgcctgtccaggagcagcagcaaggactttctcctgggcattgaggacattatcattcatgtttttattctctgctttcaaaccatgtatttcttatctaaggatttaaaaaagccccactatacaaacaatttattcgtattaagggttttaaaatgacaaggaaaaaaagcagtacaactctaagataagtccattcaaaatatttgcattctgcacccagctttctcagggaatcattccaaaagtatgtttcacaatgtacactcaaacaaattttttgattacttgattcccttagcatgtatctggaatggtaatccaaataataataatagtaatcccagtagtaatgaggaggaggagatgattacaatgacaatggaggtggcagcagtagcagcgtcaaaaacagctctggatgcaaagacaatggctctgctgaccttcaatctggaggacatggtcttggctaattttttcaatggccacaatggaaacccgtaaactttgtggcctaacaaagatgaaattttttttctttccttcctttcttccagcctccttccatccttcgttccacctttccttcattcatttttttttcttctgccttgagatagacagcttagaaactcaggttataggtcaaataattattcttttccttcatcaaaatgtaatgtgttcccatccagctgccactgtgaaaattaattgccactccttggaaaacacagcaattcagaaggcataatcatctccagtcaaaacaaaggcttcctcccttccagacaaatgttcacacaaaaatacacataagtaagaatatggatggttatatgtcagaatgatactggttatatggaagaagccagcagctgagaggactgactcttggaaacagtgtatgttattactttgaatacacccatggatacatttgtgtacacacatgtacgcaaatccaccgtggttctgaatacactgattagacccactggcccaccctggcagacagtgccctgggcataagaggaggacatcagccttggggcagtagtaggcagcaatttcaaaggactttgggcacgagaaatagagaccaaaggaaaagtggctgtgcacttatgtcataatccctggggcctcctcatataactggaaagactagggagactgagggtcagggtcctactggcatgcaggtaggggtcaagagctgaagaaatagggatggtggagactggagacatgcgatctgtttatctcacatctaagaacccagcagaagagccaatgatactgcaggtgtgactgactaacagagctggaattaaagatgtatttattgagctagggatgcaccactttaagaaatgctgcaaaaagatcaccaagaatgactcttaagagaaaaaaataaggtacagaacagtgtgtagcatataatctcttgcataaaatttgaaacatctataaacagataaatatatctggaaacaaatcacaagaaattttaacttttgtagggtaaggtctaggaggcagaaggaagaaggagtttctggttttcatctttgtacatttgtgtagatttctgcttgaattttctaaccatgtgggttttattattttaaaatgtcaatcagggttatccagctggtaaaattatgggccatttttggtttatatttatacataaaaataataaatactatacacatgagtaaataataatttaataaataaaacaaatgcctacttaatactaaattgtccaagttgccagcagttacagattgttggcatatttatttatttttttaatgggagctaaattttttaattttaggtttgggggtacatgtgaaggtttgttacataaataaacacgtgtcaagggggtttgttgtacataacattacattgcccaggcattaagcccagtacccagtagtcatcttttctgctcctctccctcctcccaccttccccactcaagtggaccccagcgtctgttgttccttctttgtgttcataagttcttatcatttagctcccacttatgagtaagaacatgtggtatttggttttccgtttctgcgttagtttgataaggataatagcctccagctccatccatgttcccgcacaagacattatctcattcttttttatggctacataatattccatggtgtatatgtaccacattttctttatccagtctgtcattaatgggcatttaggttgattccatggttttgctattgtgaacagtgctgcaacgaacattcacatacatgtgtctttatggtagaatgctttatattccactgggtatatacccagtaatgggatattggcatatttaaaccatggcctattatgcaagtatttaaaatcctgtttgcatagcattgctaactaaatgaaaatagtagatctttaaaaagcagaatgtaaaatagtatggcattaattttgtaaaaagaaaaaattattgcatagaacaaaaatataaggaatctactaaaatgttttatttggcaatgggacgactgatgattttacttctcctcttcatgcttttctgcatctgccagtgtgttttcattgagtgtaaacagaataaaaagatattttaaaaccaactacaaaatatcagaatggttatttaagtgacttttgaacaataagtttttgctttttaaaaggactctgcaggagaaaataatcctttcatactccaaagatgactgaattcttaaaatttaaacttaaaagactggagagaatataaaattctgtatcttttaaaaaaaagtactgcacagttttctcatgttcacaaattgttatgacatttatatgaaaaatgttgggaacctttttcttcaaagggtgaggttgtgcaaggctcaaatagcaggaattggaaaataagcaaattgaaaacaagggttaggatgggaagccttgggggtggaaagggaagggtttttttgagaaatttcatattgcagaattggacaccaccttagcaacacagacaacaaagtatgagataggcctgagtacaagggagctagagagaaaccctgcccttgcctttgacttgagctgccttctggtcatggctgggaagattcagaaggagccagtactgctgaagcaatagctatgccttctggggcagaaacctggaaagggggtaagagaggaggagagctcagaccctggaggtcacttgacaaccctaatcctaatggctttagctgacttctgaagctctgcccaagaattaatggggtccttaactctgggcttgcaaagcctgagatgggccaatgttcagcaggggagctttgttgtgaatttcacacaagtgtagtcctcagcacaaaagggaccattgactaacagccacagcctccttgactccacatttgctcctccttccatttggtctccatgctgcagtcaaaggtaaccttcccaaaatgcaactctaactgcatgacttccttccttagaacccttcaatggctcccattgccccccacataaagcccaaactccctgatatcatacatgaggccctccgagggatggtccgtgtgatcttctacaatccctcagccaagccctggccctgccgaatcactagtgctattccctagcacgaggatctccttatatcttccctatctttgcctatctatttccttttcttggagccctctttgcactccaactgttcacctattcaagctctactcaaacctttagatatcagcacactccttgcctccttcaggactccttctccaaccccctaaaccaggttaagtcccctaatctgcatttttcatacactattaaaattgcttccttacttatctatttccacaacttggccatgagcacaatgaagacaagagctctgttctactcactgttgtatctccagctgcagcacccaattgttggcaacaccccacatattagcttactgaatgaatgaaaaaaggaatgaaggaaggaaggaaggaaggaaggaaggaaggaaggaattctaaagaaagtggcttgtgtaaaaggaagaggccagagtaggtgacggctgagtcccttcagctccgagattctacaaagaagtaaagaagtaataaaaagtgatggagaaagtctatacatagcttaaaacagaggacctaaaacatacttaggcatcgttacagtttcaaatatacccaaatgtatctttctggtagttttcattataaaattccaaaattcattcactaataaaatttatcttctctctaagatttgtctctggattttgtattacccacacctagagtatcagttaatgttattagctaaagcaacagaaacagctcagtctgatttaagcagaaaaatggggaaactcacaaaactgccagaaaggctagaaaatcagggtcagggaaaatagtatagaattatgcccagagttttgatgcaagtggtctagtgcaaacactgttgccccaactgctgaaaactagacatcgaggcttacagtacagtgagctctgtcccactcgttctctttggccgcagcacccaactgtgttggcaatactacatattaacttactgaataaacgaaagaagtgagaaaggaaggaaccctaacaagagtggcttcaactgacccccggacaacaccactagccctgcagtcatgttgccccatgatcttgactttgcagtccctgcagcagagagagggtccttcaaaatcccaacattccaatgacactggggcaggtacatctaatgaggaaagccaaggtaaggcatacagcccaactgcaagggaggcttagaaaccaagtgttagcagtttcatcttccatagtgagatgttcttcataaaatcagaacaaagcttggagtctggatggccaaaaattatgacccatatccacagcacctagggagagctccagtgttagctcttgagccagcaaactccaccatcctaaaacaattgctctggactttctttctctcaagttcctacaggctgacaaggttaaggtttgactcagacacttctccaaatatggtcccggcaactctttgttaccagtctttgacaagataactacagaaatcataagtgtgtatacagcatcctaatatgcaagaacatgatccatggacctgtcatcatgagcaatgtatggacaagttcaggtgttgttgaacctgtgtcgcacgtggctggaactgcacactgatcaagtgcacagtaagaccacatattgttccatgacagattgaaaattatttaaaaaagaaaaagcttgcttggggagcatgaatgcacaggtctgccaatctctccgtgtccctcagaggtaccttttgcagaatgccaaggatgctccttgagtggaaaaggcaaggctggttgctagtacagggcctaccaaaccatggatttaaacacaaagatttaagtcaacccattgtattaattttctacagttgcataacaaattgccacaaatttagcagcttaacagcatcagatcagaagtctgggcatggcctgattggtttttctgctgagggtctcacaaagctaatataaagggatcagtttggctaagttcccatcttgaatctggggtcctctttcaagctcattcaggttgttggtattattcagctccttgctggctgctggccaaggttgctgtcagcttccagaggctatatacaaaggcccttgccacacagtacttccctccctctttaaaaccagcaaccaagcatttctcacatagaaaatcaccctcctgcttggaatatctctgacttccctgtctctgacctctagccccagatttactgcgctcatgtgattaggtagggccaacacagataatctcccttttgatcaacttaaggtcaatagactagtgaccttaattacatctgaaaattcccttttgcataaaatgtaacctaagcatagacataacaccaacaggcacataatatgggaaccattctagaattctgcttattatacccatattttttctttgaaataaaaacatgttggtcctttagatctcttatacagagaattctgtgagtggaattcattcaaaatggaggaattctccactctaacaggatgtgtaacattttaatatggccaaaaaatggaataaaaatttgaaaacaaattttcagcttataaaaaagtaagtattgtatgcagcaaacccccttcctccgtttctttctttttttttttttttttttttttttcgagatggagtctcactctgttgcccaggctggagtgcaatggcatgatctcggcctcccgggttcaagccattctcctgcctcagcctcccaagtagctgggactacaggtgtgcactaccacgcccagctaatttttgtatttttagtagagatggggtttcaccatgttggccaggctggtctcaaactcctgactccaagtgatctgcctgcctcggcctcccaaagtgctgggattagaggcatgggctgccgcaaccagccaccttcctccatttcttgaaccgatctccattcttaagcaacataggttcccagcattagggtctattcaggaaagctgctttaatgagatgactatttagaaggcaacatatagctgtctccagtcaaaaagcagcctcacaactttcagctaatataacagtgtcatgatgaggaggaggaggaggatgagaatgatgaagatgatggccattatctattaagtgattcctacaagccaggcactgtactaaaagctttctttttgacattttattttgagataattgaaatttacatacagttataagaaataatacaaagagagtcctttattctttacctagtttctgctaatggtaacatctagaataattatagtaaaatactataaccagggaattgacattgatacaacccaacggccttattcatatatcatgagtttttatatgcactcatgtgcatttgtgtatttgtgtgcatctgtatttagttctatgcaattgtaccacatgtgtagatttacgtgaccaccaccaaagtcaagatacagaacaagtcccacaccacaaaaatctcttgcaatgcccttttatagctgcacacaaatccctcctgcctctgtcccatccttaacccatggcaaccattaatctcttctacatttctataatttggtcatttcacaaatgttatataaataaagtcacacagtatgtaacctgtgggattggcttttttcactctgcataattctctgaagatccatcaaagttgttatagttatcaacaacttcttcctttttattgctaagtaggtattccatggcatggatatccaggcttgcttaagcatttacctgctgaaggacatttcagttgtttttagtttgggctgttacaaataaacgactatgaacattcaactacgggttttattttttcggtgacgtaagttttcacttttctgggacaaatgctaccagagtgcaactgctgggttgaatggaagttgtaatttctattatataagatactactgcactgtttcccagagtggctttaccattttaattctcatcaacagtgtgtgaatgatctggcctctgtacatccccacaaacttttggtgttatcagtattttttattttggtaattcttataggtgtgtagtgatatatcaatgtagttttattttgcatttccctaatggctaatgatttttaacatcttttcatgtgcttatttactgtctgtaagtctccttcggtaaaatgtctcttcaagtcttttgcccattttctaagttttttgttttactattcaccgttgtgactcctttatattttctaggtattagtcctttgtcagatacatggtttgcaattatttcctccaagtctatggcttgtcttttcattttcttaacaggtctttcacagaacaaaaggtccaatttatcagtctttcctttcatggatcatacttttgatgtcactttcagggtttgttgcctagtcctaaatcatgaagattttctcctatagtttttctaacaaatttatactttcatgttttacatttaagtacatgatctactttttgttattttttgcataaggtgtgaagtttaggtcaatgttcattgtgttgcctgtagatatctaattatctaattgatccagcatcatttgtttaaaaggctatccttcctccactggaatgcttttgcacttttgtaaaaaatcacttaggcttatttgtgtggctgtatttctgggtcctagtctgtcccattaatctatatctctatccttcaataatatcacactgtcttgattacagtaactatatagtaaggcttaatattagtagagtgaatcttttaaccttattcttttttccccaagattgttttagttattcggggggttatgccttttcataagaaatttataaaaagtttgtctatgtcatcaaaaccctttggtgggattgtgataggaatctcattaaatctatatagcactatttgagcagaattgacacctttactatgttgagtcttccaattcattaatacaatacttatctaagtttgtttaggtcttctttagttgtgctcattaacattttataagtttcagcatacagatcctgcaggttttcctaagtttacatctacatattttattttctttggataactgtaaaccgtcttatatttttaattttatcaatagcttccacatattctgttgttagtatatagatatgtagttaaattttgtatgttgatcatgcatcctgagaccttactgaagtcacttactagttctgggagtgaggtgggttgttttgtttcattttttgtccctttttaaagattccttgggattttctatgtggacaacaatgtcatcttcaaaaaaggatgacacttttttctttccttattgcagtggctagggctttggagtactatgctgtataccaatagtgagaataggcatctttgtttttatcctgaatttacagggaatatactcagtcttaatggtgaaaaacagatgttcgctataggttttttgtaaatgtgctttatcaagctgagatagctctcctctgctcctaacttactaagagtttttattatgaatgggtattgaattgtgtaaagtgctttctctgtgttaattaacacatttttttcatctgtatcctgtttatactgtggattataataattagttttggtgtgctaaatcagccttgcacaccgggaataaatttcacttggtcatgccatattattctttttaaacattttttaatttgatttatgtaatattttgttggagagttttatatctaaattcatgagagacagtcatctatagggttgttctgcgggtttttggctttattctttttgttttttaatttgatactgtctttttcaggtttgggaatcaaagagttactgccatcataaattagtaggaaagtgttccctctcatctcctatctgggagaaattgagtaaaattaggattaattctttaacattttggtaaaattctccagtgaagccatcagggcttggaaatttctttttcaggagccttttaactacaccttcaatgtatttcatggttttaagactattcagtcatctatttcatgttggttacttttggatactttgtggttttttagaaattggtccatttctactaaactgtcatatttatgagcataaagttgtctacagtattcttctattaggttgctaatagctacaggaactgtaatgatagcttctgtttcatttctgacattggcaatatacatcttctttatttttctcagggtttctggagatttatcaattttatttatgttttcaaagaaggagcttttaatgttattgattttctctgttgtttctatattttcgattttattaaattttgctccatttttattatttccttccctctacttagtttcggtttattttgttcttctgggttattgaggtaggaacttggagtattcattcaagatctttcttcttttttcatataagcatccaatgcttacattttcttctcagcactgctctagctgcatcccacacattttgatattttgtgtttttcttttcattcagtttcatgtatgtttttcctttgaaacttcatctttcgactatgggttacttagcagtgtgatatataattttcaagtgtttatagatccccttgtctgtctgttatcaatttccagttttattacattaagatcatagaacataccttatataaatccagtttgttcaaatttggtgaggtgtgttctgcaatgcaggatatagtttatcttggtgaatattatatatgtacttgcaaataatgcatttcagcagctgttgggaatattctataaatagcaatcagttgatagaattgatcagttctttccatatttttctaattttctacatttagtttcctatatttaatttctttatttagttcaattgctgatagtggtatgttgaagtcccaaactataattgtgaattcgtttattttacctttcaactctaatagtttttctttcatgtattttgaagctctgttgcatatacatttaggattgctatatcttcttggtgaattactctgttttattatgatataatgttactgatggtccatagtaattttttctgctctgaagtctactttatctgatattaatatagccattcttgcattttaaaaattaatgttagaacaaagagtgatgtcagtaagatggcagaataggagtttccagtgctaatcctctgacagaaacatcaatttgaacaactgtctatgcatgaataatcttcatggatgcgaattaatctaggagtaagtaattataccctccgaatggagcacaaatataagaaaagactcagtgaagagagtaagaacagtttcacagtatccagtcagcccttcctgaatcccaggcagtgcagcatggggagagagatacatggggaaaagagagtgaaatgagcacctgactttgccaaagatcctagcatcaggcctactccgatgaaccctggctccaggctggcccctgagcagtcagattccaggcccactcaatcaccaggctagcccctgtgggcagagctttaacactttccagtgaggatcagcactaggctggcctccaaatactcaagaccaggcacatagccatagacccaggcaccaggcctgccccagcccaggtcagccctaatgaccacagcctccagcctgtcccccatggatacaagcttttggtctgcacccagacaacaggctcatccctgtggaccccaacccaagctgatccccatggacataagatccagtcccaccctaaataacccagattccaggtctctaccatggactcagtactggaccttcccatgtacatgctggctccaggcccacccccacatacccatggctggccccatgcaaccaggtaccaggccagccagcccaaggactctagcagcaaacctgcccagactccatctcatggcccctccaaaatctctggacaggctaacaggtgaaggcctttccctgctgaagccagtctgtaaagactagaaaaggagtctacttcttcaaatgtgcagacaaaaattcaaggccacaaagatcaagaataatcagggaaacttgataccacccaatgaacaaaattaagcatgagtaaccaactgtaaagaaatgactatctgtaaactgactggcaaacaattcataacaatcatctttaaaaacctcagtaagctacaagaaaacacagacaactaaagaaaataaggaaaataacacacaaacaataaagaaatacacaaaaacaagaaaaaacaataaaacattctgcagctaaagaacacaactaaacttgaaaaattccactgggatttttggtatagtctgatttgtgtgacccctccaaatctcatgttgaaatttgatcctcaatcttggaggtggagcctaatgggaggtgtttcagtcatgggagtggattcctcttgaatggcttggtgacatccttgcagtaatgagtgagttctcactctgttaattccaatgagaactggttgtttaagagtctgccacctccctcttctctctcatctccttttttgccatgtgatctctctacacaccagctcctatttgctttccacaaaaagtggaagcagcctgaagccctcaccatgctgacaccagcatcatgcttcttgtacagcctacaaaaccataagccaaataaatgttctttcctttataaattcctgagcctcaggtattccttgatagcaacacaaatgaactaggacaaacttcaacaggagatttaatcaggcaaaagaaagaatccacaaactcaaagacagatccttggaaagtaccaactcaaaagaagaaaaattttaataagtctatgggacttatgggccgccattaagcaaagcaatatatgcattatgtgagtcatagaagaagtagagaaagagaaaggggcagaagattgtttaaagaaataatgacagaaaactacctaaatctggagagggaaatgagtattcagatccgtgaagccaaaagaatcccaaataaatataaaaagatcttcactgagatatgatcaaattctcaaaagtcaaaaacaaagataattttaaaagcatcaagagaaaagtgattcatcacataaaaaggaatttccttaagactatcagattttacaacaggaaccttggaaccccaaccaggcactgtggtgtggcacattcctgtactaccagctagctacttgtgaagtgaggctgtaggatcacttgagcccaggaattcaactccaacctgagaaacatagtgagaccctgtctgttggaagaacaaaagaaagaaaggaaagaaagaaagaaagaaagaaagaaagagagagagagagacagaaagaaagaaagaaagaaagaaagaaagaaagaaagaaagaaagaaagaaagaaacagaaagaaagaaagaaagagaaagaaagaaagaaagaaagaaagaaagaaagaaagaaagaaaaaagaaacagaaagaaagaaagaaagaaagaaagaaagaaagaaagaaagaaagaaagaaagaaaagtaaagtaaagtaaaaacaaaggctgggcagagtggctcatgcctgtaatcccagcactttgggaggccaagacaagagcattatgtcagcccaagggttcaagaccagcctggacaacagagtgagaccccatctctacaaaaaaggaaaaaagaaaaattagctgggtgtggtggtgcatgcctgtggtcccaattaacaaactattgtagctatagttatttttaatattttgtagagtaaaaagtcatttatgttccactattacagttttagagtaccaaaaatgtgatcaaagtcttacctttacagtgagttttaaacttttttatattttcatgttttggttagcatcctttcatttcaacttgaagaattcccagtagcatttcttgtaaggcatgtatagtggtgacgagcttctttcatttcaacttaaagaactaccactagcatttcttgtaaggcatgtctggtggtgatgaacttccatggattttgtttgtctaggaaacttttatcactccttaatttctgaaggacagctttgccaagtatagtattcttggttggcaggtttttttcttctttcagaaatttgaatcatgtaatcatccccacaagatttctctcatgtaagagaatttctctcattacaagatttgaatcatgtaatcatccctctcagcctacaagatttctttttttttcttttttcttttcaaaggcagggtcttgctctgccacccaggttggaaggcagtggcatgatcatggctcactgtagccttgacctccaaggctcaagtgtccttcccacctcagcctccacctacagactagcagcagtaagtccttacctataaataatcaggataatcaggataatttaatccatttactttaaatgtaaataaattacggaatcaaaagacatagaatgtctaaattgatttttaaaaacaagattcaactatatgcgactatagaagactcactttagcttaaaggacacatataggctgaaagtcaatgaagagaaaaagatattctatgcaaattgtaagcaaaaaagaataggggtgactatacttatatcagacaaaagacactttaagtcaaaaactgtcataagagacaaagaaggtcattgcataataataaaagggtcatttcatcaagaaggtaaaacaactataaatatatatatatatgcacccaacatcagaacatttaaatatattaaggaaatataaccaaaactgaaggtagaaacagacagcaatacaataatagtaggggacttcagtactcattttaaataatgactaggtcatctagacagaaaaacaatcaagaaacagtagatctgaataacaatatagaccaagtgggcctaacagacatatacaaaacattccattcaaaagaagtagaatacacacactttacaagtgcatatgaaacattctctaggacagattatatcttgggccaccaaacagtcttgaaaatttaagaagattgaaatcatatcaagtatcttttccaaccacaatagtatgaaattagaaatcaataatggaggaaaactggaaaattcacaaatatgtggaaattactcctgaacaaccaattgatcaagaaagaaatcaaaagggaaatttaaaaatatattgaaacaaataaaaatggaaacatagcatacaaaaatgtaggggacatggcaaaagcagttttaaaagggaagtttataataagaaacacctatattaaggaaaaagaaagatatcaaataaacaacttaacctcatacctcaagtaactaaaaaaataagaacgaacaaacccaaaagttagcagaaggaaggaaataatagaaagcaaagcagagacaaataaaattaagtttagaaaaacaaccgaaagaacaaaaaaactaagagtttgctttttgaaaagataaacaaaattgacaaacctttagctagactaataaaaaatgagagaagcctcaaataaataaaattataaatgaaagatgtgacatgacaactgacaccacagaaatacaaaggattataaaagattattactatgagccattttacaagccaaaaaattggataacctaaaagaaatggataaatttttagaaacacgtaacctaccaagactaaaatataaagaaatagaaaatctaaacagaccactgagtaaggaaattaaatcagtaatcaaaacttccccacaaagaaaagcccagaatctgcttgcttcaaaggtgaattctaccaaacgtttaaagaattaatgccaatccttctcaaactcttccaaaaaattgaagaggagggaacatgctatggtctgaatgcatccctcaatattcacgtgttggagacttaatccacaatgcaagagtactgtgaggtgggacattttgagagatgtttaagtcatgaaggttctgcccttatgaatggattaacgccattataaaagggcttgacagagggagtttggccctttatgcctttgtgcctttggctttgtgaggatacagccttcctcctctctggaagatacagcattcaaggtgccataatggagcagagagctgccctcagcagaggcaggcactttgaattggacttctcagcctccagaaatgtaagaaataaatttctgttctttacaaactacccattctcaggtatgttgttatagcagcatgaacaaacgaaaacagaatacttccaatctcatttacaaggccagcattaccctgataccaaagccaacaagaatactacgagaaaaaaaaattacagtccaatatccctgatgaatatagacgcaaaaatcctcaacaaaagactagcaaacagaactcaacaacatatcaaaagagtcatacttcatgatctagtggaatttattattgggatgaagaattgttcaacatatgcaaatcaataatgggctatgccacattaataaaataaaagataaaaatcacaggatcatcccaatagatgcagaaaaagcacttatcaaaatttatcctttcatgataaagactctcgacaaattgggcataagatgaatgtgcctcaacataatcaaggttatacatgataagcccacagctaacttaatactcaatggagagaagctgaaaacttttcctctaagatcagggacacgacaaggatgcccacttttgccacttcttttctatatagtacctggcgccttcttttcactttagtaccttgctacaattaggcaagaaaaaaaacaataaaatcatccgaatctggaaggagtaaaattgcatctgtttgcagatgacatgatcttaaatagagaaaactctgaggggagggaccaagatggctgactggaagcagctgccgtcagcggcaccaggaagaacgaaaacggcaagtgaatcctgcacctccagctgaggtatccaggttctctcatctgggctgactaggcggttggtgcaacccatggagagtgagaaaaagcagggtggagtgacggcccactgggagctgcacagaacaagtggagctctcacccccagacaagggaggcagtgagtaattgtgctaccctgctcgggaaaccacgctttttctatgaacctgtacaacctgcaaatcaggagattccctcatgagcccatgccaccagagccgtggggcccaagcaaagagctgtgcagacactcagcagccactccggttgaagccagtggcagcaggctggagactgcctaagatgaccaagttcccaaggggaggggcagctgccacagcaaaccatagcagccctatagaagacgggcctgactgttaaaagagaaacaaacaaacaaaaagcaacaacgacaacgacgtcaataaaaaagcccctacaaaaaccccatccaaaggtcagcagcctcaaagatcaagcaaaggtagataagcttacaaagatgagaaataatcaacacaaaaatgctaaaaactcaaaaacccagagtgcctattctcctctaagtgattgcaatacatctccagcaagaacacagaactgaactgaggctgagatggatgaactgacagaagtaggcttcagaagttgaagaataatgaacttcactgcgctaaaggagtatgttctaacccaatgcaaagaagctaagaaccctgataaaacatcacaggagctgtgaatgagaataaccggtttagagaggaacataaatgacttgatagagctgaaaaacacaacatgagaacttcacaatgcaatcacaagtatcaatagctgaagagaccacgcagaagaaagaatctcagagcttaaagactgtcttgctgaaataagacagtcagacgagattagagaaaaaggaatgaaaaggaaggaacaaaagctctgagaactatgggattatatacaaagaccaaacttatgactgattggggtacctgaaagagatggtgagaatggaaccaagttggaaaacatacttcaggatatcatccaggagaacttccccagtctagaaagacaggccaacatttaaattcaggaaacccagagaaccccagtaaaatactccatgagaagatcaaccccaagacacagaatcatcagattctccaaggtcaaaatgaaggaaaaatgttaagggcagccagagagaaaggtcaagtcacttaaaaagggaagcccagcagactgacagtggacctctcagtggaaactttacaagccagaagagattgggggccaatattcaggaaattgaaacaggaccccttcctcacaccttatacaaaaatcagctcaagatggattaaagacttaaatgtaaaacccacaaccataaaaaccctagaagaaaatctaagcaataccattcaggatataggcatgacaaaacttcaaaagcaattgcaacaaaagcaaaaattgacaaataggatctaattaaactaaagagcttctacacagcaaaagaaactatcatcagagcaaacagacaacctaaagaatgggagaaaatttttgcaatctatccatatggcaaaggtctaatatccacaatccacaaggaacttaaacaaatttataagaataaaacaaacaaccccattaaaaagtgggcagaagacatgaacagacacttctcaaaagaagacacacatgtggccaacaaacatatgaaaaaaagctcaacatcacttatcattagagaaatgcaaatcaaaaccacaatgagatactatctcacgccagtcaaatcccaattattaaaaaaatcaagaaacaacagatgctggtgaggctgtaaagaaagaggaatgcttttacattgttggtgggaatgtaaattagttcaaccattgtggaggacagtgtggtgattcctcaaagacctagaaccagaaataccatttgacccagctatccttccactggttatatacccaaaggaatataaatcattctattataaatatatacgcatgtgtatgttcattgcagcactattcgcaatagcaaagacatggaatcaacccaaatgcccatcagtgatagattggataaagaaaatgtgatacatatacaccatggaatattatgcagccataaaaaggaataagatcatgtcctttgcagggacatggatggagctggaagccattatcctcagcaaactaatgcaggaacagaaaaccaaacactgcatgttctcacttataagttggtgctgaacaatgagaacatatggacacagggaagggaaaaacacccactggggcctgtggtaggtggtgggggttgggagaacatcaggaaaaatagctaatgtgtgctgggctttaatacctaggtgatggattgatagggcagccagtcaaatacccttttattgccatcgggcagacagcatctattatgtacttctctaccatcctcaccctcataccactcaccagcctaattgcaaataaactacttaggtgatagattgataggtgtagcaaactaccatggcacatgtttacctatgaaacaaacctgtacatcctgcacatgtaccctgaaacttaaaataaaaattaaacagaaaaaaaggaaaaccctaaagactccagtaaaaaagtgttcaaactaataaacaaatccagtaatgttgcaggatagaaagttaacttgcaaaaaatcagtagcatctctatatactaacaacaaactatctgaaaaagaaattaggaaaacaatcccatttacaatagcttcaagacaataaatataacaggaataaatttaatcaagaaggcaaaaggcttgtacactgaaaactataaaacattgctaaaagcaactgaagacacaaataaatggaaagatatcccatgttcacgaatttgaaaaattaatattgcttaaatctccatactacccaaagcattctacagatgcaaatcaatctctatgaaaattccgatgtcatttttcacagaaatagaaaaaaaaatcctaaaactcatatgaaaccaaaaaagaccctgaatagctaaagcaatcttcagcaaaaaatgaatctggaagcatcatgctacttgatttcaaaatatactacaaagctatagtaatcaaaacagtaaggtgctggcataaaaacaaacatacagatcaatggaactgaatagaaattccaaatataaatccatgcacttgtagtcaatttttctttgcaaaattgccgggaacatgcaataggggaaagagaatatctttaataaataatgttggaaaaactggatatccatatgcaaaaaagtaaaattggacccttatctcacactacatgtaaaaaccaactaaaatagattaaagacttaaatacaagagctggaactgcaaaactgcccaaagaaaacataaggaaaaagctttttgacattgatctggccaatgatttttttttaaataaaaccccaaaacgggtagcaaaggaaaaataggcaaatgggattgcatcaaactaaaaagcttttgcacagcaaaggaaacatagacgttgaacaccaaaacagatgttacaatttttcttcaaccatcacatacgtgatttaaggaccacaaggagaaagatagcttgttttatttagtttatatgcagtttattattaattactttgattttttttccattacactttatttcctttctgcttggagagcttcctttgccattcttttagacagggtctccctctgtcacctaggccggagtgcagtagcatgagcatagatagctcagtgtaatgacgcacctcagcctcctctgagtagctgggattacaagcataagctacagcactcatctcccttatagctattctctaaggggagatatatagatacatatatatctatatatgtatatagagatgtatatatgtatacatatacatatatatctatatatgtatatataatatatagatgtatatgtatatatacatatatagatgtatatgtatatatacatatatagatagatacatatatctctatatagagagagatatatagagagagatacatatagatatatctctatatatatagagagagatatagatacatagatctctatatatagagatatatatagatatatatagagagatacatatagatatatatgtatctatatatctccccttagagaattttctaagggtattattttctctgtgttgttcagattaagtcctattgatctgtcttcaagttcagtgattctatcttctgtcatttccactctaccgttgagtccttccagtgaggttttccacttcttaaatgaacttgtaatcactcattcaatcaattttatgataattgctttacagcttttgtcagataattctattatctgattcatgtcagctgtctttttctcatcaaaattgtgatttttcttgtatgacaggtttcttggtataatgggttattttcttggtatgacaggtgattttctattgtatcttggacattttagatatatgtttaagaggtggggtttttttcctatttacattctatgtatatcttttacctaataggaagtcatctgttttggtttagcatagtagttcagtctgaccaaaggagtggaagagtctcctccccgggtcactgatatcactgctaggggcagagaggctctaccagcagtttggggctggtgatagattgagctaccctggctctgctgatgaagctgctgtaggcatcctgcgctcaccacttctggcagatgtaagacaggaaaatgggttggcttactgagggcttggctggcaacatttctgggcagactgggccattactaaatcccagttgggcttctcctgttccactcctttggccagagaaagcaggcattcccttcccctttcttccttccttccacctttcctctctcactttctccttcttcctttccctctttcattccttccctccaccaattcttgctggcaattcagggctgcagggctctccagtgcccagtaagatatatatgggagatgggaagaaaagtcaggaaactcaccatgatgccgttcttcaagtcctcaggtccctagccaatccactttcttctttactacctgtcaaagtccttttatgattgcctgtcgtactattttcaggtactcaattgtatttggagggaaggaacaagtattagtgactttatgacaccctgttgcagaaatggaagccactaaatactttttaaaaacagattatttttcacttactctttgaaaataccatcaatgatttaaagtgaaaagaagcaaagtaacttgattaaggtgacccagcaaattagcggcaaagtgaggttcacactcagacagactcaagaagccccagctcctgcttcaggctccacacaactaccccaggagtcttttagagaaggaactctcagcccccttcctgcacctgcacatatagttatacattcccacgagatgaaggagggaaaagaactagtttctaactggggaatttagttgtttgcaaaacctgatcttccatttcagattcattcccaaatgacataaagctacatgggaaataaattcaaacacattcaagccaactcactgtgttggtaaatattctgttggctgaaatgccaaacacaaagcgaagaagaggagcttcctaataccactaagatctgcattcctatcgtggggctggcacataggaggttctcagtaaatattcctcaactgaaaacaaagtgaaccagccgtttaaaacactggataaggcttggctcatatacctcctaccaaacagtgtccctgagaacaaccaaccacatcatgacaccctgtggaatatttgagatactgcactatacaagctctaccaaagcccaaattcaaatggacgggtgaaagcagaaaataagaccgctccccaaagtgcataatcaatgtttaaaggtctagaatgctcttttatcgtcagcagtctgacttcaatgaataaggtactctaaaataaaagtagcggcttcccaattctcggtgcttaactgaatttcagatcatttatacaattcattttctcttaaaactaattttaaaatgtggtcgaaacccctaaccaagacaacatgtttccaaatggtaaggaattttgtgtaatttttcctttagacataaaatgaacaggcagcaaatttaaaacatccccaaattgtcctaaaacggaacatcctgaaaaagtccaatgatggaatggcaggcaaaatccaaaggagcttctagaaatattttatgatttcaaaatattaataagtgattactgtaggcaagatcttcatggtttgctaaccgtggctaaacgtattgagaggatggcagagcggccaagaggtctggagcccgcaaaatgaaaaaaactcctaatatagtgtaaagtcatttctgctggatatcgtgatagtcagaaagaagatttatttttgtttgttttccatataaaaacctgaagacctatcaaatttagtatgtaaaatattctagtttttcaacattttgtactccccaaataaaataaaaagcagagtgtacacaaggggatcattgtgtgtggcaaaagtacatttgcacacattgaacagaaaatgattaagaattttttatggcactaattttattggaaagtcatagctatatatgttatatagcgttgggatcaagtttcaaccatgcatatacctttcatttgtaatggacttctttatttattcaaatagtgtctgacatcagaaaaattggactgcttatcggaaacacaagacactcagaaaaaaaaagaggaattaaaaaggaagcaataggacaagtaaaaaaaaatcttttaaaatctttaaactctcatgaaaaccacatgcaaatgactgattctgagaaatatatcacagatcttccacagattttcgttaatacattttcttttaatactcatacgttcattttctaccctctaactctattctaaacttataagttagttgacaagatagtacctgcctttcatggttgctttgttactgtttaattcctcatctacaattcaattgcaactaactttaaaattcaaacacatcatctaatctttgactatttaaataatgtatattttagtaattaagatttgtcagtaagatcacttaaaaaaaatcattaaactcttcaggataaaagtcttttcttgtccacacactgtcaataaacaaagtgctaatcttgtcactttcttggccactgtctcaggaatgcttcttaagtactcaaaggattaaattaaatctcacctgcagacaggctttacaattcggctgaaaacctagttctcaaagtaaaattactttcattatcttaagttaaaaccaaatattctgtcctctgggatttgcaggaaaaagaacagcatcaaagaaaacaattcacttcaagagagtttgttcttcaagactctgtctgaaagaattatttaagggagaattcgttttgggaaacattttttcaaggtcattctaagacagctataaaactgtgctatttaaattacttcaagttgatgccttttcacaattttgactgtgttcttggggttttaggatttttttttcaagaattatttatgtatagtccttgttttgaattctaaatttggttatgatcttttacttttttaagagattatgtaactttatgagctgaacatttgaaacctatggagggaataaaatgaagagatttatttcctttgagttcaaaaatgaaataatagaataaactaaatttgagattaaaagtatgtattcatttggggggaaaattgtagcacttcagtactcaagaaactattttccaacttaaagtactctatctatgctctttaatttaatttaagaaataataggataaaatactcatattgcagaaaatttcctcttaagaagagatagcatttcaaaaaatccctccacaatgttgttataagagtcaccgggggcaggattaggacgcggttcatttttggactcttgcatctacttcctaaataaacaaatcctaactctcgctccccaaatcaaatacaaacccagaggaaggacagggagatgaactaccagactgaaaaatagaaacattatgtcaaagcaccctacatcgttatttgcagacaatttattttgttattgcttagtatccttcatgctaaatgttctgtcccctacagcaaatgttccatttcaaaaacatagtaacatgtgctagaaatagaaaccaccaaagcaatagttctagtggatatagaacgtattttatggtagattagaaaaatatactttaaaactgaagctcactatcaatataatctataaaataacctaagagtatgttagaattcttttttagttggcataaagttttagaaatagagattaaagtgcattttaccctcatcagactatctctaaaagagggcggttaacatgcaagaattaaaggcaaatttgcaaatttactttttattttcattttagaaacatcaagaaatgtaaacagaaccgtaacacttcttcaattagattcacaagcatgacctgtgggaagataatttactaatttagcatgttttttctttgacctgtgcatttgagtctttaacagtgtgttctacctacatggcaagacataccacagccttatctttccagagcccagttttgaatagccctgataagcacctcaaagatggatcctacctgtgccacaaatccccttcacttcagatgcgtttctatagggaagtataatcttacctagcattctgacgaaagccacggtgttgcatctaaaattcacaaatgctatacggtaactttgagcacctttaaaatttatatcaaatattttggaaactaaacatgaaaggatttctggaaattaagagtttccatgaggttaaggtcaaaaattcctctcaagaattttttgtgacacaatgacatatgttattcattggaacaaagtgatgggtggacagaaagcccataagaatataattcagcaacttctgagacacaccagcacccaaatgatttacacaattctatacagtcaggggatcatcatattcctatcactcaccgtggtgtgatgaatcacacacctgcaaaaaatatactcaattattaaaatataaaaattacacaaaaatagcgtggcttccaaatttgactgcacacgagaatcatctgaatacctgataatgcagattcctgagcccccgactagaagtgctgacacagtagatccagggagaggtatggtaattcacatgttaaacaagtgctacaggtgatttttgatctcccagtcccatgaaccagagctctggaaacacttgcactgaaacatttttacatcaaactgagtctggaaaataatagttactcccaatttctccctcaaccatcacccttttcaagaaaaattgacaatgttctccctaagtttccggtactgaacttatttttcaaaggtctgagaattcagaaagcattattcactgccatttaggagatacccacaggacatgggtccaggaagaagctgggggtgagaagggttggcgagtaagctcctcctcccttgcaccttccttaagaacagcatagacatcggtggtatttacactgataagggcatctttcatgagaaagcaaagggcatgcaaagattccatctctgtgaaaggcttcttcaatgggaagtcaccagttacttatgacaatcatatccatagcctatcttcacttagaacccattggaggccaaccataaaacaaagaggctgaagatataacaaatacccataaaataatgagacctgataaattctaatggacagagtgtcagcataaatgaaacaaattctgtatattctttgcctctcaagttcctggcaaaagaacttcatggaatctcccacttagagagaagaggcacaaaaagatcatgagcagtcaccctgtaggcctgtgatctaaaccctggggctggacagataagctgaaatagttaagaaaccctttcattttcttcctttcaaagtttaatgttgttcattccttccagcagtaaccatctgcatttaagaggtctgattacagcacatgcagaatttacaaagtaaaataatgatgcaggccccagattcattccgctagtggaaaggagtctgtcttctgcaaagtgtcaaaaattcagtctcatctgctagcctgacgctgaagaaaacataaacccgggcttcttttcccaattaaattcagggtcccttaaactttcctaggaggctagtcttgttctgaaatcggatatttaaagaagcaatctgcttttgtctatgcatttttgtttcctattaagatccagaatgtgttttgttcttttattgtccaaggcagcttctccacatgtaattttggaatctcacagatcaatgtttcgggatggccatcaacaacttctatgctttgttaacaaattcctctggtcctttaataccactggatcctgtccttaatcagagcatatgtttggggtaagtgatgcaaatccagatgtatccataggtgccatactgcaggtcactgcaaaattccctgcaaaagcatattaaaatgcaaggggctgctataaggcatcaaggagtccttctagaggaaaaaggccagagttcataagccagatactttactaataattagttaaaatgtacaatgaaccaactgtgaaaccaaatgcagtgcttaaagcacacagggtatttaaacaagccctgagaacaaaatgaaggaggaaaatggggaatatttgaagtgatacacccagggagaggtgcaaggaatgactagtagttttgttccaaggtagctttcatactttcaagtacttttttaaaagaaaaagatagctgtaactttgaaaaagaaaagcaatttgcctttatgcttacatttccacaggctctcccgtagatttcctcctttccatggttcagtaattgctggcaagaggggccacttgcaccctcaaaataaggggcaagtggctaattatttctgtacaagcccatgttcacattcagtcagttgcagatgtagaattgtacccacaaaaaaagaagcagcttctatattatagggccctagatgcagtggaattccaagaaagcaacacaataaccctgcaattcatggggtggtgaatccctatgtagtaccccaaatgggctgcctggtgattttctttaaaacaaattaataagaacaattttttaaaaagatttaaagatattcagatgatattcagataagcaagtcaaatctgctctcaatacttatgttggtctaaatattaaaccgtaaattacttcagtgttttgtctaactctaactcagccttctttaaactcaggaacagagggggcaggaagaagctataagccaagagcaagatctcccagtgccaggcactgtttgctgattgaatctgcgtaacaagtctatgatttggtgacaatgatccctattttacagacaagggtcacattgctacaagacagcaaagtaagacttgaacccaagtctctcacattctaaacacagtgcttgctttgttaaaaaccatagtcatctgcccactactttaatttttttttaatatctaatgtgaattggccaatagcatgctcaagaacagctcttctgtaagcatttacttcaaactggtctgactacatactattagcaccgcaggtccagtctcagtgagaatcaaatagtttcaagacagcataggaaaaatgtttcattaacaagaaaatcaaagcatcttccttctcaatatgcctggttatatgttttttgattcattcagtattgagctaatatttgtttaattcctcctgtatgccaagtaacctctgcagacctggtgaagaagccagactcggtccctgcctctgtagagcttgtgtacaacgggggacacagtcaataaacaagtcaacaaatgcacacaaaatgtagtaacttcagacagtgataagtacaaagtgctaggtacaaaaataaaccagttcagggaacagtaagtgatgggggtttgcagctgagttacgtgagatgggtattcacgaagacctcttggaggaggtgatatctaaggagagtggtagatgataccaagaacctgctggggagaactacaatgcaagggccctaaggcaaaaaggagttccaaatggccaaaggggggcaggcagtacagaggaggccagtaaggcaggcatagcccagatgatagaggatgttggagaatgctaaggacctttattctgaaagcagtaggtggctttagcattttgagcatagagatagcatgactcgacttgtgttgacaaagatgaggctggctgctgggggtgagcgcatgctaaggacacagtgaaagcagaaacggctgataggaagcccccacagccaagcaggcgagatttctgtgaagaggtgccccatgtgatcatgactggaccactttaacaggtgaaggaacaaacaactgcagttcacccatgcaatggattattactccacaataaaaaagaatggtctactgatactgtgaaggttaatactgagtgtcaacttgattggactgaaggatgcaaagtattgatcctaggtgtttctgtgagggtgttgccaaagaagattaacagttgagtcagtgggctgggaaaggcagactcaaccttaatcttggtggataccactaatcagctgccagtacggccaggatataaagcaggcagaaaaacatgaaaaggctagatttgcttagcctttcagcctacatctttctcccatgctggatgcttcctgctgtcaaacatcagactccaagttcttcagctttgggactcacactggcttccttgctcctcagcttgcagatggactattgtgggaccttgagatagtataagttaatgctacttaataaactcccatcatatatgtgtgtgtgtgtgtgtgtgtgtgtgtgtgtgtgtgtgtgtgtatcctattggttctgtccttctagagaaccctaacacagatttccacaactatacagatgaacctcaagtacattatgccaagcaaaagaagctagacccagaaggctacatatctatgggtccatttatatgacactgtacaaaaggcaaaactattgggacgaaggagcagatcagtggttgccagggcactgaggctgactgcaaaggggcatgagggaattctagaggatgatgaaactgtcatatatgttgattgcagtgatggtcatgggactgtatggattttttaaatgcatagattgtacaccaaaaaggaggaatttaactgtatgtaagtaatatctcaagctttttaagtgactagtaaaacatgcttatattaataggtttaaagattgtaccactaagactcaagggaaggacagagcccatggccatgcagctatttctatacaactgtctcagtctgggacgccctccagttggatctgggatctgcaagggaccagagtagaaacaagctggtggattgttgaggctgttttgtctcagtttcataagcaaaaggcaatggaaaagtgttggggtcaagtgtgaaatgcgtgcgtctcctacaaaaccttcccttagccctgcctaattcgccagcctcctttccaccctgcctgtttactccagtcacactgaagtccttgaactgctaagctccacaactccaccctctctggctcagcaaacaccttgtcttcttttctcctttctctgaaatgctacatcctgtccttgacaagggaagagtcctcccatattctctcaacacctgtactgcttcatcatactccctgcaactgcagtcaggttattaactctggaatcttagcttgacttttgtttactgactaattttccattaagccaaagctccatgggggcaaggactccatctctctcattccagactgtattcccaatacctagcacatacatagtaggccctcaatacatacatgtgaaatgaatttcaataagttgctcattagaaatattaggtaggcagaagcagctctggaacagctccttgattcttctaaagtagtagttattagggaaagcacatgagaaactcatataaggatttcacagaggaaagcccattccccacccattccctgatgcctgcagccagaggtcctgaaaagtactttctacccaacagaagacacaggcaggtgggacctatttacagttcagaatgaagcacttccctgggctgtaggctttaccagaactttgctctgcttgttgggaaggaatgcaattcatgattcatacattcaataagagacccaagaataattttccaaggcccacttggaactcagataagtgctagaatgaaaacatttaccagcagattaagatggttttaacatttttcatttcaaacccctatttgcaggggattacatgataagccagctgtaaaacttaattctaaactgaaacttggcaaataatgatggactgccttcacacatattttttagaaaaaaagggggtgggagtgcagagagagagggagacaacctttggtcacttgtaagatactgaaatgccaaaaaagaagaagtgaaaagtcgttttcagtgtttctttaaatcatccttgcagagagaagatatctttgttttcaacatcaatcttgagaaccagagctcagagatgagaccagacttaagcaaaacaggacactgacttccatcaacaccatacactgggcagctaccccatctctacttaaaatacaaaaattagccgggtatggtggtgtgtgcctgtagtcccagctactcaagagactgaggcagcagaattgcttgcacccaggaggcagaggttgcagtgagccgagatcgcgccactgcactccagcctggcgacagagtgagactccatctcaaacacacacacacacacacacacacacacacacacacacacacacacacacacaaatttaacctggtcacatttatttgtcagagttagtgtcctaagatgtagaaaatagcaactcctgctgttgtttagacacaataaattgagtataaactatgttctcttaggtccttgtggccccagagagaaaaccagactttgagaaatataggcagtgcatgcactgtccacttcgctttaaaagaaactacaaaaaacagtcacacaattctagtaatgtgctgttggcccagactgtaaaatcccagcatgtctccaaccaagttcagaggaagcgccatcaaggatgccctatgggtagcttaacagtcattgcagacctgtttgctctgtgaaaagctacaagatgctttcagccagaaaaagaaaaagaactcaaaatgatgtggccacatggattctgtcctggattctgttctcaatccactttaggttttagagacattaaatagagagccagtattacgggaaaaggcagcagtatgctaatgcgcagggtcagcaaactcccgcccacaggccagtttccggcccaccacctgtttttgtaaacagaatttattgaaacccagccaatatctatacttgctgtagtactacaaatggcagaactgaatatttgcaatggaggccatctggccctttaagaaaacatctgatgaccctcagaccagtgaatatgaggagatatttaaattctgtgtgtgttgggcaggttagctaatgtctttgagcctcattttatccacagtaaaatgggataatagtaacacctatcccagaaggtagttatcgcagctacaagagttaatgcaaatgtagaaagcaagggggaaatggaattttaagagctgggacccgagttgcattttgagagaagtgttgctgttgcttagggaagtatgaaccactattagtagtactaatctttcccacataatcataggactgtcagccctaccctatctgaaaatagtggagttgaagtgtcttcatgctcctctgcctcctgacagaccacacctccagcctctcatctttcccacactcttcaggtggggtaggactgacagtgtgaagaaaggtagtcaggtgggccaaggaaaaaagtaggtaagggaagaagctgaacacatggcaagctgctgaaacaagcaggcaaagtgactgatgaaaaactccacatggcgaggcagcaccagctttgtgcagaatcaaggaagcctgatgctccactttctcaagtcctccttgttatgattataagccctgctctcccaacctaaggtttcaggaaagactgctcagcccacatgccttgtgtgagtggtaagaggagaagttaaagggaagaggctgtgtgccacgagtgggtaaactgaacaaccagacccacagggaaaagaggtgtaagtgagcagtataacggggatggaaattcacacctggagggcattctggaaagaggagactgtgagggatggggagaagtggggaggaatgggcttctttctggatgtggggtagaacatgtaagctgtatttacatctcaaaggacaggatgacctcaggtggcacccgagttacacacatcaagaacttagctcaacaactgacatataaaacattttcctgatcttttacatgtccttgccattacaattattgttggaatcattatttactggaagccagaaaacttgattcccattgcttttctatctcaggatctcaatcaagccgtttagccactttagaacctcagcttccttatctacaaaaatgggcataatagctgccccgatgactccactggatttacggaagggatcaaatggaaaaacatgtgtactatgaaaattataagtccccttcgcaatgtaaggtggcatcattaagaagaagttgactttttttttttaagtaaaaccttaaccagcctaacccttaaaaccaaaacttcaaagctcttgaagcagtttacatttctcccctcttaattccaggcaataaaactgtaacctcctcaaagttacaggagatacaaagacgcagacagaccagctgcagctcatggtccacccccaccccgaataggctgagatcatttattcaaaagcacacctttgaatcatctgtaaacacttccttcaagttcccagtaagttaaactttgctaacagctggcaattatatggcaattattacacccattttgttcttaggcttaaagttatactctctggaaaaacagagaatgatataaagttggtcttttactaaaattgtgtacagtacctgcctcccgacccattgctttttaggaaatgtcaggcagtgcttaaagagaaatagcaggactgtgcccacacatgggccagagtgatgaatctgctttgaattggaataaggaaaaacaaacatcgttgaacgggggagatttagttcaagggtttcaaagtaaaaattccagagatagctccatttcaaaccactgcacccaattttgagataacatatgaatgaagtctagatgtggaacatgatgggaatacagctatattactgaataaatgcctttcatatatatgatagcatatttaaatatgattggctatataacgtatcaaatgtctattacgtcctatcatctctgttgggtaccttgtcccccctgctggatacttttaacatccattgtatcatttcattctcctaataatcctatggaaaagatactgtgttcttattttatcgatgagcaaactgcggcttcaagggatacaacaacttgactcagtccatacaactagtaagtccctagttcaatatactgtctgtggataaaatatgggtcatctcttttagaaaggcatttacaatcaagttgctttgccaacactcaagcaagcaagttggagaaaactgttgcagtaacaatcaaaagcctgttttcaagatgcttccatttttattaagtcattcaaaaattgccctcatgctctgtatatgtagtcttatatcaaaaagcgattaagatctgacatgggccaaatgtcggtcttcagaggctcacagccctcatggcagtgcgatgtaattcaatattgcaacactgaggctcggaaagacaatgcgcgtgttaggttgcagcattcattacctcaggcgagacacaggccctctgtgtatacactatcaaagccccactaaacttaaactgaaatgccaaacacggcgacctgggccccgttaatcaacatctgctcaacagtttgcctctttccaccagctagcaaagagaatgccatacagcttttgtgctgtaaaacctgggtaggctgaaagaacaacctgagctggtgccttctagctgggatggcagtattccctgatggggagggcagacttaggggagaaaagacagtcatagttgcctttgagtttcagagattttcactcccagcagaatagcaaatgaagcaagtcattttcctcccttccaaggagtgatatcacttttttttcagacaataaaatacatggaaagtgaaatggtttgattatctttagcaccagtaaattttattgtaatccatggccaaatatatttatgtctggttctgatatacaaccttagctcctattgttcagaggaaattttacttaaaagacgttagtcattaagtctgccctgaagagctcaagcagagcttttcctactagaatgtcccgtataacaggcgagacagacaaactgcagaggtaatggaggctggcttccaaatctgccactctccgggggcctatcagccccatcattagtacaacacagctgcagagagactcttcttattttcagtgaattcattccatcccaacttcttggccaatcccactctcagtctcccctctctctatctgcacttgcatgccctcatgctgagaattgccacattgtggttggttctgtctgcccacatttcaacaacaaataacagcctgggtggctccaggtttcatggggcctgaatttgataggagtgtggaaggggggtttctttaaagaaaaatcttacttttgcaaaatttacaaaaacataaacatgagaatacactgccagagttttggaagagacttgtgcaaaggagggggcatgaacttaagcaccattagctttccagcaaattcatctctggtatgtaataatgtttactgagtgatgtccacataaccctcagtccatcctgtctcaccagaccaagagcttaacctttgccatgtgacaattcttccttcatctggagacaaatgcttttgaacacctgtccctagaggacataaggtttggtctgctcaattgctaagagataatttatgaaagtccccataaagagagggaaagaagacatgaaatgtcatttggtctttatagtttcctcaatgtcatgagggtgttgcatgcttgctatgactttgtttctcttgagaaacaggagaaacctacttctcagtgccccagataagaaaggaaaagttacaactcagtggcctctccaccaaccacctcagaaaagaaagacacaaatgaacaacactgaccaggtcatgtccttgaagctgatctggacaaaatctgtttcccaaatatgtatgtattatgtatcatacattattatgtatgggccttgtgagagagttggggcctcctagcactacttggacataggtgtcaatctttaagacctgagagatctgtgctggtaatagctggacgttacttaataccctctgagttgagaatagacgagatgatgtgacaagtgctctctgaccggttttggtctcttagagctctcaatcctgcacttaactgctttattgaaaagccaatcaatatattaagagactggaatgaatgaagacaccttccctggtcaataggcatactcttttttaaaaaaggattcattaggcgccagttattgtactgagctcttttcactcattctccatgaatcctcatggcttctctacgaggtaggtaccatgatcatgttcattacagatatgggggcaactaaggttgagaagggtaaggaacttgtctaacctacatagttaaaaaagagataagccaaaatttaacctcaggtcttttcttcctcccatttccccaataagatccttttatttcttaccttctcctccttcccccacaaacacaccattaaacaatggctctaaatcttaacacttattttttatattttatttctaattacagtaaaatatacaagcaagatttaccatctcaaccatttttaagtgtccacttcaggggcattaagtacattcatattgtttgctgtgcagtcatcactgccatccatccacagaatgattttcatcttacaaaactaaaattttgtacctattaaataataactccttatcttaacatttcttgtttaatttttctttctttcttgtaatgtgtcagcatcaggccccacattgcttactcatttcttggttttgctttgggcctataaaatcttcagaacagttgtattcttcttaattagaaagcctccatcaagaccccagctgactgggttgtgttctggcatagctgcatggttctttcgcctaagatgtacctaaaatgcagtaccaaagcaacttcccagaaccttgttttcatctgttaaactggaatccaaacagtacctacctcactgacatgtgggtgttgtgaagattaagataatcattcattgtatttcacatgtattgattaagctcctgttacatggtggatgccgatctaggcacttgggatacgtcagtacacaaaacagacaatgattctgtccttataaaacttagattccaacagagggaggcagatgaaaaataaatataattaatgagtaaatgatagattgtattaaaaggtgaaatactatggttaaaaaaaaagaacaagtagacaaaggtaagaaatataatgatctacctctttagtttggtataaatattcaaatatgagaattttaaataacattacataatgttccacattaaattcttctccaattaattgattattatttgtcaggtatccttacagtgatataatcaatgtgattttcagagaagcacttgtaaaacaaatcttcaattcatattacaaatttctgtagcaagatacctgcacttgataaacagctgtgctctggttataattcctgatatccaaacatactcacaagttgtgactaccagaaaacccctcctgaacccatgcctccccttaacttttagggagacataccctgacaaggtagatgtacagacctgcaagtggtctctgtaactgttacgacccttggacttaatccaacggctggctcttgggaaagttgagaggttggaaaagccttaccttcaggttcacaaccttctgattgctcaccacaccacactccaggtgcctggtattagtgtcatccccaccaactctgccaccaccccaatcacttctgaaaagacgaagtctctcagtcctctggtgacatgtgactgttaattttatgtgtcaatttggctggaccacgacaccaagatatttggtcaagcattattgtggatgtttctatgagagtgtttttggatgacacatgaagtcagtggactttaagtaagcagattaccctccataatgtgggagagcctcatccaatcaaaacaaatggctgacctcccataggcaagatggaattcctcagcagactgccttcaggcttcatctgcaacatcagctcttcccggttcactagcagacagccttggactcaaactgcaactctttcctgggtctccagcctgccagcctctcccattagattctggattcacaaagtccccataatcacatgagccaatttcttaaaacaaatctttttctttctttctttctttatttacacacatcctattggttctgtctctctggagaaccctgtctaatgcatttggtctttccttctctaccacagaaactttggtccagggcccttacccactctccctggctaagggtcaatgaggggatcatagaaagccagaaaattataaggcttcatgtgctcttgtaatgtctttctccatgagcacataaagatatcttttttttattttttttatttttttttttggaaatggagtctcgctctgtcaccaggctagggtgcagtggcgccatctcggctcactgcaacctccgccccccaggttcaagcaattctcctgtctcagcctcctgagtagctaggactattggcgcccgccaacatgcccggctaatttttgtatttttagtagagacgggggtttcacctgttggccacggtggtctcgatctcttgacctcgtgatctgcccacctcggcctcccaaagtgctaagattacaggcatgagccaccgtgcccggccacatagagatatttatatgcacagataatggttaaaatccagactacttcagttcataacctattgctgctactaatcagctacaggaagtaagtgactttggacaacttacttcagatctctaggattcagtttccccatctgaaaactgaggtgtctttgggctcaaagattcttattttaatttccatctttgcccagaagtcctctctaaacaatttaggagagttggatgtattctctgtatttaagtcttttatcttaaatcatatcccattgtgccacatcacaattcttcctttagtgttgtaggaaaaaacaaaaaacaaaaaactgtgcttcaatagaaaataaatgttcagatcataccctttcaagttatctggttctagtcttttattgtcttttagctattgtacaacttggtaaactgtaaataaccgatggcaatgaaaataattcctgtctacaaacatgcagattctgagctgtccagtagaggttatattgactttccctctgcacttgggaaaaagccagctttgtctgcatttgcacattcatttcaatattcctgatctacaaatgtgtctgttctctgaattctctatccagttctaacatctgcctggttcctcagctgactaatgagttaagtaaaatctttaatatgtgttcattttataactgtatcaaagtcataattttaccattttaaaaaaattatcttagaatgagttctatctctactacactgggaacgtcttatgtacatttaatatgtttgctcaatgaacacacaaatgaaggaactgacaaacaaacatagtctttctcccatgggcacatgaagatttctatatccacagataatggttaagagtaaaatccagactacttcagttcagttacctactgctgctactaatcagctgcattatccacagcaattatctgtactttccttttcccatctgtaaaatgggaagaaacccccaccctttaaaggttgtcattaggattaaaagaaacaatccatgagaaagttttagtactatgcatggcagccttgtaagtatttaatgaattgtacttatcatcatttttagacaggttgaccatttgggcaatcatacacattctgtctttcatctaacaacccacagggtgccccatacccaacaggtgcttcataaaggctaatgacggtggcagtgaccacaacagttccaaaacctcctggcctgccaagcttaataaagtatgttatccattcttccagaccactgctggagatgttacagcctgaccttctattgatcccaacatcgtcccaatggaccctgttccattgtaatttattacaacagccaaattgaatccacatgacagtgctcagggccaattctcattgagggtctccccctcttctgcccctgcccctactgcccccaaagatttgtggagacactgaattagatgatttactcaattccagatattacagctattgaattcctttctttaatcttgcacatccacctagaaaacgataaagatggcctggcatgatttgttctgcactctcgtaaattttttattaatgcagagtcagtaacctccacttgcctgctcaattcttcccagccatggtctttatcttgaggaattcaagttgcttgttgctactgacatctcctatattcctcaagcctttattctcagttagaaagaagcaagtccagaaagatagttctctggctgcaggcacgactgcacataaataataacaggatctagcagattctacatgcaagtttgcccaaagatgtctgagcaaattagtgcctcctgtgctctataagacaatttcaatcgctaaaattgacattcttgatttttccttcaattcaacacagggatggtgtctcaggctctttctctattgaccttgtaagcatttcgaatgtgattttctacctcctgcttttctctctggactagactagtctgcatgctgacactgcaattgggagacttatctaaccaaactagtttgtcagctaccataacacttagcacagtgtttgtttagttcccatgtccttgatcatagagactctacaaaagaaaggaagggactttaaaagatgaattattcaaagaaaaaaatatttagcttaaaattctaaataaaggtcttgtggcaatgacgagaaaaaatatataaaccacacagaaacatacaacaaatgtttggactatgaatggaaatgaaatactaaaccaaagattcttcaagaacagtttctgagagtttaaatttgaacatagcaaataacatatatttccttatgacaattgccatgtttaccagaaatctaagttaaagttactgtaaacagaagaaatacataaattaccttgggtgcttaactaagttctgtatctgtaattcagtaaactgctataaaaagtattttaaaatggaggattaaaataatgcaaaggaaaattagctgatatacacgtgggtataagcacattaccgtgaccaacttaaattagcaaataaacatttcatgctatgtgtagaattttttctgcatttcatattataaaccataaatcttaattttccttgttaatgttaaatgtttattttgttcattggcttatgcaataaaaatagataactattttatatagattcaagagatcccatttttaaaagcctaatttgatttttaagaataaaaaggctatactgtttcttttttaaaagaagtataacatggtacttacatgtaagctaattattttaaaataaagaagtactattgctttagaaatgaaaaataaacaggataaataataaacggtaagagaactcttttcagttcaggcttcagggcaaaactgtacacctctgtacaagatctggtgtgaattttctgtggggatctgaagcttatcaggccaaacttacacatttaaaaggcttggccaattaccatgtatctatctgctctaggggtgaaagcagcatctatgatacctctggtcactctccaaaccattcactgcttactatgaatgctagaaaatgaagatggatttgcacaaactcatgctgattacaaaaaataataataatgatacaaggcccttttttctcattctaaaacaagaagcgctcatttcttttatttttaaaaatagttaaatgctatcgtttcagcacaacccattgcacacacatgaacacacacccaaacacacatatgcatgcctttccctgccctttagggagtttatcattagtataccaccagaattgttgaccctacctaacttcccatgtaactttgcaagtttaccatcaaaggctctggattctggtctcaactctgacttgagctcacctggggtaatgcatttgatttctggctctcagactagaaaatcttaccttctcaacagacggagactaggttgtttctccagtccttttcagtgccaacatcctaccctgccccaactctggcttcggaataacttcagggatgaaagacacatatggttatgacagagattgtttcataaacaacaaggttactctcagagttatctttaagagtatcctctttagaatgaactattgataaaagctacaacatggatgagtttcaatgcattatgctaagtcaaagaagccagacacgaaagtctatccatatacaggatgattccatttttatgacattctagaaaaggcaaaactacaaggcatggggaacaaactggtgattgccagggattggaggctggggagagagattgaccacaaagggcagcacaagggaggattacagaagtgccccgtgtcatgattgtgaaggggcttacattactttgtttttgttaaaacacatagaactgtacaccacaaaaagtgaatttcactattagtaaagttaaaaagcaattaaaaattatctttgtgaaataatttcattttctttccaagctcttaaaaaattgaggagtttagcatttaagttcggattttttgtataaaataataatttattgagcaccaacagtgatggtcagtttgttcattcaacaaatacctcttgaacacctactatgctgagaaaaattcagactgaaagtaagaggtgagcttatcctcattttaatgacagggaaactgaggcagaggatatgtaagtaacttgccaaagattaaaaagaccttaagtaacaacactgagattcaaagccaggcctgtcacagttcatgcccttaataaactaattatactgaagcatgcatgtatgtatgcataagttatgtctgtgtataaagtttttaaaataaaaatcaggttatactataaagtggtgttgagggtgtgggaaaataggcattttctgatacttctctgtacatacatattgtaaagtttatttccattaacaaaatagagtgaatatctttctatatcattaaatatactcataaatatactcatctataacatcatgtctactggcagaatttccatgtatgaatataccatcatttatttagttactcctccacttgggaatgctttcactgatctggaaaaaaaatttttttaaagaactatgccgtgaacaagcctgtagctaaatcaatacctacatcctcaatcttttcctagaatgaattcctaggtaaagaatcaataggttaaatagctctggtcaaatgccccatgtttgttttcccctgactacctgacatttcatacctgccatctacctgtcccaaagaacactaccgggcaagccctaagaaacgtgtcggtaacatggaactgcagcaaaggacctttgcctctattcctaccttcccacctggccacccttgtccatgccctcagctgttcacaagttcacagacattccatttggagacagccttggtgtgtgtatgccgcccttcataaacttttataaatcagtctatcatatgtgaccttaagaatttaacttcttattttaataactaaagaaagaaatatctccactccatgtcaatgagtgctattcattcaagcacatcctgtttgcttagctttgcttcattcagactttattcacaaaaaagctacagaacgcaacagaaactaaggaagacctcacccttgggaacgaacgacttacttccctttgcaccagaaaggatgtctgaggcaaacagtaaatatagtctggaaaagaagtgaactttgtttaactctattaaatatttagagtacacttttaaaatctcaaacttgccatgaaggttgctatatgatagagttgcctagaggctgtaagaacttgtgatctacaccagagttgagcaaactgcagcccatgggccaaactggcccactgcctgtttttgtaaataaagttttattggaacacagccattcctatttatttactcattctgaatccaaaaagaactttggacttatttatttactcaatctattacatttcagttttccagctaacatttattaagcacctataacatgccagcactgtgctaagtactaaggataaaagaatgactaagactcagtcacttcctttgctgaactcagggtttaatgaggagagagacataaagatacaacatagcattttaggaaatcttaggtattttatctaaaatactacaatctgaaagctgtaataaaggctcatttcctatgcatacatttttaaataatccgggtccccctaaaattgtaaaacatcatcaagactcccattatttattttttttctttattttatgagacagggtctcgctctgttgcccaggcttcagcgagtgtcatgatcatggctcactgcagcctcaacctcccggactcaagcaatcctcccacctcagcctcccgaacaggtggaactacaggcacgcactaccatgcccagctaattttttaattttgtgtagagacaggtctcactctgttccccgggctgctctcaaattcctgggctccagcaatccttccacctcagccaccgtgcccagcctcatgatattctgacatggactactttcttttttaaaaaaaaaaaagcattttattttaggttccaggatacatgtgcagaacgtgcaggtttgttgcataggttaatgtgtgccacggtggttcgctgcacctatcaatccaacacctaggtattaagcccagtgtgcattagctatttttcctgatgctctcccttcccctgtgacccccctgcccctactgactggccctggtgtgtgttgttcctctccctgtgtccatgtattcccattgttagctcccacttatgagtgagtatatgtggtgtttggttttctgttcctgtgttagtttgctgaggatgatggcttccagcttcatccatgtccctgcaaaggacatgatttcattcctttttatggctgcatagtattccatggtgtatatataccacattttctttatccagtctattattgacaggcatttgggttgattccatgtctttgctattatgaatagtactgcaatgagcatacatgtgcatgtatctttatagcagaacgatttatattcctttgggtatatacccagtaatgggattactgggtcaaacagtatttctggttctagatctttgaggaatcaccactgtctcccacagtggttgaactaatttacattcccatcaacactgtaaaagcattcctatttatccacagcctcaccagcatctgttgtttcttgactttttaataatcgccattctaaccggcatgagatggtagttcattgtggttttgatttgcatttctctaatgatcagtgatgttgagctttgcttagcttttcttcatgtgtttgttggccacataaatgtcttcttttgagaagtgtctgttcatgtcctttgcccactttttgatggggttgtttttcttcttgtaaatttgtttaagttccttgtagattctggatattagacctttgtaaaaggggtggattgcaaaagttttctcccattctgtaggttgtctgttcactctgatgatagtttctttttctgtgcagaagctcttcagtttaattagatcccatttgtcaatttttgctttgttgcaattgtttttgatgatgtcatcataaaatctttgtccatgcctatttcctgaatggtaccgcctagattttcttctagggtttttatggtttggggttttacatttaagtctttaatccaccttaagttaatttttgttaaagtataagaaagtggtcctgtttcagttttctgcatatggcctattttcccagcaccatttattaaataaggaatcttttccccattgcttgtttttgtcaggtttgttgaaaatcagatggttgtagatgtgtggtattatttctgagatctctattctgttccattggtctatgtgtctgttttggtacttgtaccatgctgtattggttaccatagccttgtagtagagtttgaagtcaagcggcataatgcctccagctttgttctttttgcttaggattgtcttggctacataggcatgggctcttttatggttccagatgaattttaaagtatttttttctaattctgtgaagaatgtcaatggtagtttgatgggaatagcactgaatctctaaattactttgggcagcatggccattttcacaatattaattcttcctattaacgaggatgaaatatttttccatttgtttgtgtcttctcttatttccttgagcagtggattgtagttctccttgaagaggtccttcacatcccttgttagctgtttcctaggtattttattctctttgtagcaattgcgaatggaagttcattcatggctctctgcttgtctattgttggtgtataggaatgcttgtgattttgcacattgattttgtatcctgagactttgctgaagttgcttatcaccttaaggagcttttgagctgagacgatggggttttctagatataggatcatgtcatctgcaaatagagacaattttacttcctcatttcctatttgaataatttctctctcttacctgattgccctggtcagaacttccaatactatgttgaataggagtggtgaaagagggtatccttgtgttgtgccagttttcaaagggaatgcttccagcttttgccgattcatgatattggctgtgggtttatcataaatagctcttattattttgagatatgttccaccaatacgtagtttattgagactttttaacatgaagggatgttgaattttatcaaaggccttttctgcatctattgagataatcacgtggtttttgtcattggttctgtttatgtgatgaattatgtttattgatttgcgtatgttgaaccagacttgcatcccagggatgaagccaacttgatcatggcagctaagctttttgatgtgctgctggattcagtttgccagtatattattatggattttcgcatcgattttcatcaggggtattggcctgaattttttgttgttgttgtgtctctgccagattttggtatcaggatgatgctggcctcataaaatgagttagggagaagtccttccttttcaattgtttggaaatatttcagagggaatctaccagctcctctttgtacctctggtagaatttggctgtgaatccatctgctcctgggctttttttggttggcgggctatttattactgcctcaatttcagaacttgttattggtctattcaaggatttgacttcttcctggtttagtcttgggaaggtgtacgtgtccaggaatttctccatttcacctagattttctagtttatttgcatagaggtgtttgtactcttctctgatggtagtttgtatttctgtggggtcagtggtgatatctcctttatcattttttattatgtctatttgattcttctctttttccttctttattagtctagctagtggtccattttatttatttatttatttttttccaaaaaaccagcccctggattcatgatttttttgaaggatcttttgtgtctctatctccatcagttctgctctgatcttagttatttcctgtcttcagttaatttttggattggtttgctcttgcttctctagatcttttagttttgatgttacagtgtcaatttgagatctttctagctttctgatgtgggcatttagtgctataaatttccctcttaacactgctttagctgtgttcctgagattctggtacattatctctttgctctcattggtttcaaagaacttggtttctgccttaatttcattatttacccaggaatcattcaggagcaggttgttcaatttccatgtagttgtgtggttttgagtgagtttcttaatctttagttctaatttggttgcactgtggtctgagagactgttatgatttcagttcttttgcatttgctgaggagtgttttacttccaattttgtgatcgattttagagtaagtgccatgtggcactgagaagaatatatattctgttgttttggggtggagagttctgtagatgtctatcaggtccacttgatctagagctgagctcaagccctgcatatccttgttaattttctgtctcaatgatcctatctaatattgacagttgggtgttaaggtctcccactattattgtgtgggaagactgccattatttctatgctgagcagtcaaggtattgaaaactgctttagttcctagcggtgccactttagtggaccagcagcattctttgtcagtatcctgtgaactctactactgtttacttgcctctgaatttccatgagaggtttgggaactctgaaaagttattttaacatgtacttacatcagttttctattgctgtatgacaaaatgccaccaaatgacttaaaacaacatccatttattagttcacagttgtgtaagtcagaagtctgtcaaggtgtggctggggtctctgcctgtggctggggtctctgcctggggtattacaagggtgaaatcaagacgtcagccagaagagcatctctctggaggctctagggaaaaattcacttccaaatccatcatattcatagtcccaggcattattcaaagcacatacaacagggaagtgggaaagctcaggggtccatcttagaattctatctaccacagtacttttgttagagttataaatgacttttataaaccataattgtattatctaaggactgattatatgtgggtgctactgctggttctcaaaatcagcaatctaaaaaggaggtatgataaaaatgttatgacaaaggctccaaattgccatatagtttgtgccattaatttagaatacaacttccatgaaaacagtctgtttaaagcagttacatattttagtctgcagaagttgtagtataatcaggtgagtacaaaggaaagtacaaagtacaaagactgcagtatcagaacagtagaaaaatgctattacccacagtaactgtgaagcaatatgccccacaagaacacattacccttactttacatttatacttatgggaaactaaaacaggtattatagacattttgaatcatggacttcccttacaatataacatgataaatgccaatatagatatgtgtaaaattcttcacagcaaagcagagtccattggcaaacaaaagataagtaaaaaaagacagaacattttccttcccacataaataaggttgatttaaatcaaatggcctgggagtatgtagggagaaaaacagaatcatctgcagactgaaatatgtaaaggctcaaccacctctaatcccatttcaaaaactataagcaatagctggcagcttggattgacagatgtgtcaagatgcctgtacccgttagggtagcagccgtggtcagggcactctgggcatttttattttaaatcttcaaggaattttgcaagtaattataaacaaaccttttttaaaaaaaaaaaaatccatcatagtgaaattgagtatagaatataaggtcttaacccagaagcaaatatttatttaaaagagaatttgcctcccctgggtgggatcagctttttcattgaacgagaatcaattctcagcatgatctggccctgaactgcatttttaaataacactgataattgttattgccacttgcaagtcacaaaggactagaacatttataatatagaagtcaaaatgactctccaactttaattataaaatatatttgattgctagaagacgtaaagaatagaaaagctccgaaatgtgaaatctgtttcctaagtgggccaagaaagtgtggtccagctatattaaattacttctaattccaccaaatgcaccgtgctgcctcttcctgccaaacctttgcaaatgctattctcgctttgactggaccactactcctagcccctcatctctcaatttagccattatcttttccaggaagtcctccttattcatcccactcccctggctaggtgaggtgcccctcctatgtgtagtatacctggctgatagagcacacatcatctacagtcctgtaacttgcctatttagtaattttctccatgagtctgagttcccagtgggcagaaattacaacttcttcaataatatatgtatccccagtacctttgaggcagccagctcattaccgatgctgaatgtggactattggatggctggacagcaggagggcaggcaaacaaacaggccagagtagggcaatggtgcccaaggcctcatatgccatagggacatggaaagaaggaaaggaaaagtgtaatcagattcagacacttgagtacagcccaggctctgtcactaattagctccatgaccctacataagtcacatcatccctcaggtactctatatcttgagtggagaaatgaagaggttggactaggaggctccatcaagtctcttccaggtttactgttgtctcatgtcttcctgtcttcaagactgtccaggcttcatcagcataaccaaagttacatgtcttttaaaatcaaataatattgggttgtgtacactagagcccaaaggaagaaaaatggagctatgtgaagacagtgcctgtagatgctgaatgaatggatgaatgaatgggcaggcttccctgactctctttaattgttccattagagggtaactttcctagctttggttcctttgataataaaataccatttcatcaatgtcatctctaggagaaggacaatttcaaatcccttagaagaaaagcaatgtatacaaaggaggaggctactgaatttgttgcttcacaaaggagcttagttttaccatggaagccacaatctctatccaagagacatgaagcacacacaaagtgacttttgaatatcattcattggagcaaaatggacttctgaccaacagtatcgatcaattggttaaagtcaccaagatgttttttcctaaaccatctcaccaacattggggcaaataattccagccaagtgcagcagccatacactgttggtgattacttgccctgtggaatttaattagcactagaacccttggcatcaccttcgcaccatgatgaagacacactgtattggatgtgagggcaatctggctgcaacatctgtcaccccattgatggccagggttgattcggctgatctggctggtaggcgggtgtccccttcctccctcaccactccatgtgtgtccctcccaaagctacatgcttggtcaaagaggacgacatccccaatagaggaggaccgatcttcagtcaagggcatacgagtagctgtgctcccctgttagaacccccaagcaagctgtcaagacacactgtattaaaggatgcaagagcaaagatgcctattcttaggtccggtgacatactgctaccctaccaacacaaaatacatataaataactttctgtgtaatatattaagttagatttttgttatattttccaaaccaggaaagacactgttcaaaagaatttggcaaatcacaaacactaacctggattatactttttaattgcaaatttttaggcactgtattagttaaatctacattcaatctacattgaacagaaaattttaccctatcccaaatgactagatcaaatgtatgaaaagatatatttaatgtgaatatagaaataagattttcaacccaaaaggttgataaaataaagtgtttttattttcagtcaggaaaaaaagtcatattaaaggtcactatttttcaaatgactgcaatgctggtattaagccaaagaaatttaaactgagtgttatctgctgggtgggctatctctgttctgtctcaatcagatgctttattcctattacatgttccctgtactacacctgactagcacccccctaacaaattagtcgatatcatgataagaatagtcagatcagttttaataattgcaataattttcagggttcaagagtgtcatacacactcacatatataagtatagattactatatgtgaaaattgttagacagaaagagtaacagtccaaacaccatacacactcatgtgcacacacacaaacatacacgagaaattcaactctgtaagctgcctaaaataatgccacagaaaaagtgcaggtaaaaatgttatgcatttcaactgagataatactgaaaggtgggagaaaggtctgttatactaagtaaaaacttttaagaaatgctacctcaaggcagggggcctagagaaccaagatcagtagtgatccttacacaagaaggaaaggactcctgtagaccagggcttctctggatgattatttattggggggcagaggtgtcctctgcatattaggacatttagcagcacccctggaatagaccctacccatgagatgcttagagcatcctcccagctatagcaaccaaaaatatctccagacattagcaaatgttcccaggggagtagggaggttctaagcctctgttacaggccctggttaagaacctctgccttagacccatggccaccctagttgtgatcccaatccctgggacaccaggctagttcctggcttcagatgcaaagtgagtttgcctacaccaaggaggtcagacctatgtgaacagctcactgcaaagtggagcagcttcccagaccgtttccactctggacttggcaaggaatgagggatctcccaactcaagagttcaccttcgtctagtccaggaaagctgcttacatgtctcaaatcatcttttgaggtctcagtcctttaagccaacaaccaaaggaaagggaaactaccaacagagcaaacacgtcaatcctttaaaaatgaagcagtaaaacaatcttagaatggtacataaagagcttctgggggaagaaaaattaaacagatattgaaagccaccacaatctttcttttttctacatataacttatcatatttttaaatacagacctggtgttatattttattcatgtaattcgttccctacttttttaaaattacattatttagtggctgcatctctgctggttttgtcctaaaaagaggggttcttatatatcaacctcaggtatgttgctcaaattgtagtttagctaatctgtaaaagttaatgatcccacttgtctcatgagggaagcaggatcataaactaggaaaaacaccagaatagtgtggtggttaagaatagctccatccctttcctgccacgtcactctgaacgagttcttctctaaaccatagtctctcattttaaaaaccaagattatgatagtgcctataagccattaggtctgttacaagaacgcataacctaaggatgcaaatcatttagtgcagtgtctggtatacagtaagggttcaagaaatagtatataatataatcattttattataaaaataattatttgcatggaaatgcaaataattggaaatgaccacatataaccagaaatttcattgtatcactctcataaaatatcaccttcctaacaatccaataaattagaagtgagaactagagaaggaagcattctctttgcagaataagatgatattctctgtaaataccacatttctttttattaaaaaggaaaatgaaggaagagtggcgaaacacccttactcaaaccttcatccctttttaccttcctagggtaatagaaccaaggctggagatgttaggtgtgggtacagcaacagccatttcctcttctgtgttttattattcgtggtatggttccatcttgcagcctacacagaacataccgtgctgggaacaagagtgggcttgacattttgctggggcaaatgactctcctcagagctaacaatattcttgggtgagaagtagatctcaaagcaatttctcctctcccaagttctcattcattgagaatttgctgagctcatttattcactcaatgcacattgatcaaggagcatcacatgccaagaattttgcgagaagctggaggtatcttgatgattatggttggggcactcaagccctgagaggaaagccaacattcaccaaagggatgcataattccaaactgaaccaagaaatagttctctaagagtgtaaaacctcccccagactgcagtgtcagcaaagacttccctgagtgacataaaaacagagcagaaagctcaagtgtaaagcttggagtcacatatcccagactcttataaaggcagggtctgattagatcctgccaatgagagtcagttgtgtgaagtttggagctctgtcccaggactttgactcttgactgacagtgcaatgtgagggcagaggaaagagggtgagggagagcagccgtcaacagaaaagacagctgaccagacactcctggttatgaaatcaaagtggtgtttgccttctcttggtctcttagggctgccctggttcttgatcatccccaatctggttctacagaccagatattgggaccccagatattcttacaaaaaattcccttttgcttaaggtagccagaagtggcttctgctgtttgcatccatcaagtgatttccttctggtaacgtgccatatgttgttctccactgcacttatatttaggattatgcatgtctgtctccacaactagactgtcagtttcttgaggactggagattgtctcatttctccctgaacctccaggacctacagtggtgactgactgacacataggaaacactcagtaaatgtgaaatgaatatgatgttgcacatgttcaaaaaattaggaggtttgccaataataagtataaaagctcaactagatgtttaaacactgagaaagagctcaagtgagtcaaaaagtcctccacactttacttcaattttacactaacagggaaatctctatgttctgtatctatcttctcaggtattactataaaaaaatttttttttccagaagaaactcagtaatcccacagtgtccttacccctgaggttatcatcattcagaattttcaccaccatacttccaaataggtaaaatcaacctgctgaagtggaaaggtccatatacaccactcccaggagccaactccattcacccctctctaccttttccaacccacagggcaatccacaaagttcagtaggcagccagtggacttggcttccagagagatcgccatctgtttttctacctttaataaataaagtacctctgctctataaattcacattgtttatgggactaaggcctagaaagaaaatggagatagaatttttgtccaattttaatgggtttaaaaaaattcgtgggtagcaagtttatgctgtaagaatctatgtgttacataacagtctgaatttgatcgggttcaaataatgctaccatgtcctaaaatcctgggcattatacactttccaaatgtacaatgtcatcaggttttatgacatttcctacaaaaactcaatagtcaggtagcacttcatcagttacagtttaaattcaggtatgggaacagaaaactatggctgcagcatggaaaccataccgctcttctgatttcaatgtcacagccccacgggaacatttcactaaacacttttcatacatgtgcatttttgtcccctgctaagagaactccatgtcttggaattacagagtacagccaaaagtatgttagtagggccaaaaatccactctagatgatctctgtcttcccacaaaagcttcatcagagatgctcctccacctggggttttctgtttattcagcctcacttccttcttcaagtgatgaaatgcttagagcatcatgtccatgcctgtctacatggcttatggagcacacaagacttctgagactcagagctctgaaggcaaagctgacagatatgaaatgcaagcctagctttgccagggtaaacgtggccaggaaaggagcatacctagttctactggcatcaaaacagggttgcgaaagagtctatgagaaagaaatattaagtaatactgcatgtctgacattgacatgagcttattattcttccatgccaacacaccctaatccaaagcttatgctattccaatccaagcctgccctaaaacagccaattatgctgaatgcagtctaagctccaaggagtctccagacttaaagacaatgtttcattggcccattcgtttttgtattatttctacattttgagtcagcttctaaatcatatgcatcacttctctagggattatttccctttcacattgcaggtataatagagctcctgtggctttgctacattgccagtggttttatttccttcccaaatgtattggtaaacttggtttaaaaacctgaagctgagcaacctctccaaataaacatgaaacatttccaaacccattatctacatgacttcaacaagtgatatcataatcatgttgccgaaaggagccataatatacaactggttttgttctagaacttccaaactggttcccaaacttttgagtctggctgtggagggaagtttaaaattctgcaaaacatttgcattggcaaaagtggtcatttgtcacttatgcattggaagtgccatcccaaaatattcactgagaaaactgttgtcatttattcctcaagaatgagcgcacttagtctcaacttctgacaaaatgaacaagtgtgatatttttccctaattcactctcacacctggtgtcatcatcctaaaaagtgaaattaaaaaaaggcttattctcttaatttacattaattattttattatatattcctaaagacaaaaaacacttttatctaggctatgtgatcttgggcaagcttaccataagcctcaatattccacaattccttagattaataattgtgcccatctcactaggtagtggtcaaaagtaagtaaacagtgcatgtaacaagcactatttacatgagtaaacagagtagtcagcatacagtgttccatataagcaagttcaataaatgtaagcttttgttattatttgcagccggagattttaaatgaaaaatcttcttctgaatccttagaacatgctccaagacaggctactataaccatctctctgttattcccacgtatcctagacagcccctttgattcaagggtccttagtaatctctcctgagctctcttctaaatttctgtgtcaattagctagtgctacaagaggaagaggatccaatgaccaggaccttgtccatgaagagctctacagaaatgaattaataatatgattcatcaaatcaccaatatcctgagagtttctaacgaatgcagtgtctctacttttaactctttggtaaagcctctataatttggtttgaatctaactttgtttttaaaatgtgacagactctattctgtacatgaatgtaccatttaggctctggctgaccataacagaacaggaagagactcactggctctcagagtttaagaaagattacagaactcacttatgaaaagacaaaatcatggggaatatcctaatagatattagaatgcattgataatctaatcacagcctctgcaccgaaacaaatgaatgccagctactgttgtcatctttgcatagctcggtccttgaatcaaattcacaagaacaagtgctcctggcagtagggggtgagcatgtaacataaccttggccaatcaaatgctcctacccaagactttaactctggagcaagttcatttatccattcattcaacaaatatttattaagcatttagtatcttttgggtactaaacatacgggggaaaagtctgcctttttggaatttacattctagtaatatgaatgaacaatatatatatttaaatatatatttatttatattatataaattttaaaaatacatatacacacaaaaacacatttgtcaaatggttaaaagttctaattaaaaaaataaaactggatgagagaagacagagggcaggaatgtgggtggtcatgcaattttatgcaggatggacaaaaaaggcctgtaacaaagcactatttgaacagagacctgaaagaagcaaaggcatgagccatgtggctatttcgagcagttctgtcaataggaacataatgtgagtcacacaggtaattttaagctttctagtaattacattaaaaaaagtaaaaagaaacaagtgaaattcattttcatttacctgatatgtccaaaatattttcatttcaccatataatcaaactaaaaattgattcacgaaagcgcttccatttttttcataataagtcttccagatctgatgtgcacttcacacttaaagcacacctcagtcaaggccttaatcgctacaagtggctcgtgactaccacaatgggcagcacgggttcagaatgagaatgtccccataaaagctacagtaaatgtcaggtaccaagacagcatgcctcatgtgtctgcagaagaacacaaaggccacagtgactgatgtagtctgagcaaaggggaaggcagtgagacaggaggccagactggccagagggagcccaatcctgcagggtgtcctgggccttccactgttactctgagtgacaatggaagccaatggaggtggggacagctccatggacctctgacctgtgcagctgcacaggtccctatgcttggtttaaggctctacggttaccatcctgaaattctcaattttgggacaggggtgtcatgtttacattatgcaatggacccccaaaattatgtaattggttgtgactggagagtttttatcagagagtgacatgaaccgttttatgcattatgaggattaatccagtttctgtgttaagaataggctgtaggaaacatgacaagaaaaacatctggaatgctgtagatcaacgccaggtgagaaatgatgatagcaggtgacaccaagaacaggggacagttagttccatttgctgcagcagagcacctgacaacatgcctgtggatggcagcatccaggtcagaggctcctgcggcccaccattgatttccacctaatttcctctctggccccctgttcatctgtgagccttgtatcttcccaacacattttattttttttgtaaaagagcagccattggtttctcttcacacccacccttttactaagagaaggcaggatactcaatggccccactaaaactatatacagtagcaaacagaaattctccaaaagaaaatcgggaatgctatcacaaaatcagggtcccctataagggagaaatcgagctgctaaaggaaggaaggaagagccctaacaaggtcaagcatcttctgtgttgcatcactgtggctgggaattattatacattctttccattgatttcaattaagtaatgggtataaaacattacccctgcctcccaaaaatctatatgggcttcacagaataggatctactacagtttatgtgactatcaaatgtatctaaaatacattcaggacccacaaatacattgctaactctcaggaagaaaaaattaacttttgggacctttggttattttagatttgtatctaaatttgtacaattctctctatgtttaagctgctgaataaaaaattatcatcactatttagtttctaggtaatcaaatagaaaattcatcaagcaacgctaatattgacatgatgcaactaccagtaagtgaaacaccagtatgaaaatcagcctattcttcctaaagattcgtaaaagatcacttattttccatgtgctcaaaatttttctaaaatgacaaaacatggatgataccccacttgaaggtcttatgtcagctactcacctttttctgaagaacattgatttttctttccttcacttctaacatatctttcatgtcacgaatttcaccggccagtgtccccttctcttctgtgaggtcctgtagctgttttgtttttttattgaggaaagattctttttcttccagtcgtaatctcagcgcatctacctgaaatcaggaaaaagacagaaggttgtggttttacagaaaggtcatcaataaccatcaattgtgccctttgaggaggcagggcagcagcatgtttactgagcaaggcacaatggaaccactgctcatggcacctcactgccctgcattttaacagcctacatccttcttaaagccctattgtgtgcacatctcaatagtgatactttaaaaaaaaaataagacttctttgaaataagacattatgaaatagtagtaggtttccatgtttgtttccctactacaacatgtttgtctaagcttggaaacaaagcacatcaatactcccatgtctctctgagagtccagggaggataaaatactgctcaagctttgcagcatcgtcctgaaatacggagaacacaatgagccatgccatggacatccagaggaacaagattgacatgtagagaaacactcctaaattagaaaaatacatgttgccaagaggacactcatgctgctggaggaagaaaataagatagaaatgaaacacccatgctccagcctcatgagactgctttccaaatacttttaaagaaaaaaaaagaaaaagacaaagcatacaaaaaaaaattcctccttgtaactcagctctaaaatttaaaaaaaatataattcctgctttcaaatgttgttaataaaaaagaaaatataagttttttttttaatttaacattctgaagcccatgtgcaaagaaaggtctatttctagactactcagattagatcatagaaaaatatcactggggtggtaaaaaagaaatgagacaacaaaaagaatatgaagaccatcagaataccattttgagttaattttctgtagcatttttaaattgtacttttttgatatacaacaccatatttgcaaccatgtttataaatgtacactaatccagtcttaaaatgcaactgtgacaaacactttatttgaaggattattgtccttaattatcgacaatgacagactatgagatttccaagagtcttgttctcagctaaacaatgacattcaataagttactcccaaagcatttactttttttattggatatatatattaaaaagattaggaccctttgccacaattatcttgctgccacttcagcagatactactgttatggtctgaatgtgttgctcaaaattcataaattgaaatcaaatccccaatacaataatattaaaaggtggggcctttaggaggtgattaggtcatgagggcaaagtgcctcatgaatgggactaattgctacataaaagaagcccaaaggaattcattcaccccttccaccatgtgagaacacagcacgatggcaccatatatgaagcattgattgatctctcatcagacaagaaatctgctgatgccttgatcttggactttccagcctctgtaactgtaagacataaatttctgttgtttataagccacccagtctcggtgctttgttctagcagcctgaatgaactaagacaaccaccatgatttattttttctggatcattaaagacaccttaacacttgattgtatgtcaaagccagggttagaacaatccaggaactaactcttcaaggatcagtcctgatccctttggcaaaggatgtatgaagtaactctttgtcagtccccttgatgtgggaaaggaatatgttatgtttactacaacaaatcaaaattaaataagatcatatggaacaggggtccccaacccttggaccagttccggtccagggcctgttaggaaccaggccacccagcaggaggtgagtgtcggtcaagcattaccacttgagctccacctcctgccagatcagcagtgacactagattttcatagaatctaatgaacctagatccctcacatgtgcagttcacaatggggttcactctcctatgacagtctaatgcctgatgatctgaggtggaacaatttcattcctaaaccatcccccacaccccacacctcttcgtctgtggaaaaactgtcttccacaaaactggtcgctggtgccaaaaaggttggggactgctgatatagaaagtgtaaaagacatgtccacaaaatgattttcatagagatgcccacagcaacattgttcataatggatcacacaggaaacaacacaaatgtctatcagtaaatgaatggataaataaaatggtggtgtttttatatggaatattatctatccataaaaaggagtgacctgcagatatacataataacataggtgaatctcaaaagcaccccgagtgaaagaatctagaggatttatggcatgactgtgtttccatttctgtgaaattctaaaagaggtgaaaataatctatgaggttacagaaatgagagcaacagttgcctggggtggaagctgggaagggctgattataaagggacaggagggtgtttttctgttctctaaattgattagggagagtggagaacagttacctggtgtacaaaattgtcaaaactcattgaactgtacattttaataatttatactttgatataattataatttatatttcaataaatttgaaaaatatatgaatacataactaagaattaacaaatatcttacaacaatgtctttcatgaaagagagaggtcaaaacaaaacaaaacaccaacctgggaactaaattaccttataacacaactgggagaatgaagtgggggttggataaggttcccatgggtgatgaggtattgaggtgatgaggtattggggtgatggaaggacttaatcttcaccctccatagcaggaagtcaacagatagtagctataccagcaatcaggaagtagagaagcaagtaggttatttagagatatcaaaataaccgaacaagaagagttaaaagggtttgtcttagggaaaaaaaaaatggaacaggggaagtaaaggattgctgcatctcataacaaaaattttcaaacattttgcttccttatcctataggcaagtaaaatttgaatggaaagaaaaaaaaagaataaagaaatcaaaaacaaaaatgatacaagaatgccataagaaaccaatagaagatatacaaatacccaaaaaacatatgaaaaatgctcaacatcactaatcatcagggaaatgcaaatcaaaactacagtgagaataccaccttatcccaaccagaatagctattcttaaaaagtcaaaaaacaatagatgttggcttggatgtggtggaaaggaaatgcttatacactgctggtgggaatgtaaattagtaaaacctctacggaaaacaacatggagatttctcaaataactaaaagtcaatctactattccatcccactactgggtatctacccaaaaggaaagaagtcattgcatcaaaaagatacctgtatgtgtatgtttatcacagcacaattcacatttgcaaatatatggaatcaacctatgtgcctgtcaaagaataagtagataagagtagataaagtatgataacaaataagatatatatatgataagaatgaaataatgtcttctgcagcaacctggatggaacttcacttaggccatcattctaagtgaagtaactcaggaatggaaaaccaaatactgcatgttctcacttctaagtgggaactaagttctggatacacagatgcatgtgaagtcgtataatggacattggagacttagaagcaggaagggtgtgaggaggatgaggaataaaaaactacctactgggtgcaaggtacactactcaggtgatgcgtacactgaaatcccagacttcaccactatacgatttactcatgtaaccaaaaactacctatacccctaaagatactgaaatttaaaaattaaaaaaaaaaaaaaagaaaagttcagggcagcagagggtggcatttaaaagaaaaaaaaagtcaataggaacaatagaaagaggacacttaggtttttaggactggttctgcttttaactgcctgagaggatcaggacagataactctcatttcccctccccagcctttcagcctcagtttctccatctataaaaccaagaggtgtgaacagatcatatctgacatcttaggatttttaaaggcaggaatccgtttttggtagaatgcgtcagggaaggatgatgatattagcgataaagaaaaattattggagtagaatatccttttcttgctccttgccaagaaaggggtacctaagttgtgtttctaaaggtcaaaggtgacagggaagttgggggagtagagagtttttccagtttctgctccagtgagaaggatgaagctgggaggtccccgtaggggaagggttggtcacagatgtgtggagcccccaagccctaatggccctgactgcattacaagagagagtggacattctgtgactggggaggagaacggcagattcttcaaatagctgatagctgtgccccttctcacataatagccagaaagatacagggcctggaaaggtggagggatactcacgtcctggggatcttcctcttcctaaatgaaaattcatgacaggtgcactaaagatgatgccctacagatgggccacagattctcatgtggcccatttttgtttaaagttaccttcatctaccagcctggcataaaaccactcttctctgtaggttttcattatatctggtgaaaaaatatgatttttgagtttatgcacaaatataggtatttggtggattactggaatattggcagaacatgctgaacactctggattatagcagtggttataaaggggttacaatcaattgtagatatttgcacatgggcttactaggactcagtgtgattctgagaagaaacacatgactgaggtcccatttgccctgcatcctacctatcaaagctggatggtctatatctggactaaaggaaatgcctaatatccaaactgtgatataaataaattacaatatgggaggtagtgagtggtgctggagagagtttagaaaaagacactctgtaatcatgagagagagagtcaagggctcttaaaattatttggtgttgagtgaagaggcagagaaaaatattccatatacccaaacattttaacttttatgtctctacctgatgttggaatgtaatctagactttaaggcttaacatttatagcaccttctcgccatgtgtgatctatcagtgccctgtcgcatcttcccaagcccagaagagataaaaaacaaccctagccatgagaatatttctccagaaacaaaatggagagcgaggatggttgtgatcagcacgttactcaaacacccaaattcaacatggcaggagggagcctgtgccagctgaggtcttctgtttggggggtttattttccatgcactggaaagtgtgtacttaacttcaaaggaatttgggtcgtgcctttcaatcaccttcactctgtctttaaagttttgcactagaaatgggcttcagggtcttctttttttttttttttaagatgaaactttgacatgaaccacaggcaattcacaagcaacattagcccagtgtgcagtaagcaagtatgacatcatctctaaaaccaaatatgaacttccacatggtgcaaaaccacaagcaggcacacaagcctttggatgcaccaaagtttaaatacagggaagataaggcaagaaaaaatgcattctattaaaaattagaatatctagttccaaattaggtatcaatgactgaaattaaagttcccctcactaatattctgactccactcaacagagtacatcacttaaaacagaatcagaaaagcctgaagtctagattatactccaacatcaggtagagacataaagttaaaatgtttaggtatatggaatacctttctctgcctcttcactcaacaccaaataattttaagggcccttgactctctctcttaaactttggcagttgactcaataataaaacttggcaaagcaaagagcaccatcatttcccagaaaaacaaaagaaaattagaactgtatgatatagtccatgcacaaagacccagaaggttgaatttccaatttttacatatgacttaaccacatgggaactagtcatctaatgttaaaactaggacaatctttccattttaggagaattgctcatttccttttgatccatttgtgtgtgtgtgtgtgtgtgtgtgtgtgtgtgtgtgtgtaagagcatgtgacatatgaaaatttaaccttttatctggcagtataaaacataaaacatttgttttcacttcagttccaggtaataacttgaaagaaaagaaccatggcaatgaaattggcaaaacgttgccaaaatcagagttaagcattattaatcttcatgtcagcacccaggaattataaccagttccaatggtgaggtatgtttccagaagttctatacataagacactcgacctttctgccgtattttatgtgcgccttcagaaacggtttcaatgttgtgacaaaacactaagtgctacttgatgtgccataaataatttctaaaaatcaaacagttcatttcaatcttaaaatgactactgcaacacttgagagaaaaaaacacctgagggagaaaaaggggccacttgaaaattttcacagattaaatactacttgcttgacaacgcttcaagaattgaataaacaggctatcacaaagaaaaactttaaaagaaaatgaaactggaacactcacaaaagctcccaatatagttttatttcacattcaaagcttcatttgtttgtttttcctaatcgtagacttgagttaagggtatatttgaatttgattcaacctgcaatcattcaaacaggagacagtttcaaagttggaagtacgcataatgtacacagtctccaaagacacaaacactaaaaataacctaaaatctaaaacttgcttggtagtaacgactagttctcactcacatccaactctcctttcctcctgaaaacaggaaagatcacacttctcaggcgccttttgggaagatgaaacgctgtgttttcttcaggaaatgtaagcagaagtgaggtacatcacttcctgtctgttccataccacactccttttcttcctcagagatcgtagaggctacactttccagatggtggagatacaagatggcagaaccttcctaagtctggatcctcaagtgactgtgagaaacaggttctcccccaagtcctcaatccttaaaacgggttggacttacagtatgatgggttaaatagcttagaaattattacaataaactcgtatgattttgctgcaaaataggcaccttaaaactaaaactgttttttttgtcttagagattgtcatgaatctaaagaattagggctatggtacttcctttcactctttctatatataggaccttcaacttcccttctcctttcatcccaaatccaaagaagggggaaaaaatgacagagggccaaagacagagctaagaggaagaagcagtagaaccttgggggagtagacacgggggttaaagatcaaagccttgggaaaaagagagaaagacagactgaagaggaaagatccccttaagctcatcaacttgagtttcagtttggatagacaagcggctcaggtgggtatgttttgcaacatcctctgcaatgcaaatatatatgttcaactaactcataacaatggcctttcaaatgtcatgaacatttctaaggtattacaaggaaaatggagataataacagtacgtccttcattgagttattttgagtattaaattaaataacacatgtaaagcacttagcatggtacctggcacttagaaaccctcaataaatttttgctattgttattatactttattattctacttttcacagcctctaattcagtgatttatataccgcaggaatgcaataaaggttgctgatcaacagcagccctcaggaagagtggagaaccagcaaataaggttttgtgctctaacatgtactgaggcgttatattgtttgacatttacttaaaaatatttcagcatacactctatggtatgtgtgcagtgtggagggttgtgtgggtgggtggacagatgggtgtattacccaactgggaataagtcctccagagttagttaattagctatgaaagactttaattaaaagctaacattccagagtcagctaccaaaaatacctcagtattctttatatttgatggacaactgaaaattgtcaattaacataatttatgtgaggagtgatttctccctggtgaagtgaatggtatttgagatctgtgcagtggctagaaatgttgcacaggcatgtccagtcttccaagagcaaggtttaagactgtgtgtccaaaataattagatgcaagccacatttgtacttttacattttttaatagccccatttaaaaagtaaaaagaaacattgaaattaattttaataaaatatttaatctattatatctaaaatattattactcaacctgtaatcaatatgaaaaatattgagatactctacattttttgtattgtcttcaaaatctagcttttttttaatacttttagcacatctcaatgaggattagccatatttcaggtgctcaatagccatatgtggctcatggctaccatattggacagtgaaggtctatgactcctgtaagcccaaaagcttcaacccttggaatggaatcctacctaggcttagaatttcaatctcccttgcatattgatgattcagggaggattctggcccaacagcaaacagacggttggctgagccctgtcacaagacatagcatcacactgacttagagagaagctttcatggacatgaagcttccagaaaaacagagagctgaaacttcaaggagtgctcagggaagttgtacagctgtgatgtactacatagaggccaggtggtggggcaggagtactgccttcttcccttctctaaccatcaggggctactgacctctacaaaagaaaatttttgacgaataatcatcaatgaccttgatggctggtaattcagctagcatgaatctttctggattcttgatgaaataagaactcagaataatcactgctttcaaaaactctttcacgtcaatctctaattatagcaaaagttgcctttcagaaaaaaatgtccttcagcagctgcatcatcaaaaactggctctacggatgagggtgtgcccatctcttaccctatgcttggttacatcctcctgctctttaacttctgcagctattttaatttcagatttctctcctgtctgtagttaacctttttataagcagtaaccagaatcacttcttcattcattcaataaatatgaagaatcaattttgtgccaggcaacattctagtgttagggatatagccttttaacaagacagtcaggtttgtgatttattgaaacatacggttgtaaggttggaggtagtggaggtagaacaaataagtattatgtcaatatcatttaataaatacaagttttagcataagagtggagtaaaacagatataaactctaagaacttaaatacttaaataaaagccttgtaatactaaattcaaattggaaatattatgaatacatgatatattttcatattttcttttttttttttttagatctgggtttgttacgtaatggtgaggtttgggtcttctagagtacgcatcacccaaatagtgaacattgtgcccgataggtgatttttcaatgctccctggctccccctacccttcctcttttttttatttctagctttgtccactgtagacctagaaaaaaaactgaccacctaagtagcgatgagaacccaccccaggtgcccaaattgtgatctctaaaccatttttcactaaaacaaatctactttcattgtagaaatgattgattttaggtctaaggcaggatgtgcaggtgagttcagaatgccttgttgaaccagaaagcaaggaagttattaaagaccaatagagtcttgctattggtcaaggatgggacaatttgatgcactttttctttaaaattcgctctgggtgttctatggaaaacaggcactaggggacaggaatggaggccggggacaggtgaggagctgctgcaatgagccagaagggagaaagtggctgtcacaactaggatggaggtggtggagagggggcacgtggctgtgtttgtgatgcattttgagatacagaagacagctggcagaactgaggatttgtatgtgtagggatgaaaggaaggaagatatcaaagaagactcctgggttgctagctggaaaaactcagtagatagtggaattattgcctgtgatgtggaagactggggagaactggacttgaggaaaggaaatcaagagtttaggattaggcatatatagtttgagatggctaggaaacatatgaaaagcaaatggctatatgatttggaagctcccaacacaacagaagctggactggagtctgatctacatgtggatgggcagtcctgtaattacatcaacatttcccctaatgaccaggtaggacaccttctgcacatttacagattcactcctgtttcgatgcagctctctgagaccaaattaacaaaaatgtgtaaggagaggacatcgacattgttgaaaactgagagaaatccccttcctaaaagggcccctgcttttaggtcttttgctataaggtctcttcctctcatagtcatggataacaagagatttggtcatctcaattgagcctttggcctttcaaggcgtctagttaatgtcaatgatgtatttatcctcctgttgatgtctacagtcagtagagtaatactgaatcagagataaaggactatataatcccacttctgtgtgctgacttcatttagcagtcaaaaatttacacacttgacaagagaaaaaaaacctatattatatttaaaaacatttagatagcacaaagaaaaacaataatgattgtataataaagtgcttcataatttacagtacatgtttctcttaggttgtctgttctcatacaatttgaattcaaaaaatagaattcagggatatttagtatcatataaccacatatatcatttaagctgtgcttataaaagttaagttacaatcaccaacttgttaataacacagtcgagattttcaggttgtaaaaatgtgtttgtcatgcctacctgtcaaaaaattatacccaagtcccacatgccacctacttgaagaaaacaatgctgggttgagagtgctttgtatcacctacatgggagaattcatatcacatgtgagttaataattcagccaactttataaacctgttttcatacttaagtttttggctacttcttacactaaaattaggtggttttaagtgactagtccaaagttcaaaatttaatgctcagttcagttccagcaaatttctgaaaacacatgggaattgtaactcatgtgttaatacttaaagttttcgttaataaaacttccaacactaaccttacctcattgaacttacctcactgatttttatgctcactataaaactatagctgtcataatatttttgaattactacaaaaggaagtaagccattccaaagtcaatgttattttgcaacatgatgatagttataaattcaaaatacttaaaaccaatttgcaaagctatcaatcttagtacctcctaacatttataaagcccatcttcaaaacatttgctattacggaaaaaaacaagtttaagaaaataccatgtgtcattcatattgtgctttcccttcaggtaagcacattaaatgtaagcacgaaattgtgttttaacataaaattttaaaatattgatcccgcttagatatgccatgaattttctaaactatcactgaagctccagaacttaaatcacagataatttagtactaagtaataattttgtgatctttaggtcagtgctttttaacaaatccaaacaaataacctccaatgagatatgcctaaagtatttgtaaatgactaacaaattaggcactgtatttgttagggttaaacccatgttttagagtcgtgtctctcaaatactcctggaggatggggacttgtgtttaaggatccagaagtttgctataagagcgttcttatgttgtctgttcttttctatgtcatcttttcttttctatgattatctcaaaagttaaaatgaatttatcctggatcatgtaaataactcttataaatctggatcaggtaaatctctccttgctaatagatttcaatatagcctttgtgtttgcacttaagattgctttggagtgaaatggaaaaaagcacagaacttcttgtttctatgatacattccctccaagtctcaaccacaggacatcatgctaaccatgaaaaccaggggttcatcagcactataaataaaaacagcaatcagcgaggaaactggatcttcacacaacataccactagttcaggcctcctgaactagcacctcagccataccagtttgtaccacattcatatcagtgtaaattcatgcgtggaaaacactatccttctccatattaaattaatatcattaatttagattttattaactttgacattgtattttcatttagtacataatcttgatttggctgcatagttctataagagctataaacatgcttaatcttatgtttgtcactaattaagtaaagtagtaattattacataaaacaatactaggtgtctacaaggttgtttatttgaaaaaaagaagaagaaatgttttctcaactgtgaaaaatactactctaaaataaacagtatttgttctttgaaacttttctgagtgttgtgcaaaagttaagtaggggtgtggaagcagggtgtgtgccatgatggagcagacttgggaaacattgtgggctctagtggtttatggtagacagtagcatactaaaggttctgaaaagtcccacagcaaagatcttctttaaattgatttaacttacctttccccacatctattttttcccaccgaacccgttcttttctaagaacacataataatatccttcagaatatttttaggaaaggctgttctaaagtatctttaagccatcaaatttgtaaggtgtggcatgggtaagaaaggtttgagtgtggcaaaatgggaacacactgctgaaagggactcagaaggccttggctgacagtctgctgatacttttgagatgccctctgtggctaacactgcattaggtggtgcaggaggctcctgcattccccagggcaacctgtgatgtaagtactgcttaaaggtgaaaacagtggagctttcagggctcagagacctagtgtagtagagctatggcttaaagccccatcttctggtccaaaacataccccagcagcccataccctaggttcatttctggctctgctaggacctggggatgggaccttgggggaagctgcttatttctgagggactcagttatcttttgataaaaaaataaaattgagataaaattttgctcaatgacttctaaggactttacctaacctaaatttcatgtcaggaggtgaatgatccagctgtactgtattgaaacatatttaaagctttggtaattaaaacagtttggtagtgatgcaggaagaaaaagacagatcagtccatgaacaataatgagggagtccaaaatagactgacatacacatataaagttagtatatgataaaggtggtagttagattcagtaggggaaacatggattattccattgataatgactgaaaacttactttcatttagaaaaataataacagtgaaactttacctaactctttatgacaaaaataaattcctaataaagagttagatgtaaaaaattaaatcataaaagtgctaaaacagatggggttgggggcagtggctaacgcctataatcccagcactttgggaggccaaggtgggaagactgcttgaggccagaagtttgaggcaagcctgagcaacgtagcaagacctcatttatactaaataaaataaaaaattgtttgggcatggtggtgcagccctatagtcccaactacttgggaggctgaggcaggaggctgcagtgagctatgattgcaccactgctctccagcctatgcaacagagtaggacatgggctcaaaaacaaaaagtattaatatagatatatgaaaaaattttaaaaagaaaatatgggggcccttctttttattcatagggtataggagccctttctaagcaagagaaaaagcctagacaccataaagtaaaagacagataaataagattaaatttaaattgaaactatcttcatggaaaaagacaaacggcaaattgcagaaaatttttgtaaaggcaaaatgtaaaatgcagcgtgtattccagtatgtctaacatgtttccaattgggaaaaaagaaagaacatttgcttgtgtgcacacaggctatttctggaaagatgcataagcaaatgaaaagagtttattaaatgcctccttcatgctcagttaaatgagtgataaaaacaaggattaaatgaacacatttgtcaatttcacttgtaaactaaccaaggaatcccacccaaagattcctatgaggaactaactcagtgtaagagaaatctagttaggcccagagctcccagaaaattaattgattgcctgcatttctagtttagccctttcttgaggacagaaatgctgcaggtggaggaaatggccaggacacactctgcccaggaagaattatccatggtggtacatattatagctgttatgactctttatctagcatattaatacattgtaggaaggcaggaaaagagtaatggctgcaagtcggagctcttgactcctcaaggtcaaatcttaaccttccacttactcaccatggcttagggaaagaaagatacaatctctcaaaactccagtctcctcatccataaaatgagggtaataatagtacagatactatgaggattaattgaaatatgacttttaagatgttttattataaggcactaagagataaagtagagacaatcactgaacagcagctgctgtttaatagtgaaaagtgacataatttatgattaccatgatacattatatattctatcatctacatatgattagtaaatttagtcattagagtatttatgttaatattctagcagttatcattaaaagctaatctcactgacaataatgataacattagctaatgcctaggaggcattttcatgaggcccctcagcatttttgagacagggtgagttcttgttctccattttagaaggcccagagccacatggcttttaagcagcaaagccaagacatcacgctcagaaggaggaaagcaggaaatatctgaacagcataaatagcaaccaaagcagtggagagaatgtggtatgaagcaaaaaaagggtgaatgtactaaaattatgacatgtatcttatcctttctgacatatatagatagatatttatatacaaggtaggtattatttagaagtaaaaacttcgaatctctgagacgtctcctagttataatgatagaagtgtcacttatacatgtaaggcgtttattatgtacatttatatattattacacttacatgtgtgtgtgttgtgtgctattctgcatccagtctaaagtgctccaaacaaaatgtcatcaaatggaaaatccttcaaaatgccaagtgtaaataacaccttccctctatgtattcttatgttgtaatgtttcaacttcagccaaatatttaatactgaaatagttttaacaaatttgctcttcaaaagaatgaaaacatgtatcctatcctcagacattcagaaacatcttttatgcccacaaatgctgaaggaaagaaaggttcactactgaggttccattgtaacacctcccactaaggtgtgtgttgaatttaggaacatactttcacatttaagccaagttgggacttcacatcattgagttttaggaagagcataaatgattctgaaatgggcggtaacaccaaactctgtgcaaatttaccttggccagagcaagtgattgtttctctgttgggacttgttacagcctcttccaacttggaagcattttcatactaaggaacacggagctggaaaaagaactgagctccatgagtaaagaagacaatcactataaaaactaagctggaagcaagaattgccatgatgttaaaaaaattagagtcaacctacatatacttattgctcacttttttttttcttaaaggcagagcaacaatcatccctttgctagtatacatcatggctcctgaaaaatatcacagcacttatagcagtgaacattttggtatggaaaatctgtttcatcctgcgaattttctatttctgtgtgggtttgtgtgtgggtgtgtataaatcaatttactgtgtaagcattgagtcaacaatattctattgtattactcttgaggcagtggtttctttgttcatagtcctacaattttatgagagaaatcataacttaactgctcaaagagtaacaattggtaatgggaagttcccaccgttttcacatctgtaagatgaagaggtggaactcactgatccatttgcaactctgacattctgtgatttttatgatgccattttgttagttcatattatgcaatactgggacccaataaaacacccacaaactaaggggctattgtttctgagcagcctgatatcctatcagcaaacctggtcactaggcatttacccatttaaacagtaaacatttgcagtgcattctaagagggagatacagagagtattttgcatcacatttagccttccaaacagaatatcttggattgcaaacaaaaaatcatgcccctagctttaacaattaccaattttatagggagggggaaaatgtgctgatagcatcctatctagctgaaacacaagaaatacccagaaatgagagcactcatctaaaaggaaatactgtctgagccaaagggggatgaatatgtctagaaactacaaccttctgatgatggataaaccaaatgcatcaagcagagcttgccactctacagcatttcaaatgcaagcaagtttgcgcaaagacaagtaaggatgttttcaggccaaatatattgcccgactcctttataaaccatacgaatagcagaatttgagtcttttaagaagcagtcaccatcaaccaaagtggtctcaatttctactgtagttttagaagtggagcgtgaggaaagacacttcttccctccgagattcttcttgccaggcactttagatcctgccaggaaggacataaatgaccagaaacatgaacaaccacctccacttcatccctaggcattccctatgaggcacaggttttgctgcataaaatatgttcgtgtccatttacattaagcttgaattccttggcctcttatgacatcattgagactggtcattggaaatgtttcaatgagactgactgttcatacctctcataaagtgctctgtttatcatcttagggaatctgcttgtttgtatcacaggtccactccagtctgttggaagcagcttcatagagcctaatgttaggaaggatcctaaggccacatccagacttggtgaaaagatgggcaggatgaagcagtgaggacttctagacacacaagtttggggagccatggcatgcctatattggcccccttgatctagaacacccaaccctgaatcttcacaggtacatgcatggctggctcttcgttcttggactaggcttatgtatcctccaatcttgaaaaattgatttagtacctgtaatgagttgaatggtggtccccaaatagatgtgtccatgttccagaacctgtgaatgtgatcttgtttggataaagtgtctttcaaaatgtgattaagaatctcaaaattagatcatcctggattatctgggtaagccctaaatccaaagatgagtgtccttataaaagacacacacagcagagaagagtagaaggccacgtgaggacaagagaagagactagagctatgcagcccaagtgaaggagcctcctgaagctgaaagagaccaggaggattctcccttagagcctctgtggggtgtgcagattttgcaacaccttgatttctgatttctggtttccagaactgtcagacaataaacttctgttgttttaagccaccaagtttgtggtaatttgttatggctgtcctagaaaacttatacagtatcccctttcatccatccacttaccactaccagctaatgtttattattttttatggggattcaaagaccaatgaaacaccgtccctgcatttcagaggctcttgttctacagggagtgatacgtaaaccaacaactatgggagtgaagcacagaactctcctgaaataatgttgaaagcatcctcagaggatgtaacatgactgtggtccaagagtctccatcaatagagccggaggggaagtacacgggatctccacagtgggcagacaggacaccgaggggccatgtgcgagttgccagatcctaaaactgtgtccaccatagttggtgagcttggatggcatcttttcctgtgggaaaaacagggaatctgtagaaagtgctgttcctggtgaagtaaaggatatgtgaaggtttcttttcctacctcagtcctgctcaagaactcagaggtctaaactccctttcatgaaaacacagactttctactcctgaccttgcatcttgcctttcccccttgccagacacatttgcctgaagtttccttcctccaaaactctttgctacatggaatcccagccttcccaaaagtctttccagagaaccagctctacgagcactcttattggggagaaaaaaaaaggactgaggggaggcagaagacattccaaagtaacataaatttgggaaatgctctttcaggaatttgcaaaatgctctgagaagtccagtttaactttggttaatcagcatttcccaaacctatttcactctaacattgtcttttttgtaacatcttattaatatcctggggaacatactatagaaaatgctgcatttgaataacgttatttttcaaatgtaagtttaatagattatattctatatttggtaggccctccaatatatactgctggcttaactcactgttggaacatttttccctctcctgccaaaaacccaacacctttatcaaaaagcatatccctttaccaatgccctctgatgaccactaagcaagcaagaaccaagcaccccagtccaaggcacagtggtagaccctgggaacatgacatttcccaggtggcatccttgcccttgatagcttacgtgacttcactttatacagcgtgagttaattctacactcaacaaaaccacaaaattaaaagtatgttagaataaccctgctgggaaaagatatttcattttgattgttaacaattctaagtattgtttgcacaaatgggcaaaatatcttacaaaatttgccttcctcatatggcaaatttcatcatattcataagcatccctacgaacatgaaaaaatgaattttctgaaacatctttcctcagaagatcagggatagggcatgctcccatgccattcctttctgtatattccctgtcaccactagttagttgcattaacattattaagttgcaatatattacacacagtacagtaaaagctgtaaaaataagctcttggttatttcatgactacacatgctataagagttattcagaagacggaattacaaggaaaggggcctaaaaactccctctcttacctctaacagttgtcctcaacacagaaattcaggggataatcaaattaaggaggaaaaaaaatcatcctctgtttttctcttcatactacagttctgaatggaaagttattttccaggcaaagatgaatgaaatctgctctttctaatctctgtaaagattgtgaaaataaagatccatttcattggatagagtgatgtcttctctgaaaagcagccatattctgacataatcagagatgagtgggcaggacctgcactctgcggactgcaggctggtgcgcctccagcctgcacctccgtaactcatatcacacctcaggaaaacggacatcacaagaactgtttctgtcactgaggaagataagagcatttacaagttggacaataacaacaatattataacacagaaagagagactgttttccttcaaagaggaaacatccacatacgtgcttcacctgttcctgtaacagatgaggagtttcattctaattcctctttaaaacaatgtaatagtaacacaacctactgctctttattgaatgccaggctaagggcattactgctggggaggtagggagcatcattcctccagtttttagagaagggaagtgagcctcaggaaagtaaaggacttacccatggccccacatccaccgaaaatcaaccgggcctccccagccaacagaatagcccagaaactgaaggacctgaaaaatgtaagtggcagacaaatggaatccaacaactcgggtttcctgatttctaaatccaggtccggagtagccattgtggttttagtgtccctataatatagaggaagtcatccattaaagacggaaatgtactgagtgggaaacattccagcaagaggaaattgggtcactcagagcctcagaggagaatgtcaaggggtttgtgctcagacctgctgagcagatgaaagtggcctatacacaactcagccaaagaaactttgcagcttttccctcatcctctgcaaccggtgttggtgttgggagcataaaaatggattttgattgggctacctttgagaattagactttaaatccagcaagatgtggtactttcaataacaattgttaccagatcttgtcacctggatgttcttacgctcatattttattcatacgttcactggctaacttttccctccctttgcttcacttatgacagagactaaacactggaatcgcaaatcaaatgcaaatggaggtcaggcgagtgacacaagcgctccctccagctgggtgggacggggtggactggcagccacacctcatcccatccccaggggcagccagccacaccttagctcccacccaagactgccagaggaagcccaggcagtgctagggacagagcttcacatcacccaagaaaaactagaaacctacattattacatgaaatgtcatgattttttcattcctggcaacttattttgatatctttaagaaaaaaacaaaaccaaaaacaaagaacacggggtgagaacagaaaactgaatcctggggactggattcaccccacaggtttccagcctagaaaaactctactaaacacagcagagttcagcaatgaggaatatattgagatcattccatttgaaagacagcctagagagcttgttaacagtgttctgttttcctaagaaaaggtttacttaggaatatataattagacaaagaagaaatatgcaattctgtgtcctttctattaatattatgctcttctaaactacaagctaaacaaaaagttaagttgaatttcttcttgaagaaagtgaaggacttagcctgcaaccccaatttcttcttcttgaacccactgatgttgataagtagctggtatatttttgaactttaatagaaaccttgtcaaaaaaagatgtgcattattcactaaaatgatacattaatactacttgcaaaaatgtatttgacaactttttttttgtcaccattgaccaagttccacgctctgttgctgaactctgaggaagcaaacaatggtaaatgagatagtcctatctttatcactgggttagcaggaaggacaactaaataaacatcccaataaatgttggttacctgttaaaataggggagggagagagtcctaaggggatgcaggatgaattagagagagcttcctggaggaagggatattgaagatgagacgaaagagaaaatggtcagggaaggggaaaggataatttgagatgagatgatctcaaattcagatgcaggaaatagcactatggcttagagaatctgaagtgagtttgatatgcctgcagaattcaattggcagggtgaagtggggacagtggagagatgatacagatgaactgggccatgttatggattctgggttttatcttgatggcaataggaagtggcatgatcaaatatgcccgcgagaagaagcactcagcaaggatgtaatggagccaaaagtgtcactctgtgcagagacacaaccttccctcctctctaagagggatgaattcccacttgctgagccagctcccaagctcccctttgttgtgtaagacccaaactatggactaagctagtggttctcaaccaggacaatcttgacgcccagggacatttggcagtctctgtagatatttttggtggtcacaatagggaggcaggagagtgagagtggcatctagtgggtagaatccaaggaagtctccacaacaaagaattatccagcccaaaatttcaataatcccatattgagaaaatctgaaataatttaacaaaaaaactagaagtgtatctatctatctatctatctatctatctatctatctatctatccatccaaactattttttaaaggggcaggaggagagaaggggagagattccaaaaacctacaagaccttggtgtcaagaggagtttgccaggacttagaagaggtgagaagatacagaatagctgagtgttaaagaaggaacctgagataaaaagaaggaatagttggtaggaagttcagcggcactgctagcccagtatcaatgcactgtaaacaaccagtgaatatttgtcaggtgaatgaattaatgaatgaacaaacagatacatcaatgaactggatcttctttaatgagtcaaagtaaagaactgagaccatctttgtcgctatgacttaaatgttactacagactgctatgtcaacatcttagttgtttgttccagcaaatctttgcccagaaaaaaaaaaatcattatttgctccaggaaattcccattgatagacttattggagaaaataatctgctcactttggcaaaccattgtcttatcaatcacagtttattcatcgcaactctcttcaagaccctcactttgctgtgtacaacaaccctacattatcacatcacagactttgaacaattccaattagttctgcctgaaaggcccatcttaaaccacttgaggccaaaccccaaagacctataaacatttcacctctaattttcccttcttagacactgctaagactttgttgaggtggcatgctccctcattggaataaggtataaatttagctgatgatattttggggcattcaacagaatggaattactttttaattacttcggttattgggctatgtgtctttgaatgcgacaggactaggacacattctagatcctgtattttttttttttttaagttacattttagggcctgtctgggattttgaaccaaagctaaagtacccagctgtaccatgtcttaaaatatccccaaagaatttcatccatttatttaaaaatattcctggggtacctgctgtgtcccaggcactgttctggatgttaggaatatcagtgaacaaaatagttttcagtctagtgggagaatggggcagggcagaagaaagacaacaagcgctaaacgtagtaaataattaggttatatagaacgctagaaaatgtcatagagcaagcctggggaatcctgcagttggagggagctgcagttttaaacagggagatcagtgtaagtctccactgagaaggtgacattagagggagaggacttgaaggaggcaagagagtttgcaatgtgaggagctagggggaaagcattccaggtagagggaagagccagcacagaaaaaaaaaacaaagatgggcagatgccaggcatgttggagcaacagcctggaggccacagggttggaatggagtgagtgaggagacaatggctaggagacaaggtcacaaggaaatggggtaaggacagggatgaagaagggttacacagacctgggtgtcactgtgaagactttggttgatatggtcactggagggttttttgttattattgttggtctttttttaagacaggatcttgctctgttgcccaagctagagtacatggtgtgattacagatcactgcaactccaaccaactccaactcctgggctcaagctatcctcccaccttatcctcctgagtagctaggactacaggtgtgcatcaccacacctaagttgttttgtttctatttttttaagagatggggtcttgctacattgcccaggctggtcttgaactcctggcctcaagcaatcctcccacgtcaactttccaaagtgttgggattataggtgtgagccatcatgtccagccccactggagggttcctgagcagaggaaagacagaactagacttacgttttaacaggttcactgtagagaggcagtgggagaagcagggagaagttaggaggcatctgccacaatccagataagaattgactgtgcctacacccctcagtgaggaggatgaacagtagactcattccaggaagagccaaggagatgtctgcacaggttggttgaggggtgtgctagctaaataggcatttaatataacttctagactggtagtctcatgaagaaatcagggtcaatcagacacaagctgtccttattcttaaaacacaacttgaaagtcagaaaaatgggtagaggatctaaacttggcacatgatttcagaaagaatgcacaattcaggacttatgtttctggtacagaaagaaacttgtaaggcatgatttgagttcactgaataagagaagtttttaaaattcctttatgaagatccaaactgtatactaatgttcactataatcttgataggtgtctagtttcttaataaagtaggatcccttttgcactgggggtgggtggggatccttgagaagggcctgcctgttcgctaggcagaaggttcaacaggaagaaccacagtgaagagagccaagctccgcctggcagcacctccagagatacaatagaattacactggccccatggaaaaaggaaaatagatagaagttcacctgtaagcagaatgatccagttatgtattagagctcccttcgtggaggtctgcaactgggaagaaggaaccaaaagtattaatgtttaacgaggacacaacaataagtgtgtttattcttcactgtcctgttgtcctagtgttgaagggggaggggcctttaacttggggttgtctttagggcctttctggactctggggacaaagaaaatagaggaaacataaaaatagcccagaggttaggtacatgttttgttttctggtttacttatttatttttttaaatttgtaatgctgaaaaaatggagagcaaggcagagagaaaagccactttggtcaaagactagccatgagggagtaacagcagccctggggtgttctttgaaaatgggacaagtgttgctagtgtttataaactggcttatatttatcagcattcttgtgctagcaagtcactggaaatatttccagttagtttaagaagaaaagaggatttagtgatttatgtgattccttgggataatgttctttgggatatagaagtaaagattactttttaattactttggctgctggaggtgtttcattgactgtgacctaatcaccacggtgaatcaatcagaggtgatcaggtgttaggcccagccaatcgcagcccttcttaggaccacgtaatgcattcaatacggaaacatgttttattctattggggttgcaaagatgggaggatatgaacgaggatatgatactgggtctgctgatggccctggcatcttccaatatatagcccccaaaaaggaacaaaaggccaagatattgaagggggaaatgaaagaaatgcaatgatggcaatgtttgagtctctggatccagctatgtctaaagtcaatgctatcctgaaatttccaatcacacaaatcattaaatccacttttttttttttttttgctaattttaaaagagttgcagttacttgctagcataagaatgctgactaatgtaaactgaagcccattaagcttcccattccttctttaaaatgaactataaatcctcaaactaaacacaatagtctctgactcaaccaaggggctttgggtcccagtctcagttttcccaggctgcacccttactgacctactctggtcaagccactcacccagtctctgcttcagtttcctcatctgaaaaaatgatgggctctcaaagaccctgtccacctctgatactctgctttcaccctaaaaatgtgcaggcaaccacaagagctaaagcactcggaaactattccccatcaccaaagccacccttctgattttttcattacaccaagacattttacctaaataaaatataataaaacagggaaaactaagtacctatttaaaaagccattgactgaatcttctcaatctaacaaagtaagggaaaaatgtgagacatgaccccatccaaagtagaaagcctaaatagtaactgattcctactgtaatagcaactaggtgaattttttcaaactttcaagaacaaatgttttccatataagatatactactcaacaacagaaaaaaattgttaattgatgctgtcaagaaatcttactatcctgtaaatcaacacacaatctagctatgtacatatataaaatcctccttattagtatggatacaaaagtcctaaataaaactagcatatggaatttaaaatacttagagacaacaccataacaaaaaggctttcacctagggtcctttagcctaagacactttattaacagaaataccacatcaataagcaaagtaagaaaagctagtgagcactttaattgatattaaagtattatttagtaaaatgcaactttcattcctataaacatttttaaagggaaatggaagctctctcaacatgagggaaagtatttccacagcaaagaaccaatatgtcattactcaagaaactccttaggccattcccatagaaaatataagcaaatatttaatgttttgaagtttatcgcagaacaacacacaaaaaatattttcaaagtagaaatagtgacaacaaagggataaagataatattatttgccttaacatataaagaaaatttaaataaccaataattttttataatcttaggaaaaaataatgatctgaatacaaatatatatacacatatctatttcttatacatatttcaaaatgacattacaaaagataaatcacttaggaataaacttaataagcatcataaaaacactgaaaacaggaaaataattgacagtatatcatatttacttaaactaatcaattctccctaagttaatttatagattgaatgtaccctatagatgattctttttaaaaataaagaaaatgtttctagaaatcaactagggggaaatcaggtaagcatgtccaataccattctgaaaaagcaattctggattgaaaggagcaatctcttatctatccagaacataaagtaggagagcctgctgtaggatacaagattaataatcaggctgacatacagtccccaaacagagccaatgatagatgagaaataatatgaagaatgaatcaaaaacagtgaagaaagaccattaaataaattatattaagataaattaaacagaaagaaattaacttaaattcatgctttgtaacatcaaaatagactctttttttaaactttcattttagattcgaggatacatgtgcaggtttgttatataagtaaacttgtgtcacaggggtttgtcatataaattatttcatcgcccaggtactaagcctagtacctaatagttattttttctgctcctctctccctccttccccctcccaccttctaccttcaggtaggccccagcatctgcggttcccctctttgtgttcatgagatctcatcatttaacttgtaagtgagaacatgcggtatttgattttctgttcctgctttagtttgctaaagataatggcctccagctccatccatgttccacaaaagacataatctcattcttttttatggctgcatagtattccatgctgtatatgtaccacattttctttatccaatctgttactgatgggcatttaggttgattccatgtctttgctattgtgaatagtgctgcaatgaacattcacatgcatgagtcttaaaatagactcttgacagatctaatctatcaaggaagtttttttccaaataaagttaaactggttacacgaattatagtccatgcacataacagaatatgatgcagcagtgaaaagcctgaggtcagccatctcttgggtagaatgaattcttgggtgtcctgctaagtaaagaatgtaaaggtacacaactgtggccatgggacacttccaactgcagtgttgaaattgctttgactttgtacatgtattgtacttccaaaaagaacaaataaactataaagaaacaaatgtttaaaaaccaacaacaacaaacatcaaggcgcagagaacaagctgaaattagaagacaggacttatctgatccttggaagaactaaaaaagtgatgacagaaatgactgacaaattcaactgtatgtacagccaaaaacctcatgacaactcacaaaaccaaaatttagaagacaaacaacaaaatgggggtaaatgtctgcattaactaaggaagagttaatatttctaatatgagattacactagacaagaatccaccatataggcaaatcacggcgaaaatatacacagtaaacaaagcatggaaatatattcaaccctgcaatataattaaagttgtaaaaaggcaggatagtgttatgctgaacattttcactttaaaagacccagtactagcaaggctataggaaatttggtatcagtcttttgctgaggtattataataggtacacgagcaccttttaaaaagcaatttcaaagtgcacagaatatgccataaaagtggttataccctttgacccagtaatccaaatgttcaaagatattcccactgcaatactaactatacaagtgaaaaattttagaaatagctgcaatgaacaaaagtagaagtgtggcaagggaaatcatgacacacagtgtgattaagaataaaattaagaggcttataactacatgggcacaagtttaatgacaaaaagttaaatttaaaaactcaaaaccctgaattttggctatattataaatgcaactatatttaatataatgtacatacaacataacaaagtcccaaaggaacatggaaagaattttttaaattctgtcataatgttaaaattatgatggatttaagcattgatatcattagagcatattaacaatacattacaaggggaattataaattatttttggaaaatggcctgtaggcaggattgagacaggtaaatatttttcaaaaatttccccagcatgatatgatacatcaatactggcttatttgattctacatatctaaatggataatcaaagactaatctagaatgagagctagaagaaaaagactttgactgcatctcatgtctgccaaggtcacctctggagtccagaatacacatctgctcttattagggtctctacctgttcatatggaatactcctagttcttttgattgttggcctgatcactgtctcccagatgttttcaagggggtgggggtagggccaccgagggacagtggctcaaggactctaagtctctctccaattgagggcacatgacctctacattcccattatagaccccagaaagttatgtgtgaaggaatgtgtcctggtgtgtccctgaggctgtgttctatgaactcaaatcctgtgcttcagtcccagtgtctttaagagattcactttctaacagccaagaccaattcgtagtttagacaaaaacaagacaagcaatcagctcaataatgcactcaatctctcgctccctctttctctctccctctttctctctctccctctttctctctctctctctcaatctctctccctcaatctctctctccctcaatctctccctctctctccctcaacctctccctctctctctctcagttctatccccccctctctctcaccagctccaagagtgcacctcctcctgcctttggtgttgataatgtcaaaagtatcaaagggcaaaatctgccaaataagggtaaatcagaaaaacagcagctggttcagaaagagaactgtggcactttacggagcagaccacttacagcagcacccacacaagacaaagctcagtaagtcagccatactcattattaaaccatctaagccagggagaaaacgaagatgatggtctgaaattcattcataggatttcaatacaaagctggttttacctaactttacaacagccagtttccactgaaccatgtcacagctccacaagaaaagccaaatggctcattatgtgaaaagttccaatgactgttttttaatgtttagcagcagttgcttggctcggccactgcaacaaatattgctgaactgtttaacttacaagagacatttaaaagcaaaaaagcccaaattctaaatatgcaattcataaaatagcatattttctttaattcattttctcaaagtttacaatatctgtactaattctctgtaactagatatgttctggatacattctcagagaatctgtgcagaataaaaatttgaaacatcttaaaactaactaaaaacatctttctagtatgctgcaaggcaaatgctttttagatgttttgcatttttatgctaaacagtgcagctgcgactgataaaaagcaatcaagctaatttaagtcaatcaactccaggaggttctcatcacttggataaaaatgctctctcactccttagaaaataaataaagatttaacagagtgactgcattttcttgactctgctttcttgccattccaaaggcagcatataaccaagaagtcatgtcaagcaatttttgtcacaagtttaaagcataatgcaaacttttaagtcatatttaattaagtaatcctgggccatagcacatcaacagagaataacaaaccttgagtgagaaaagacagacagacacacacacacacacacacacacacacacacacattggcacacacacataggcacacacttatgaaaggtacaaaattttcattagagagaccatcaattcctcttcagtctttaaggagagtatcacattaaaacaatttagttctggctggttgtcattattaaaaggtgatcctggaatttgaaaaatcactattttaaaattcgtaagttcaggggtaaactgtaaagcagagttcatgcacttcactaagttcatacatatattaggagaaaaccaggagggatggttacaaagtattttactaaaaataaagataaagataatatatgttgaagatttagtgccgaagagaggaggagccagtctaaatttcccatttccaccgggaggtcaacaccacactcctctgatgcctgcaaatatgacttacataagttcaagcagtagccgataaaggcccatcatcagacatattagctacctaggcagaaaagatccatcaaagccatttggtctttcaataagtgatccccaacaggcaatataaaaaaaatcagaaaaagcttatctccctctcacagtgtaaaaccctggccaagttactgagaaattatacatatatctttctcaatctaataggtggggtgttaatatccattctgaaaattaactatctgacagggccgagcatagcagtgctaatttataagagatatcagattctatatcagagccatgtatgaacacaatttttctttattaatttactgaatatagaaagatgggatacattaaggaaaagatgacaacaaatgaaagaaagagctggaacatattactctctaaagcttctatgaaattagtcatgtgaatagtactgaaaagatgaatcaagttttttaatggagtttcagagcagaaaacactaaggagcatcagtccctgctgaccataaagatacctcacgcttgctgttgagcaagaatgtaggaaaataccttcatatagcagccctctatgatttaatgcccacatatggaaattccacacactttgcagtgggtatatgtgtgtgtgtgttctctaggaatgtagaatgttacattaaaagaagaaaactctttctatactcacaatacttctgacaccaaatgtatggggttttcacatgaagcaagtctccaattctttgcagatacaaactgggtatcctaaaattaaactcaattccgacactatctactcagaattagcacagacctcacaggttaaggactcagtcacacaagactgccccccaccctcccacttcagatgccaattgcatgtagtgggtccccaggttacctacacttccatctgacttaattataaatcaggggttcccgtaatcccctcctaagttttggaaatttgctagaatcgctcacatagctcagggaaacatatcacttgtgaatataggcttattactgtcaactgaagaatcataaggttcatatatttagagaggagagctttatttcttgtagagagttgcagcctgcagcctggccatcctgctggctaagaggtgtatcctctggcagaaactaaaagcaagcacttcaagggaggacagggcaaaacaggagttcatgccaaatgggttggctaagtatacatatttaacaggttgcaaaaagagctatgaatattcatgaaggaggcttgcatgcacagtaagcaaacatgcacgttacatacatcccatgttcactttggagtggagacttaacatttaaatgtattaaaattaagctctatatgttaaaaggtgaaacggaggacacaggcatcctgtatgagtagcctctataaaccagccagaggaagtccatggtcagtggtcttctaagaaaaaaggaatgctagtcagttattgtgtaaatcagtggtggagcaaatttttccaaagggctggtttccattcaacccttacgaaagaaagtctaaaggcagttatctagggagtgggtataacaggcatgtctgacctcccatcatgtcatggccaggaactcagtttttaaggtttctctggggttcctttagccaagagggggttccattcagtgagtagggggattaggattttatttttctttcccattataaaggatacaacccaggaacaaacaaatggaagagatgcatagggcaacacaagacaccctcccaccacttcagcatgttcaccagcctgaaactgcccttgcaaagattagaacagtgagaaaattgtaacagtgaaagagatcggacctaaccaactccatcttgcctttaacctccaagctgcctttttcattcccgggtgtagagtaaactaactttgagaagaattgagttgatagtttaattttgaaacaaaaatggtagcccctccctgaaacaaagccttccttgcttggggaccagattgtctttgtaaagccaacaaattagccacaagattagaaatcatggctcaggaatcatgcagccagagacctcaagattcctaacctccccaattccttgtatggataacaacactatgtcaaacctaagattggtgtttaaggtatttttcagaccctgaattctgatggatcagctggtgccactaagaccagtaaattggctcatctggtcttgtgggccccaagaaggaattgacttccagtctcccctttggccagctccacatgcattaaactctctctattgcaattcccctgtcttgatgaattggctctatatgggcagtaggcaagataaacccattgggcagttacaaacccagaagctctctgaaccccaatgtttagggttttgatagcagttccattacataggcatgcctgattcaatcactggccattctccagcccctatcccctcctcgaaggtgagacttggggagggctaaccatagggttggttcctctaggaaccagcccccattcttcaagagtcacgtcattaacataaactcaggtgtagttgaaaagggcttatcacaggtaacaaaggaagctacccttaccctagggctcagaaatgccaaaggttttaagaactctgtaccaaggaccaggatgaaaaccaaatataaatttattattatatcacaaacatatatatcacaggttcttttaattcccagagaaacaattttcttgcattatcaaggacctgagtgtatgaatcatgcctttttttcagtgtttctaatgctctgacatttggagccttgctgaccctccaaacaactaaggactgggagagactgcccctcccagagctagccaattcctagagattacaagggactcaccttttagcatgcctttcatatgcaagccaaccatccagaaccctcaccctaccacctcctgcattaggagcacacactgaaggccaccctccccctgctgtaatccctccagggccaggtacccaacaactaaggacagcccttaggccccatgcagagcccattgagattattcaaacgagctaattctaaaccctgccccatctcttctttccctgggaaactgctataaaggctcttgccatgtttctcctccctctctctgcctcctgaccgaccctagtgctttcctgtatggtcccatgtggcagggtgtgccccttcctcttggaagtggtaatgaactatcttgccagtggcagttgtctcctgatctgttgacctcaccatatctgaataaaaagaaaatcttttttaagacaataagaaatccatattttactctactttaccctagcctaaacaagtatagcccagaagcttggctttagaaatatttatgaccaagggtttgttggctgccatgaaattgtaagttataagggcagatgtacctctggcattgaacctggaagggtcaaacttgtcccccaggtaatgcagagtcaaggcattttcttgagaacagaatagcaagcctttacatcttcctgcaggaggaaatggcaggcatctacagaaggaacaggtgtatgtgcattgggacactaccacatacttgcagtcacatgttccagaaatattttattcaatattcataaagtcaggctcttcacatcttcccacctgtcctcccctttccagacacacaacatcatgagggattccctgagcacacacttcactctctctatctttgctcatgctgtgccctcaacctggaatgccatgccttcttctagccatttttttccatcaggattctattatccttcaaatcctggtttgccactgtaatggggccttcctacatgctccagcctgaaggaattgattcttgcccctcctctctgacacctctttcatgttccttgtctggctcttcctgggggaccatgtttatttctattataaaaaatgtatattaatagtgaagactttattgagtgctctgtatttggcaggcattatgctaaatttttcacctgcatcctattactgaatgcttattctcaccctttaaggaaaatattcttaatcatacctgttttacagttgagaaggttttggaaggttaggcaaattgtccaagaccacagtagtcaaaagataaatcctggatttgaacctggattcctctgacacaaagcctctgctctgaagagatggtgctgccccttcctgagctacatactgcctaggagggtaagactgtctcagtcatttgcaaatgctctcgctgtgcttggctcagtgcttacagtggagagtggatgcttaatggtcactagactgaataaataattctagtcatgtttgaaaattatgaattgcaattgttccttcattgtgctttctcacttatctggtaatatgctattacctggatttccccatgtcaatatgaattttacataatcctccacaggaaaccatttggcctccattctatgtaactagctgctaagacaaagacaacaggttcaagagacatttccatccttagaagatatcctcaacaatcatgaggagcatgagtagagcgcttggccccaaagaacactcgtatgcattgtatccatttcaccccttcctagtcaagtgaccttgcacctgtaaatcaggataagaggactccctcaagggggtgttgtgaaaatagcatgatgtaaggcaggtagagtgtgggcatgaagtttgacacatatagagtgctcagtaagctgttcaaaaggaaggagtaggaagagaaatcatagctacagctcactaaatacacaagaaaaatcacattcgatgagcacctgctctgtaaaaggagttcatccttgtctacactgtattgtcacttcagcatccaatgagctctccaaatgctcaacaacaggctggaggaaggaaaaggcaccatggcaatgagaaccagcttttctaagacacaggggtttagaggtgagcagattttagacagtgaattgactattctgagcagaggaaatgcaaggaagaagccaccccagggagagggaatgggccagcctggccacagggatagctgaagcagcccttttaattattctacctctatgacccaatggccagaatagagaatatgttcagggctttggcattagactggctggagttacaatcctggtctgccacttcagacaatggggcctagagcaagttactcagcttcctcatctgtaaaacaggatggccttatttatagggaccatgctgagcacatgctagacatagagtaaatgctcagttaatggtagtttgttactaatatgagcagggtctataaaatgggatacttctacctcagaggatcattgtgagggttcaaggagatgacacgcaaatctcctagcacagtgcctaaaacaccataggtgagcactaaatgtgaggtatgattgttagtagtgacagtaataatattgatataacatgcacaaagctcagctattacagcaggaatttcctagaaggaaacagcaagaaagaagataatattaagaagaaaaataaatagcaagaacatattatgtgccaggcaccaagctaggtcttttccatgtactaatttgttcctttacacagccttatgcctacgtagtataattcccagttttctaaggaagttcacactaatattccttttcttttttttttttttttttgagacagagtcttgctctgtcgcccaggctggagtgcagtggcgtgatctcggctcactgcaagttccgcctcccgggttcacgccattctcctgcctcagcctcccgagtagctgggactacaggcacccgccaccacgcccggctaattttttgtatttttagtagagacggggtttcaccgtgttaaccaggatggtcttgatctcctgaccttgtgacccacccgcctcggcctcccaaagtgctgggattacaggctcgagccactgtgcccggccacagtaatattcttaagcaaggcttggcaaattgtttttggtaaagggccaggtagtaaatatttttgaccttgcaggatatccagtctcttttgcaacgaattaactctgccattgtaatgcaaaagaatctatagacaatatgttatgaatgggcatggatatgttccaataaaactttatttacaaaagcaagcagcaacaggatatgtcctgcaggccatagtttgttgacctctgctttaaaccattgagattttgaggttgttaccacagcttaacacagaccacactatctgacataattactaccacacttgacaaaggaaatcttgttaaagtgttgcagagaagcaacagcacttttgcatttctctatgagaatatttgttaaaatgggatcatgtgaaattgacttgggttcagattattatttaatctggctaagtcatatctgtgtgatttctatccaccaggaaaaaagtattaactgaacctctggctggaaatgctgtgccatccccttcttccctggtttactccaactcatctttcagatcacagattaagcatcttttcccagtaagcccagcctagaaccaccttttactcttgcatagtgcttagcttccttttctcattataattgttttactgaaattacttgattaatatctttctcttccagagatggaaaactccaggaacactggagccatctctggtttattcactgtggcatccccaatgtctaacccagtgtttgatagacatagttggaactcaataaatatttgttgtaccataaagcaattaagatgaatcattagtagtcacctttcactggtagttcacagcgctgcaatgacccatccaaggtaatgaaatgatatgacagagctataattcaacccaggtttgtcttgatatccaagccttgctcttaaatagaataccccactgcctcccagggatctggagataacaattgtgggaaataaaagtaccaaagaaaagaccatcttagcaaaaaggtagagaagtatggagggagttgagtaattgccttcaaaatgagaatgctcaaaagttttctttggtttactaagatgtttcaagtgatgactaacagatgtcttttgtttggcctgcacactattgcaaaataatttcttaaattagttgccagcattgaaaaaaaagagagagagagagattctacccaaaagtctggatttcctgcttctcttagagtcagaagatctggcaacactgggcctctggttcctaaggggaagcatcagctttcgattgggcgccggctctccagttatgacagttcccgctcagccagtttctctgatttatgaaacccacttggaccctatcacattgatataaaaacccatggattttatggagattcagtggaggcaattttaagggaagaggactatgagctaagtagaatggcaagagagagtgattagcttccttttgaaaagatatccaaagaaaagaagaaaggaatggagagagggaagagagagattgtagtgttgagattagaagccaaaatgaaactattgaggaggtgggaggttttcacctcagctgtaatttttttaagtgtctaaataaacaggggaagtaagaaaaggtcaaaactctataaagcagctcctgacacatgtagtgctgatggagggaatgtccacagaatgattcttgttagaatgatctgatatagtatcctgtgatgcagagggttcaaatatctgaaaagagttaccatgtgcaaaaatcttagtaactatttcattcagaccttccacacctgggagctttgattaagagcagggatcagcaaactacattctatagagaggtccaccattttgtttgccaggccatctgataactgaacttcaggtccattttagagttaatgttggctggccagtaaatttaataatcagaatatgttatatactataaggaaggaagattgcttcagttcctggaggtaaaagtactgataagtctgaaaaggaaaacaaaaatgaccccagaatcatgcagctggaagagcagtgaagtcaggacagccctaatttgaaatcctgcatgattactgtttagacctgtggctttggaatatttactttacctctaggcctctgttttctcacctgtagaatggggatagttctatctattttgcaagattgatataaaaatttactaagacaaaacttagtaaatgtatatctgtatgtctgtatgtatgtttgtatgtctgtagcacatacaagtcactctttctcggttcatcgatctttctgaaataggtgtagaaaggttaactatttgcattaactcgtattgtctttacttttgaaagtattagcaaaatgtataattgtaatacaataaaaacaattagaacactcctggattttcagcaagtacaatgtctttctctaaaacaaagatgtattatttcaaaagtatacatggcttacttgaacctatatacagaaagcatatctattatgagtatccttatgacttaagttatttaagttttttatattaattttcaaaaatacaaatgctccaactctcaaagattaaaagtccaggcattctgtgcagttaaatattttttcttcttaagcaagagtttttacatcttaaggctgaactttgaagatactgtttatcttttgcatgtttaattaaaactcttaaatttaattcagaaagtctcattaaacctatgcctttagaaggttattttagcaaagcttatatgtgtatatatattttaaactaggtgttaatataaacatgggcgttttcttcaagttttttctcaaggaaactacaatgtttgaggcttaccgtgcccaggagtttcaattcctccctgcagcaacagaaaacaaagcaaattgctgccacatgtgcttgacttcaatccacaccaactctatggatcccacctacagctcagccccactccagggcagagacacactactgcacaactggcaactgacaaaggacttcaccaagactattttggctttgccaaaatggatgaaaggtcacatagtaacatagtctggttcttaaaaataagtttgtaatggcagaaacattggaaacaacctgtttatctataggggaatgatgaactaaagcacggtatgtggagtaatgagtagccattgacagggaggcaggtcagtatgcacagatgtagaaggacctctcaggcacaacaagtgcaaaaggcaaattattgtatttcgtatcccatatgatttcattatgttgggaagatcccaacaatatacatataaatccccacacttacatacagcatttaaataatctgaagaatacactccccaatgataatggtggtggcccctggagaaggggtgcaacttcagtgtgtttggaaagatgcaagagggatttattctcggtttaaaattttttgttttaccttaaaaaaattttttttgacaatgcaaatgtagttttgcattactttatgatttaaaaataaatcaaagccatccgcaattccaaagaagtgttctccactataaagaaagaagtctggttgtcttattttggcccattcaggttgtggtgagtagagacatattcagatttcaccaggtaaagagggcttatgagggatcacaggtacccagaaaactgtaggcaataggatggccaggtcttggggagaatgatgactccctttctaatttaccagagcaacgggtagctcaggaaaaatgcccgaatgcccgtaagtcttataatgcaatctccttttgccactgcttctgctgctttagcaacaccctcctgtctctccacttcatgactgttgcttgctcctggattctgctgtctcgtcgcttctgctaagtcccttctcttcacacctctcttaatttctctgctactttatgggctttaagtcttcataccgcaagttcaaccaccccaagaaaacacaaagcatagttgatgaacttatctaccattcaatacacatctcttatctcatttaatccttgaaacagctgttgcccattcagttattccacaacccagtaatttgtcctcgattcctctcttcccaacctcctccatatccaatttcttcccacatcctgacatctgctatagtctgaatgcttatgccacccacccccaaaattcatatgttgaaatattaacctccaaggtgatggtattaggaagtggggccttttagaggtaattaggtcatgagagtggagccctcatgactgggattcatactcttgcaaaagagaccctacagagctagctagcctttctttcatgtgaggacacagcaagaaggtgccatctgtgaaccagaaaactggcactccccagacatggagcctgctaggaccttgatcttggacttcccagcctccaaaactgtgaggaaaaaaaaaaattcttgcttctaagccagaaattaccagtttatggtaatttttttataacagcctaaagggactgtgtagacactatccttccgaaacatataacaaaatcattctcttgtctccatttctacaaccatcactggctacagaccactgtcactcctcaccaggatgtctgcaatggcctcgcagcctctactctggctccacagaggccattcctcacacagcagtcagagtggttggtcttttaagaatgcaaatcagaccatccacccctttgcttaaatacctcctgtggctccccattgtactgtgtctcctctgtaatgccggtcttgacttcctccccaacaggcacattaatcaccagggtttttgtagttctttgtttctgcctttattattgaatttactctctagtgttatttttggttctgggtctatacataaggacgccctaaggacaagggtatgtcgcctaacttacccagggctttctcagccaatttgtattacagataattgttaaagtccattctaactatggccactttgcacatatgaaagttttataaaataagaaagcctatcagaatcaggaagtaccaaactcctaggattgatttaaggattatttgacattacagatggatttggcacctgtaagtgtttaataaatgtgatatgctgctattattttattcttaatgatatataagacttcctgttggcaaaatgtgttaaattgcattaatgccattagtgacttcattctactgatttttccaattacaagcacctaagggaaaaatactttaattatgtcagtcatctgtataaggcatcagtttgccagtaaaaataagaacataagaaatattcctgacttgaattacaaatttcagcttacagaagtataacacccaggataagggtgtacgtaacaatttatctctaaaggactggcacgaagcaccatgaagatgaagacaaatgcaaagctctattcactttttcatagtggtcaatcaatgcaacatcttcctgggttctgaaaaattcccaaaccttgtaaagattctttgatctaaacccacacttacagtagctgaaaggagggaattgagcaaaaccatacaccacagaaggaggaagaaatataagacaagaaggctccattctcaagaaactgagagtcaatttagagaacaattctggaaactcaatgttgagtactgtgctaaggcacagcagacaaaatgattcaggagacatcatctagagatgacgagcaccaacaggtgtctgccaggacataaaaatatgtggagaaatggagatgagaaatatggccaaaaacaaagaaaaaagtgggaaatgagctcatcaggaactcagctatataaattctataactgaacaaaagaaatgttttcaaatcactgtcttattctctgaaatcttacataaattagtgagcatccttatctttttttgctaatctacagtacattaagatatcttgataatgatcttactctattgtatttcatccaacatgtggttttactttgaaattcactttctagagaaaatgagcttccttcttctagactgggatttagataaactcaatttacaaaacatacgttttaacaagtccatattgaatctgcttcagcctggagaaagaataaaagaaaataaaattaacaaggtcttattccctgtatattatctttcataaatcttctctctttctaaaatatgtaggataaatatttaggattccttgaatcaggcttatgttttactcatcagaaacacctagactgtaagattcacggaagactccaagcaggcaaaataaagttttctaaactttatttagaaatctgaactgagagtaaaatagaaattaggttccccagtgactgataccaatgtgggtaaaagagatgatgtcaagcaaaaatcgtgtggccatcatctgtgcctagcagcccaaggcacttccagggaagttatcatgaactgaccctgactaaatggagtgagtcatcagcaggtccctgacatctgccagctgcaaagtcttacagcgactggctagattgaaaaaagatttccgaaagtttcaacataaaaagcccaactgattccacttccctatcagatttccctgggcttgcttctaggtcttttacatccaaattaccctctcataaaaacaaagacttagaaaaactgcaaaaagttaaaatgactctttccttctgaaagtatactttagctgagtcgataaaaggtctgaaatcatctttatggttgccatcatgtttggaataatttagcagcaacaacatctgtataaatgaggacatgaagtcccaaggtaggtgggagacttcctgtggcttatccatgtcaatgggaataaaattcaaagagcccatgcaggcaactaatttacttttatttcatttttaatgttttattatataaatatcaaacatcgacaaaagttgagaaaataatgtaatgaactccatgtacccaattctcaacttcaacaagtatccacttagggctactcctgtttcatctgactgcactctccctccccatccccctgattattttaaataaaatcccagatattacatcatttcatctataaatattttagtataatctttaaagataaggattccttatttttaaaaattccatcttcaaactttagaaaaatttgccaagtttcattttttaaaatggcaacaaaaattttaaaacagagtcatttgtcctactagaatttcccatgatggggagcttgttcactatatgcaaatcaatagaggtgatacatcatgttaacagaatgaagaacataaaccatgtgatcatttaaatagatgcacaaaaagcatttgaagaagtttaacatcccttcatgataaaaactctcaacaaattaggcatagaaggaatggactccaactagtttgatgacatgatcttacatatggaaaccctaaacacctataaacccaacactgtgagaggttgaggcacaaggatcacttgaggccaaaaatttgagatcagccaggcaatacagcaagacctcatttctacagaaataaaaataaattagttgggtgtggtggtatgtagtagtcccagctacttgggaggctgaggcaggaggattgcttgagcccaggagttcaaagctgcaatgagctatgatggtagtactgctctccaacctgggtgacagagtgagatcttgtaagaaaaaaaagaaggaaggaaggaaagaaagaaaagaaagaaggaaaggaaagggaaggaaaggaaaggaaaggaaaggaaaggaaaggaaaggaaaggaaaagaaaggcaaggcaaggcaaggcaaggcaagaagggaagggcagggaagggcagggcagggaagagaagcccaaacactacactaaaaaaccctcagaactaatcaccaaattcagtaaggatgcagggttacaaaatcaatatacaaaaatcagtatcatttatataggctaatggagaactatgtaaaaaagaaatcaagaaaacaatcccatttacaatagctgtaaaaaaatatataaaatacccaggaataacaaatgaggtaaaagattaccacaatgaaaaatataaaacattgctgaaagaaactgaagacgacacaaataaaccaaaagatatcccatgttcacggattggaagaattactattttaaaatctccatactacccaaagctaactacagtctcaatgcaatccctattaaaatatcaatgacattcttcacagaaattgaaaaataatcctaaaatgtgtatggaaccacaacagatcccgaaaagccaaagcaatcaagcaaaaagaacaaagctggaggcatcacaccacttagcttcaaagtatactataaagctatagtaaacaaaccaggctggccgcagtagctcacacctgtaatcccagcactgtgggaggctgaggcaggcagatcacttgaggtcaggagttcaaaaccagcctgcccaatatggcaaaaccctgtccctactaaaaataattagctgggcacggtggcagatgcctgcaatcccagctactcgggaggctgaggcaggagaattgcttgaacccaggaggcagaggttgctatgagccaagatcatgccactgcactccagcctgaatgatagagcaaaactctgtctcaaaagaaaaaaaaaaaaaaaccagcatagtattggcataaaaacagatacatagtccagtggaacaaaacagagagtccagaaacaaatccacacatttgtagccaactgattttcaacaaagatacgaagtatacacaatggggaaaggatagtctcttcaataaatggtactgggaaaactggatatctacatatagaagaaataaattagaccctatctctcaccatatacaaaagttaactcaaaattgtctaaaaactaaaatgtaaaatccccggaggcggaggttgcagtgagctgagatcgcctgcactccagcaagactccatctcaaaaaaataaataaaaataaataaataaatttttaaattttaaaaaaaagatttgtaagtgaatagtgctccaagcaccaacacaagctctcctattcattaggtacttccatgcacttaccctgtttatatgctcaaggtctttgtagggcttgttttacagttcactagactgaatcttctatgaatcaatcctactggaaactcaaggacaaaacaaactccaaacaattcttaagcttattttcaataatcatattatgggtagtaatgttggtatttatttcttgtttatatctgtgtctccagcacctaggaccatgtaggcaatttaaaactgacgcactggagatccaataaaaagcttatcaaaatgatcacctaatacacacgtacacctaatttccacatctaagtgctccatgtctttctcacacacacacatacatacacagggcaaaatgcaaatgtggtttaagtttttccaaattaaatgtttaaaattgatatgtgtccttacccaaatgtactttttgaatttggatgagaatgaggttgaaaagttgacaaatcctcatgccactccctcagtgacacctaggtctctgaacatccccagcagttctgtgacccctcctgatcatttctttccctccttctggtactactcttagaagagctgtcaaagacagtcatcgctgtggagagagctgacccttctggccctggcattgctggggctgggcaaaggagtcacactcagtaaatgaggagttggatcttctcttttccttcacatttgaccagatcttaataaccaaacacagaatctgtcccgtttcaaattagcaactgccaagtagtattgtaggagccagacgttgttctgttatagtcataaggatttaagaaatcatctacgtttgaaaattttaaaaaatgcaataaaataaatttcacagacctcaaggtagaaatgcttgcaataatgccaaactcctaaagttaaaatgatccttaactacacaacttattacctcaagttgtattcctccctttttcttaataagacaaaaggaggaaagtatatgtctgcatggaataaatatctgtatttaatttaagaaagataaaagttcgtatgaaaatgggtgaaaaatccttgcagaagccctgctatttaacttcactcttgacattttggtttgctgtgtaaatatacgtaaagaaacccaactacagcaaatattagcccttttccaggggaatggagggaagtgtgacaaacgtggatccagtgtcaggaaagcataatcacaatgtaaactggttatttccaaatggtgcccctccaaagaaaaagaagggaatggaagtacttaataaattctgttttccataaaattcattttaaaaagagtaaagaatgtgaactcgggggtcagtaagagttttgttggatttccctcctcctaaattctgtcatctcctttttaaagtggccagtcagcttcccacagacatgacagaaatacattctttttcttcctgcaaaccatttaccagtaagtaacacttagcagaggacatgtattttctcacagacgattggctaattggatattgtcgcttccacttgcagcttaatatattatagacaatgactttttcaaacagaagtataaacaaacaaaagcactaatgatccattcattttctttcaaagaaaataaagagctctgactcgatacctctacaccccaaaacaatggacacagattatgaacagatttaatgtagaaattaaagtgattctgttatcttaattacatatttggtcatacaggtcaaataacatcctaatgagctcaaaaagaaggtccaaattcttttgttccactggaaaaataagttgctcaaaatacattgacaatgggctaaggtttggaaagtttttgattaaaaaaggatttttgttggaacacttataatgagatttgagttgcagtaacaatatgaaattgaaagcagaattacatacaaaaagagtactgtaaaatatcattattttagtacaatggaaaataaggtgtttgtggttttactctataaattctgtgttgtctgctcatatgtattccttcttggccttcctctgaatagccattctgatttccaagcccttctgcaccagtactcatttgtggtggggggacccacacaaaaaacatctcctaggctctactttcttcctccattttattggcttttcaggacgaattcatgtacacccatcacattggtgttcagttaccgggcagacaatgaattttcctaatccatttagtgtgctgacagagccatgttcacaatttatagaatttccttttagacatttacgtatttcacagttcattaagattcaaactgaacacctgtgtttataaagtcaaaagcaattttatcctaacaaggtgttaaataaggcgttctctgaaagcctgaacaacaataacaacaacaaaagtactagactcttgacctgtagaacaaaatgatgcctgtagctacctgcaccatcctttaatagtccagaatttgccacagaacaaccataaaaagcttttatgacaaacttgggatgctcccttccatcacatttcaatttctccatcacaggtctttcatgttctgccttaagaaagcaatagcatgaggccactctgcaaagttcacccaggtagctaaaatctgcaaaagagcttaaaaactttagaaggtaaatgtggcccctatagacaattccttcatttgctagatacagggacattttccgcattctaaggctcacaaagcctgaccttgcctcatttgtatgtgaccccaaagttttcacatcattaataaaaagagaatcaaaacaaagcctacagacattaggggaggggaaagtgtgttgtttggcactaccatcatccatactctcaaaatggaaagggaaaaaaataaaatgcacatagacgaggtggtgacccctataacgactatggttcccaacattttttttcctactggtaataaaccattttgcagacctcccaattgtggccaccatgatagttactgttttgcaggtttatgtctttttcttgtagttagaagtgttatcaataaaaatttcaaatgaagcctttcccgtcaaataaaaacattttaaaatgtgaagccaacagcaggattagggaggaaaaatacaaatgacaccagggctttgttttgtatatatatttttcttttaccaagtcccttaattgattagttttaaagacattccttgcaagtcttgaaagtgagataaatgcatcctaaatggcactggggtaatttaacagtcttaaaagttgattttgttgtatgctactaacttttctaaaaagcatcttaattttgaatgcagtgactatgaagggcattaaacaaaaagctatctcagaaaggacatttaaatattatcctttgaaggctgaactgattaaaaaggactttactgcttgccagtcaattatggcaaggggtgaaaaaaacctgaaattattgtttaaaagtaaactggttactaaaggataggagaagaggggtgaggggcgaaagggaaaggttggttaacagatacaaaattacagctagataggaggaataaattctagcgttctgtagcactgtaaggtgaccacagttaacaataatttattgtatactttcaaacagctagagaggatttctaaggttcccaacacaaaaaaatgataaacatttgtggtgacagatatgttaattaccatgaattgatcactacacattgttgacatgtatcaaaatcaccgtaccccataaatatgtacaattattacacgtcaattaaaaaagtaaaagatcacttcttgtaaatcccaccttatatgctatggcaaatactatttccaaccatttaaaaaactcttttgctccaaatgggtcagtcccaatgaataagtagttcttttaagtatttggaatagtttgcaaagccccgtgtgaatgcatacagtcccacagtccctggaggccacaaagcattcccaactccttgtcatggttacctttaatgcccaagagttgtagctttaccaagaactgggggacagagggcccatctcaaggcaaataaactgagaagcaaggccatgtaaaatgtgttcttttctccatgtaacaacattttcattctcaaaagtttggtttttatgattcatcttgcaaactgacagcccaagtctgctctctagtttgtgttatcacactgagtcatctgtgactcagagacagaaaaatgctgccacgggctcagaaaacacctcctcctccaccagcaccttacacaacctccctgaagaaattatcattgctgcttctgttaaaaattcatttaatttgggaggctgaggtaggagaatggtgtgaacccaggaggcggagcttgcagtgagctgagatcacgccactgcactccagcctgggcgacagagcgagactccgtctcaaaaaaaaagcatttaattttttttactataaatgtacgacatgtgcatcatcatagaaaatttaaagatcacctgggtatccaacaatcagagagaacaaagtcatacacagccatccattcttttatttgtttttacatagtgtgcatgcatatatgaatatatgtgtatgtatgtgtatgtttgtatatatataaacgtctttaaacatatttaaggaaataaaaactaaatattatatgataaacttttcttaatatactaggattctaaacttcctgaaaacaataccctccctagagtttgggcaatgaccttcattattatggccatagtgtcactattattatagccataatgttaccacgaggatttaagcctcagagttattcattcttatcccccttcttagccatgtcagagttatgcctagaaagcattcttgaaaattccgtgaactcacctgtcaagacagaattataaaacttgccacaaattttgcctttaagattaaatgaggccagacatggtggctcacgcctgtaatcccagcattttgggaagctgaggcgggcaaattgcttcagcccaggagttcgaaaccagcctgggcaacatggcaaaaccctgtctctactaaaatacaaaaattagctgggtatggtgttgcatgcctataatcccagttagttgggaggctgaggcaggagaattgcttgaacccgagaggcggaggttgcagtgagccgagatcatgccactgcactccagcctgagcgacagagcaagaccccgctgcaaaaaaataataaaataaaataaaacaaagattaaaagagataagtcatcttcctgacatgaagaaagccctcagtccactgggactctcatggaaatcactagattcctagttaaaggcatttggagctgggaacccagacattgccatttacctctgtatgaccttgagcaagttatacatcctctgagcttctatttcatcatcttaaaaataggggcaacaataccaacttcacaagtggtgagtcagttttaaaatatcacatggaaaacactcagctgcatctcctggaactcagtgtagcagccataagacactcagtaataaaattacatttaaaaggctaagactatcagctcttgaaattacggatccccaccttgtccagcaccttgcacagcatagatgcccagtattatcaatattatcaaatattatcaaatgacacctcactgatttggacacattgtgggaagggtctgtgtgacataccaccagctaaagcatttccaagtctatgcaggaactcccgaaataatgaagctagcagaatgcctgcaactccataaatatcatctcttttctcaagaaggagaaccaagttgcttgagtgtgacctcaaagaggatcagctttaatcaaaagatagtctcaatattattagggtaaccaccttagcaatattagccttcaattataagagatacaaatagacactttgaacagttgcatattttagtcttcaagggagcgaaatatctatttcttcgtgtcttctttccttcctttacttatctgcttttaaacaacaaaagaaagatcaagattcggtgtggaattattagtaatcaatgataatgaaatcactgggagtttatggtaccataaatcagttctctaacatatatccacgtgtctaaaagaacgtttgctcaatgatagcagaaaccatatctggcacatagtaggcattcaaaaagtatgtgttaaatgaaaaaatgcatgaagcccagagagcaaagattattaatgtgaagttcttggaaatgctctagagcatctataaactacctgaaattatatacactactgcatgtgaatattagcatgtatgtgcccatgtggattttttttttggtgggggggtttaattgcataagattctcatctgtgttgattatattttttagaagttatgaacccttgctttgcagctgccactatgttgcccttgcctgcataaacacaaaacccctgcattctttgttaatgaacgggttctcaagtgtttactcttagacaagtattatagaatccttctctggcttatttgggacagaaattagcattatgtaccactgtcatataacacatcttggaaaacacatgcaaaaatgttgcctggcagtttgcaaaccatgccgagttggagaaaagtatacttgccagaaatcagaaataaatctctctctttttttttgtttttttttgtttttgtttttgtttttgtttttgtttttgtttttagatggagtctcgctctgtcacccaggctggagtgcagtggcatgatctcaactcatgctcattgcaacttctgcctcccaggttcaagtgattcttgtgcctcagcctcctgaggagctgggactacaggcccgtaccaccacgtccagctaatttttgtattattagtagagatagggtttcacaatgttggtcaggctggtctcaaactcctgaccctaagtgatccccctgcctcggcctctcaaagtgctgggattacaggtgtgagccaccacacctggccagaaataaaaatcttaatttggagatagaacaaaagagatggtcactttcatagtatctttatttgtccatatcattctaagacataaaaaagtgactcaattgaagtatagaagtccgaggtctataaatgcacataccaaaaattcaaaagagacccacaaagtgaaacacagaacagatgtgaagatgacaagtgaagtagagtattcaggtgtgacctgcccaaacatccctgataaacataatagtagtaatgataataataacagcaatggtgataccataatttatagctgtaacccttgactataatcaaagcacttttcacatagatgtatgaggctgatacaatgactgccatttcatagactgtgacatgaaggctcagagaagttcaagtcttgtccacgccacacagttattgaatagggaggctgaggtataaccacacatctcccacttctaaatgctgtgttttgtttgacattttactttagatcacagaataaatgttaggccttaatccttcccagtttatggatatgttgttaattattcactgaaatccagaaaaatcaaggtgctagagaacaccaattcattattttctctactgctgtggaattcatgtgttggtggatggggtaagttggtacaaaggaaacatcaagggcagtagcaaaataagaaacttggccttagagtcctttgaagctattttaaaaagtaaaatgttatgttaagagctatgtggtgtatctctctgtgtatgtaattattattctattgatttattgcacacatgtcagagtgtctgggcatttgtacaagttcaaacaaaccaaccaaagagccaagccacatagccgcaaaccgagacagcttgcctcctacacctcaccccacccttcatcctaccaactcccaaatgcaaattccctggtagcaaaaccttctttacagagatgaaccgttaagccatgacgtctgtcatttatactattctaaaagagcagccaaagccagttgatggcacagatatagcaggactctccccattacaaagagagcccccttctgttttggcaagaactttcaggaatgactcaggaatcaaattgcaaggagctatcacatgtaacctcctttgaggatgagcaccatatcttttttttttttaaccttttattttaggttcacggatacatgtgtgggtttgttgtataggtaaattgtgtttcacaggtttggtgtacagattatttcatatgaatttaaattcagatttttcattgtagggcataatgaaacacaacatatctcatcttctgaatactcacccactaacacaccacacagcaggtagaaagactcttatttacctctgctatcccaaagagtggggaaatcactttaaagtattctacactgctgccaaaaatcctctgcccacaatccaacaattagagcaatttcaacctaaattgctccccctaagagacagacgtaattagataagtttctcctctgtttccatgtacaaagagatcttaaaaggaaaaaaaaggcaaaagaaaattcctcagccgtttccagctgataaaatcagtaatctcatactcccaacttcaaagcagaagacttagaaaatcatctcactttctctgcacacggagaataatttttttctacttcaaagcaccaactctttatttggtcattttaattattgaacatgggacggaagctatccacataatgtcaccactgtctttttcatgaaatatgtataggtctaatttggactacattaatttgagagaggtaaaatacagggaggggaatgagaaaggaaagaggacaaggaatatagcctccatcagtataagatagtgagaagaaaagcctttctgacctggctcctcattcattttctctggagagaaaccatcaagaaacctgactgctggtttgggtaagcagactgccttgcttctcaaattctctcctacccaacaacacacagcaacacaattacactaactttatcggtaatcctggtattattgacaaaatatgggtacaagcagttgctttttgaataatacagtgaagaaaaatgaatgctctagaacagctgtcagcaaactttctccatttagggtaccacagccagagagaagactagctgggcattccaatgcccactcaatcctcttcccacaaaatcacaatgccagaaattggcaaactttctgtaaaaagccagacagtaaatattttcagctttgtgggccatacaatatctattgcaactgctcgactctgctgttgtagcacaaaagcagccaaagacaacatgtagatgaatgggtatggctgtgttccaataatactttatttacaaaagcaggctcagggccagatctggcccacaagccatagttttggttgacccctatttgagacaagtactagatggtagaaatgttctctagctgtgctgtctaatacagcagccactagccacatgtaactgttagtacttgatatgtggctaatgtgactatagaactacagtttgaatttcactggattttaattaattttagtttaaatagccacatgtggctacagtgttaacacacaattctagatactattcactgctgcctcctcaaaggagatagaagccaacttccaatttatagtatagattaaatgtttgccttaaaaaataaaatacccatacctttgcattcacagtggaactatacacaactgaaaatggtatttcttttttttttttttttttttttttttgagacgaagtctcactctgtcacccaggctggagtgcagtggcacgatctccactcactgcaagctctgcctcctgggttcatgccattctcctatctcagcctcccgagtagctgggactacaggcacccgccaccacgcccagctaattttctgtattttttagtagagactgggtttcaccgtgtttgccaggatggtctggatctcctgacctcgtgatccacccgccttggcctcccaaagtgttgggattacaggcgtgagccaccgcgcccagcctgaaaatggtattttttaaatgtgaaatatctacatcattgagaccaaggtgattgtttcgaattgaagcattcaggtagctgcctatcagccaatggtcaaaggtataggggctgagtcaggttcatgctaagacctatccaatccagaaagtattttcttccgcctctggacactgtcgtgcaccttgactgaaagcacagatctactcaacagtcccattaactcctaaggccaatccaaacctccccacagatgctaaaatatatacatgcaaagacacagctcaaagagcccaagagagagcatgcatgttgattagaatgccttctaaagtaatgcacacagcacagtgcctcaacacaaaatcaagattcaccacatttttccctattgcctgctgcatttgataactattttatttacacaataactagcttgtgttttgcatttcttagcagacccaaagatgtaatccaaggaggaaaagcaaggaaataggatagtaacatatttttgttgttcttctaagcatgaataagagataacaaaccaatatttcctttgagaaactcacacaatatcaactttcttcaatgggtaaaagaaattgaagatactccttagtaaacaagaaccctttggaaacatgggtgccagaaggggaacccatacagaggatgcacagcaaagcaaggcagatgacattccagttattttatgatttttgataaaatgaaaccattctagatccaagcccttgacttggatttaccaaatctaaaatgctccgaagtatgaaaaaaagaaattccaagtgtgaaccaaacacctttggtggcacaacttgacacaaactgacaagagtctaattatacagtctttatttatcccacttagtataagaaatttttttaatgcaaaaatatgcatgtgtttgtttatggggtgttgctacaacttcacttgcagtgttacacaatctatacaatgcatctcacctttctgaaagcccaacaaatatgaatttcaaaatacatctggccccaagggttaggataaagggtctttggaggaaagttgttcaggtagggcaatttctatcaattcaatgtctctgctgtctagaatcctgagagagtgccttacctcagtctgaaggatggcagccctctgttctttggcagtaagtgactctttgagcacttcaatgtgttgcttgcaatctgaattttgattgctgagggtttcaagctttgtttgtaaggcaagaagttccgactctttctttgaaagttcctgcttcagctgatcaatctgcaaaacaacaacaaaattgcaagaaattagaaattgctgcccctacactttacattggacaactactgatttctctccatttcagcagccagtgatcaataatccaacaaggcaggccacgaatttgcttaaaaaagatggccttgggaatcacacagtctttgggttctggaggaaaatctgtaaaggtcactgagagtataggaaataggaatggaaaggtcagcagactgccctccatcccactgtggaccaaatttcacaatggaatgaagccttcccagccaaacctactcatctgtgaaaccaccaagtatattaccaccatggtcctgaggagagtcaatagggatctaacatgggtaattaaaccaaggcataactccacagtgcaaataatcattcaagggcatcatttgacaaaagaatcctaaaaaacaagtaagcactggggatcatctttttgcttacattaaatattgagaagatacaaaaagaacataaaatatacgtgaggtatgaggaaaaatgacccaaaaaatccataattcaattcaccaaaaaagatcactagaattacccatgtcctatcccatttctatctcctccccccatttggaaataattaccaccccaaattttgtgtttattatttctttgcttgtcttttaggctgatcatatatttttgcatccataaatatacactatttggttttgcatgtttttaaactttatttgggctacaattttttttcctactttgctttttttcctactcaatcttatgtcctgaagattaaatcacaatgttgtacatagagttcattcattttcactgaagtagagtattccattgtaagacttcaccacaatttatctgcccactctgctgttgatagaaattcggttctgttcttaggttttttgctactataaaaaatgctattctgaacattcttatacatataacctagttcacatagcaataatattctcaagtgtctatctaagatttaaattgctgaaccacatagcatattcatcttcaatttcactagataaaacaaaaatgtatgactcacacctataatcccagcactttgggaggccaaggcaggcagatcacaaggtcaggagttcgagaccagcctggccaatatggtgaaaccccctctccactaaaaatacaaaaattagccagctgtggtggcaggcacctgtattcccagctactcgggaggctgaggcaggagaatcacttgaacctgagaggcagaggttgcagtgagccgagatcacgccactgccctccagcctgggtgacagagggaggctccactcaaaaaacaaaaacaaaaaaatgttttccaaaacagttctgttaatttacatgatcacaagcaccttgcaagtatgccaaccactccacctcttcactaataacttatgtcactggtcttttacacttttgccaatttgatatgcgttgtgcaggtagatgatctgcagagacatcatctacccattccttcattccttcctacttgtacacaaatgtcgctcctcacaactagagctgaagtttatttaccctcttcttgaacctgggctggactgtgacttccttctgccaacaaatgcagcaaaataatcagtatacctgttatagccctagcctacagggggactggcagcttctgcttctacccactggaagccagccaccatgttctagaagctcaaccaccctgtgaccaccatggtgtgaggaagaccataccagacatatggacaggccatgcagaaagacagggaggcctgtggtcatggtggcccctttgtcttgtttcaggcctcaaagggaagaatttcaatgtttcatcattacattttgtgtctgcattggttttttatagacattttattaggcttcgcattattacaactataccaaaagtattttttaatcagtagtgaatttttaacattaccaaacatttttttctatatctcatggtttatcgccatttttcaactttcatatgttattgtaatgaattgcattaatgaaatttttaaccttaatctcccctggcattactatgaaaaactccactcgatcattacatattttttatatgttactggattcagcttgctaatattttgtaaggatcttttatttatgtttatgactgagactggtttataattttcctatcctatgctgtccttgtcaggttttaatatcaatatagccttccgaatgaagtaggaagtgttccttcctttaatgtgtttggaaatggttcctgtgaaattggaattttttttttacactaatgttcattagaaatcaccagcaaaaccattcagagctgttattttctttttccaaagaacattacttactaatccacttttaatggctgcaggaatattcacgtttctatttagctgagtcagtgttgatacatttttttccccaaagaattttttgtttcatctaaattttcacacttatttgcaggaaacgtctaaaaaacccacttatccttatatcaatagcatttatgattatgtcttccttttcatttctaatattctacattattaacctctcttttttcaagttttattttagctttaaccactctttttcctgatgaatctcagtagacacatgtcaagttaagtattcttatcaaggaaccaattttggctatattgattatgcaattacacttttattttctgtttcattcatgtctgctgcttttaaatatttccttccttccactttctttgggcttattctattttcttttcctaactttttaagttggatgtttatactaattttcagccttgtttcattcctaagataatccttcagactataagtcttgatttggttatctttaaatttgcttggtttcttatagtctcttgttctttattcatattttcaatctcttatttagacatattaaacacacttattaatatttcatagtctttttcttataattccaacttttgaagtctttgctttctgattctgctatttattctttctactggctgtcatttatggtggcctgttttcttgcagattttgtgatttttctcctttttttggtactgtgtactagttttttttttttggaactttatctgaaaaaatactttaaggcttatgtggtcctttagagaatttgcctctgccaatacctggggacactaccaaccaagaatgtagctgctttaagctacattatctacctgaagttttccgatcatcttgcacagcacatccatgtaacagccagctgtggttatggattctgagaacaaattttttcatcttttacttggctcaaagctttaaaacagaaaatcttccctggagtcccctagtctaagtgtgaggagggggaatatggtaaggttatttttagtttgcctctgcactagcagtatagctgtctgagatcccagcttcatgtggtggtggtaatagggttcctacaatccctcatcttaagtaggcccagacttctgtcttttttcttcagtgtccttgtggctatgaaaaccagagctcaagttcatctatctgaaaattgccaacaagaataaataacctgatatggtttggttgtgtccccacccaaatctcatcttgaattgtagctcccataattcctacatgtcatgggagggacccagcaggaggtaattgaatcatgggggaggggccagtctttcccatgctgttctcatgatagtgaataaatctcatgagatccgatggttttataaagggcagttcccctgcatacactctcttgcctgctgccatgtaagacatgactttgttcctcatttgccttccaccatgattgtgaggcctccccagccatgtggaattgtgagttcattaaacctctttcctttataaattacccagtcatgggtatgtctttattagcagcatgagaacagactaatacatacataacccatgctctacttatcacacaggcttcctgctatggcttagctttgactcttgaggttctttcttactcaagagctcataagtacattttaaaatatatgtttaaaaatatatttcattcagtattttttgttgctttcagcaagaaaactgacataaacaataacaagctactgacaatattagctgagcatgaacaggagtgagactcccatgttcagaagggttcaggttgcataacttagtagaaaggttgatatgaatggaaatcccatttgcaagaagtcagactatgtcagggaacaaacaagcttcatcttgctagccaaatctaaaggattggtagtggctaaacaaaaaacggtcttgagaaggatcctaagtatgtttaaatattcactgggaaagaatcatgactgcttatcaatgtgccccaggtatatgtgagcaagtgagcactgctcagatatgtgcagtttctgaaacacattatttctttataatttaatgaatcatgagtgtgtggtcatttttatgtggaacaaaagtaagaagttctctctctctcatacataacaagaatatagtataaataaaaacagggaaaatcagaattaggattatctaaaatgataaaagatactaaaatctgttatgatcaacactcttctcaggggggtatggccccaaattatatccagctgtagctgacagcacagtttatagttgattccacatatgaaactgattcatctgaaattgacactcaaaaactttcaactctacacacctaagcaaagatgatgtttatagtgaaaaaaccgattcgtgctaacttctacaaataccacagtagaaagccagtgtcgggtttggtgtattgagagagaaatgaaaaggaaatcaactggatatagacaatagggtttagtcaggaggaagggcatggcagggtctacatacacctcctttagtcaataaaaatagattgataatgataaaactatttcagtctataaatattaaataggcagtggctctaaatagctttcaggcattgctgccataaggtaaattttaaataaatatttatgtagacaataacagaaaagagcctttctaaggggaacatagttacagggtaaaaaaaatcatattctcccataaaaatatcccttttgcttcttttacagccataaattccataaaaatggaaagtgatgcaatcgaacatacatgagaactgaggccagggaaggtctgtctctgtgacagccagaagaaaagccaatcggaattacatcacatgctttatatgaagtccatgtggacatcaggcacacttcatcccgtctgaaaattcttcccccacttacgtctgtgacacaaactacaccctgaaaaaaacactctgccaaggaaaacagcttctttttcactgcagatatggcccttatgtctagaaagtgatatgcttactatcatgaagtttgggttaggaggtttgtaatctatcagaggtttataagaaaatgtgttacaaattcagaataaaggaggagatctaagacagcagatcggcatctttggcaaacactggaaacagagggagcagctaatatagaaatactggaatgagtagatgaaaaatgtgctagactaggaacaaagccttatacagaaaggaaatgccattattctttccctaccagaaaaacaattatgtatttggtatgttccattctccgaggtttaatggagctcctgaaagtaattcatgctttccatggcctccaagattcagctctcacagtttgattcctctaatccttcagtgttggggtaggaattggagtttccaacagacgagagttacacatctgagatctcccagaggctcagttctcagagacaatgttcatgtgccaaaggacttgcaagatgccaggatttctaccctggctgactatgttttgtattcctgcctttgcacaagctgagttttgcaacccatcttctacctttccaaaaatgttatatcatggtttttctatgatgtcatgtttgtaaaagcaattcaggcattcactgacacttaatttaatcaaagaactttcaagagaccctaccaattccaactacctgctctggatcaaaatggaagtgcacacccttccatgtgcctatttaaaatattttctttccctccaatctacatgatttattcattttaatagtaatgcaagcagtattcccaggcttaaatgaggaatcacactcatcactcaaagtagaattgggctgggtgtggtggctcacatctgtaatcccagcactttgggaggctgaggcaggcagatcacttgagatcaggagtttgagaccagcctgaccaacatggtgaaaccccatctctaccaaaaaaatacaaaaaatagctggcatggtggtgtgcacctgtaatcccagctactcaggaggctgggtgggagaattggttgaacctgggaggtagaggctgcagtgagccgagatcgcaccactgcaccccagcctgggtgacagagtgagaccctgcctcaaaacaaacgaacaaaaaaaaccaagtaggggaattaagaaacgtaagtaattaatgataggaaacattagcaacaaatgttatagttcaatccaataagaacattctttcaatggagaaaatattaaaaactgacccttactagtactttttagctaatttttaacaataaaagaggtgtctgcatgacataagaattcatcttatttgtatttcttagaaatccatttttctcattagtcaagttaaatatagcacttattgttatgattattatttggttatacctcttcaataataatgtttatcattataagctagatttttgagccaggtactttaactacactattgcattttaatcttatttagtccatctgaaccatcctgtaaggttggtgctgtcgcccctattttatagaagaatgtgtggtcaagtgactttggtcactcctcaagtcactccctatacagctggcaaaggcaggctggagacttgctggagtctgctttcatcttcagcctgcactctttccacctcactccactactttcctcaaacattcttctgacctgaccacttctggaaccattaaaagtaactagccattaaaagttaaatctaactcaaggattgatggtctctcagacaaacgtgggctaataaaggtcatgacttgctgaagatcatataaatgttttattcacctggacagagtccatgatgaggggcagagtttacaaatttcatgacattttcagctgtagaagtggcttgaacaatctcccattgtggaataacagagtcgagggaaaagtttaagccaaaacaataatttcccccaaacttcttgagttcactcatatctgtgcctctggtcttcattttcagaatgatttgggcactgtctgcaggtcaccctagtactgtgcttgccgaacctcggcttaactctctgagagggagggactgcaagaaagaaaccagaggaaggactgcgcagggaaacttattctaaactttgaggcagtccctggttacattcaaatccactggacagtcccctcatatctccactccttgatccacgttttcagcacaatctcaacatctagttagagatggaaagttgacagaagtatgaatagttttgtgttttttccttgtgtatacatgcttgcatacacacacacacacgcacacacgttgtgatgaagtaaacactggataaatataatttcctccctataatttgcaaactcagcaaggagtatgcacatatttcacaactgataaaaatcatttacacatttttctctcctctcccactgctttctcacagaggtctgcattactctaactctgctgcatttcataaagcaacaaacaaaattaaaacctagaacaagagaacaggcatatttaagagcaagtggtagaaaaagaaaaaagaaaacaaatttttttaattggtgtacttattattttcagaagcaaaatgatttaaacagaggaacagataaaagcatctcacagtctcaaaagacctatttgggctattcgtaaatttaataattatgcatatgtaaaaataataaatattcaggtgcttggtccatttaaagccacaaatttatttttgaaaaaatacaatccaaaatctttaaaactgacaataacaatataaactaatagagcaggttactctagaatattttataaagattcctagcaatagataacaataataacatgaataccactgtcaacaacaatgcctgccattcaatggatacttaatcagacaagggactaagggctttaaatgaataatctcctggaatcatcagaccaacccaatgacgtaggtatttttcttatccctatttcacggataaagaaactgaggcttagggaagttgaataatttaactaaagagcagcattgggactcaaaactatttatgtcttaaacactatgctaaaaccaaaatagcttaataactttttttttttgagatgtagtcttgctctgtcacccaggctggagtgcagtggtaccatcttggctcactgcaacctctacctcccaggttcaagtgattctcctgcctcagcctcctgagtagctgggattacaggtgcatgtcaccatgcctggctaatttttgtgcttttttgtagagacagggtttcaccacgttagccaggccggtctcgaactcctgacctcagctgatctgcctgcctcagcctcccaacctaataacatttaaatgagttaaactggcttgtaatcacaaatattttgagacaatcaccttctaggagaggcaagaaatttgacaacgatagcaacttcaaaaaaaatagcaaacttacatgatggtggaaatttggaagagagtggactataaatatgttaattcccaaggaagaggaataccaaaggaactcctaattaaagcctgaacctctcagtaaggaaaattccatcaaaggttttccctgattgttttttggaatctatatgtctgaactaaaaatcttccgcattctactttgttgtccatatattaaataatatcacataaagcatattatatggagtatttggaaaaagtatgtatgtaaactgtaactttctagtcacattaagaacataaaagtttataaccctggaccgtaccttggtcttcataaacttggagtgacttttgtaaacctcaatttgtttgatctcttcttcgcggtcctcagtgttcagcacaccattggcttttaacatctggatctcatcctcaagatcccttatgtttcgttccaatgaagcgatttttgtgtcctgttggtaaagaagaaaagaaaaagaaaaataaagaataaaaattatttttaagatcatcaaaacagaatttaagaaagtaattttggtagtgctgtcacatattaaccatggtatagacagccctgaatttaggacaacttattttttttcacagctgagggtcatttgtgagatgatagtttaagctcccaatcaagaccatgtgtcaatacaatacagagaattatctagatatgtttatctaatatctgggaatcaaattaccaaagcaacagtgataaaagtaatctaagtgttaaaaaacaaaacagaacaccatttaagtggacagattttaatctgggatatagtttacctgtgtatatttttgaatctacttataaacacaaaaacagtttatgtgtatattttatggctggttttataaggcatgtttggaatttgactctgagagagaaagaaattcaaatctactaatgggaaaaaggattctcatctaaaatacagacgtaagtgaaactaaataactgaatcttgacttggtatgactgatacactaaatattgaaaatttatagtgattggaaataatacatcacaatgtcataatttatttggcgagcagtcaggtccctacgtaacaaaaaacatgactaccttgcagggcagttcaacctattgatttatggagccaacaactagaaatattacactcagatgtggaattaattgggaaaaaattaccaatgacagactctatacacaaggtagagcattagaaacaatgcattagaaagtagagaagagagagctcttatagggtaaccaaaacaaaacaaaaaaaatgacgaaaaatttttccacaacagtaagtattaggcttcaatcggtctttgaaatgaaagtttgacacatcgaaaactgacttcaagttttctcagtgtcccatctgcctgccattttactgcacagagttaaggagctcatattaaatgtataactgaatgctaatacagaacaatctatcaacttttttaaccaattcattttctcagaatcaaaaagactaagaactccaaaagtaaagacaatgaataggctattctatttataagtaactcatttttaaaaaccttgcaacaaatgtgtctgtcctgattttgtggctattgtctactttattttcctataatctatgcccagtggtatatctcctatggcaatatagtaattatcattgttattatcattaacattgtcatcatgttaaaaggaggaaaagaaggagcagtaaatttatgcaactctattatgtaccaagaactgagtgctctaagttctgtagatacttttattaattctcagaaaaacttcaagaagatgaaataaaaagattttgaaaattccaagattattaggaaatggaacattctgtagtatttcattttcctttaaaaataatacctattgtattttttcagttataaaagcaatatactttgaattcatagaaaatggagaaaacctctaatcctactgtctagaaataaccaccattaatgttttcatgtatattctgccagtatttttctatttagatgccatttctggaaatattgtatactaccagtttaaattctgaaaagtgttatggactgaatgttgagttccccagaaatatatatgttgaagctctaaccctcaatgtgatggtatttggagatggggcctttggtgggtaattaggattagatgaggctaggagagtagggccctcagaatgggattagagcccttataagaagagacaccaggaagctgctcactctcgctctctctaccaagaaaggacatggggagaaggcagctatctataagccaggaagagagccctcaccagaaccttatcatgctggcaccctaatctcggccttctagcctccagaactgtgagaaaaacaaatctccattattgaagtcacccagtctatagtactttgctaagtcagacaagctcacaaacataggttcaagcaattttcatgcctcagcctcccgagtagctgggattaccagcctgcgccaccaagtacaactaattcttgtatttttagtagtgacggggtttcaccatgttggccaggctactctcgaactcctgacctcaagtgatccacccacctcagcctcccaaagtgttgggattaaaagtgtgaaccattgtgcccagccaatatttctgttcttatataacaagtcagtttcaagggcaaaagagctcatatctcacatcatgagcacagggaaaagtaggtaggagaatatcattaggattcaaaggaaaactgacacaaaaaatacagatatatcagatggttttgggttgtgcccaagaagatattcaaaacgccaaaccagagaaggacagagggaatataagcatgaaaataaaaagcaagtaaaatggctggcatgtctaccgcttttcaactgcatcagtccaaagaatttagagggaaggaattttatcattttcttttttaaaaatcgctaacactaagatacatgactaaaacctaatctatgtaaggagtactatggaagtccatatcaagtcctgatgtggctgaatgtgacatacggatgttgagatgctaaatgcacatggctcagaaactcgacgcgctaatctggaatagagaaaaaaaatacatatatgaagacatatgttgtaacttccagaaaagtggagtttcagaaagtaaagcaacattttacgccctaatcgccaaagagctttcttcatctgaacatttttacaagttatttatgactgatattttaaaacaatatatgtagtgattttcaaacacatatcttgattatatttcacaaataaacaagctctggaagcagataatcgtgggccttccttagagacggggaaagtgaaatataatgtagagtagcttttcccaaagttcacagaacccaaatgctccatgaaaaggggattgcagggtcaagtatgtttgagaaatgcttgttaggaattttcaatgcgcattaacataaatggctctggaaagtcctgaagcaaaatattctatttaattttatttatcacagtattactgcctctagaagtcaattcctgaaaaaaaatttaggcttgtaatgatcacattaagctctgggtaatattactaaattgaagagtcaaaacaacaatttggattcttcaagggaaaacttgccacaatcatccccaatttaaaatgaaggggggggggcgctaaatatctagatcagcctgccagcttctgtcactcaaaagtggtttactgagctcctgttctaagcccagcacttaagacaacatcagtgaaagaacagacatggacccccatactcctggaacttagcacctcacgtctcaggcaatagttttcaaacagtctcgagatagggcaaccatgaaattgttttgtctttatattatattttggttatggattgtaaagatgtagaaaaaaattttcagggaaaaaataaacatctaaacaatgtttgcttcagttaggaaaaaagatctcaattgagtgtctcttttcaatcatttctttctacacattcataaaataatacttataaaaatttgatgcataaattgcagatcatagcttctaattaaagattcatacccaagactattttacatctaccatctcaaaaaatgcaaaataggtatttgatgggcaactaataaataaaacactggaattgaaccccagaagccatttacccactaggcccaccgcactaatgtctaagccagccttaaatactagcactagcccatgacggctatagttatagaaatgaggatgaaagtgggatgggaagattgaaataagtttatttcttccttttctctctctttttttaaatctatctctagatttctctagaacatgtgtgctatagattaatagtaaacttagacaaggagttctctcattcattcattaattcaacaaatacatagggcacctattgggaaccagtcactttgccaggtgagtaagataccaggtagatctcaagaagatccatgggcatccttccctctctaacatgaaggacagcctggatccatgctactcaaagtgtggtcacagatcagcggcactgacatcacctgggagctttttccacttgcaaaatctcaggccccaactcagaactattgaatccaaatccatattttcacaagatcctcgggtgattcgggtgttctaaatgactgtacatgtccagaagacacaagggccaagactgaccaatgcagaagacactagggtaactctattttccaaatacatttagaaaaacatgaatctagtttcaagagccatccaacttaacattaagtgtacagcaaccctgggagtaaattttctggagtatctttgctagtcaggatgccattagtactctttttgtgttttcaaacagtatgttccccttaaacagcaagaaacagatttcaatccctctccaggaactgtgaatactgaaatggtgagtgggtggaacatcaaaaagaagcaatatcatttagtcacaaaaagtaacaattatattattgctgagtgtcacaatgtgctttccttttaaataccgtgagaattactggtttcattttaatatcaggccaagaaagaagacataagcagtttttacagagcattgaattcactgtgatcacatattggtctacggacattgatcaacaaacttagggccaatatggtttttaaaagatgtgatctaatgttcaggaaacatacctacataattatattacactttatttagaataaaatttgaaactgttattactggataccacagaggctcttaacagcttaactttaaaaaatcatctagtcatagctgcaaacacaactgagcagccctggatcttaggctacctgagtaaggccctgccttgggaaggatttactgtgtgggatgaccgtggttatatgagcccaagttagacactccagaaagaagttgacttaggcctaagacatattagtaaaaagaacgaataccaaaaaaatcaaaaactcgccttcttgggccttgtcaaactataaaaggtgatgacctagattagaaaatgacatgagaattagatggtatctaattctttatggcaaaatgtacaagcacagaaaaggttggactagatcaaatgaaaagcaactagggtgctttgatgtttcttttcctggtcttatttgcctgcttctgactcattcttcatgaaacccatgcccttggaacacatccttcctgtcatcctgtctctgtgcatattactaaggactcatgagcagatgtgtctctagtggttcttgcttgacactgtgtgatctttgaagttatgatctccatatattaatttgttcttgttgttaatggactcagctctaagaaaaagagctaaatctaaagcaatccagacagaccgcacatgaagataaaacatctgacctttacagagtcacaaacctggatgcaaatcctagttcaggcttttacaataagactatgctcctgagtatgttaagaaaattacaagtgaggtataatgcatacaaagtgcctatcacagagcctaccctaagagagtgaaaagttgtcattattatcataagccaaaaacaatgtagtaagtccctactaattccccagttgttacttacacaattagaagacagcttccatttttatttcatcctgttaaactttctgagcatgttcctaaccttgctaatcctataacctaagtttactacaagaattaaatgagtggctacatggaagtttccagaataacagctaaaacacagtagtgctcaataaatgttagcgtccctcttgtttccagctatcgcacatatctattacttttttggtctgcccagcttcctttccttttgggaactgcatcttcgcaacatccccatggttttaatagagttttaaattgtgtggccctgcccagagacaggtaccatgggtcttctgaacacaatgattgattcaggggtaaacttttaactctaggaaggccaatcagagttcttttaggggactaacattaatccagaagagaaaagatctctctcttattttctgagtaaggaaaatgaaaaaaaaaaaaaaaagaaaataaccgcatgactggatgtggccttctttgatatcatgtattgagaacctatctgaatgattgggcccttataacatcatttgaacagctatatatagctacatttgaaccatccactctccagaataccaaatatgagagtaagttttctgttacctataacagaaaaaatataatgcacaagtgatagcgtgaaaggtaatgccaaaatatgtaatgttctataagtctatatatagagaagtcaggaatgggtaagattgccatagcagagtcaagaaatctccagaaggcacaggagcctaacgtggggtttggagatgaataaaaataatattatcacagagaagatgaaattctttccagttagaagtaataatacatacaaaatcaagagcactcagcatgtgcccaggatataatatttaataaatgtaagtttaaagaaaaacagaatgaatacagagcatgtatgtatcaaggaagagtagaatacagaattgttcaaataatatagatcatgtttagctgctgaggagttggaaatgaaaggaaggtgctgcagaatgataatcagtcttcagaatcaagctaggaatttgtactaggttctgaaagcgagtcatatactggtaaataagaaggcaacaagatagtctttgggcagttagtaataaaaccagatgccgaaatgaaatttgaaaactgtggagacgacaaaaccatcacttagtggtgaaagaattctcagacatagttgagaatcaaggatagagaaaagggtagaagaatcaccaaaagaaagaggggcaaaaatcatggaaattatggaaaagtcctagaaaatgagtgaatagttttaagaaggaagaggagtcaaaggtttgaagagcctaaagactaagaaaaaagttaagatggcattggtgacatgagggtagtttcatcggagttgtgttgccataattggaaactgaaccccagtgttttaaatcccatggagccaggagtgattcccgagtcactcaacaaccagtatggaacagactcagatccccacaagacggacacctcctgaagcactggaaccaggtctgggaagtcactgcagggccaaggattaactctttagtagctgaatttggggacccctaggtaaggggtggagttgggtgcagggtactctgagggtttggggtagctgtagaagtgttgcaatattttagcaaccaatgtagctgtacctgtgcctctcatctgagtattggccctgcaaagaaaactgcttcagttaatgtcaagagctttctacatccctagtgcatggaagggagcactggctgattaaaaatcatttccatgtgcctgtaacacacactaaagcaaaggttccctaatgccaacctgaacactaactgcatcaaaatcatctagagagtgagcaaaaaactactgatgacttagtttcacccaaggacattctcttttggaggattggggaacacaaaaatccatatttatttgtaagctcctcagcttgggggtaagaaaacaaacaacaacaaaaaaacaatagctgctatgtattgattacctacacaagcactgtgctaggaaattctcatttaatattccccataatcctatgaattaaggatttattttacccatttaacaggtcagaagacttacagatggtaaataacttgcccaaggtttccccctgggtaaactggaatcgttccctcaatagataggcctgccttgaatagaagacaggaggccacatattgggaccttgctgtccacaggccaacctcagaagggactggcttcagagaatgtatgctattctggttctttcttccacagtaattttagcctctaaagatcaccgagcaaggtcaaaagaaaaaagtaaagaggctggggagagaggaaagggaggaaaaaattttcagcaactgcttccagatgagtgggcagtccctccatgtgtgcagggccatcccctcaacaatgggttgcatgtcatctttcatgtacatctaaatggaaagagggtttgaattccagctgcccatcctgagaatgccagcaattcagggaatactactttgcaacacagtgaatgcattttagggagcctaaaaagatggacatctgaccactccatttctcttccagtgttctttaggaaaagattgagtgaggaagctctctctccttgttagccttctagcaagctgaacttgctcttcccgttccttttaacccacttcctggttgggtttggtgtctcctcttagaatctccgaaacataccacagatcattctacattcaaccagtttgtctcatggaaaaaaaaaaaaaagcaacaggcagcagtggaattcaggccaccccaagtcaccaatgtggcctgatggatgtggaaactggaccatgcctcagggatgaggcatgtgatggttggtatgctgtcattactgaaacctgaaaggggaagttcacatgaggcctgtggttgacttctcaaccctgctggcaggggcacacgccagtaaggaaattgcaatccctaaataaacggtaggctgggaacctgagcaccagcaagggagagggcagggactgctggcctgggcagggctggccaagatggagcaaacaaagctaagatttaaactttgcaagaatgtcatgtcaattcagactccccaggagggccccctgagagtccaaattgccagtcatcaagcctcagacttggcagaatttttaaagtaggacagttagtccaatcccttcatttgtcagataagaagagtgagagccagtggggacaagtgacttgccaaatgcccaatagccagaaagctaagttcctaggtcatttattatcccatagacctcctgagacttgctattttttctccactgttttctcctttcaaagacacttttaaagtcttttcaacatgcaaactatgtgtgtattcagagctaagactctctctgcctaaaataggcttatttagttccttctctctggtggtccttgctcaaaggcacaacctcttttttacagataaaactcaattttcaaactcaaagggaagagatggagaggcaaaggattccttgatcctctattatgtgccaggattttcccatgccttaactcattttaatccccaccacaacccgtacaggctagtatcatggacccatttcccagatgggaaagctgaagcatagagaagcagtaagcagcaagcaaaattctcaatttccataaataacctaaccttctcctctttggaaccttctcagttcagaaaaacaaaaaaaaaaccaagaatttaaaaaatagggcattttcaagatttctgattatggcttttcttttaacaaacttgttttttttcaaaataataattcctgatcatttctatgtttagaaaaaagcacattattgaaaacatgaaaatttaggggagtgatatggtttggatccgtgtccccacccaaatctcatgttcaattgtaatccccaatgttggaggtggggcctgcaaggaggtgactggatcatggaggcagtttctcatgaatggtttagcaccatatgctggatgctgtcctcacaatagtgagtgaattctcatgagatcgagtcatttaaaagtgtgtggcacccccccaccccacctgttttgtgcttttactctggccatctgactgtgactcctccctcttcaacttccaccataattgtaagtttcctgaggcctcctcagaagccaagcaaatgccagcatcatgcttcctctacagcctgcaaaactgtgagccaattaaaccttttttctttataaattagccagtctttggtatttcattatagaaatgtgagaatggaataatatgggaggaaagaagaggaaaaaaatcctttataatctctcttcccagaacaaatgtcaacattttagtacattttccccgaagttgttattctacattgataaatataacctttttacacattaagaatactaaacctctaaactactataaactttaaaaatacatttcatagttggttattttgcgctttttatcaacttttattttagatttagggagtatatgtacaggtttgttactcgggtatactgcaagatgctgaggtttggggtataaatgatcccataacccaggcattaagcatagtactcaatagttattcaacctttgtccccttgcctccttcctccctagtagtccccagtttctattgttgccatctttatgtccatgagtacttgatgtttaactcccacttataagtgagaacgtgcagtatttggttttctgttaatgtgttaattcacttaggataatggcctccagctgcatccatgttgctgcaaaggacatggtttcattcttttttatggctgtatatagtatcccatggcgtatacatactaagcgttcttcatctagtacaccattaatgggcacctaggttgattgcatgtctttgctatggtgaatactgttgcgatgaacatttaagtgtatgtgtctttttggtaaaacaatttacattcctttgggtaatgggattgctgggtcaaatagtagttatcttttaaattctttgagaaatctccaaactgctttccacagaggctgacctaatttgtattaccaccaacagtgtataagcgtttccatttctccacaacctcactagcatctgttgtgctttgactttttaataatagccatcctgattggtgtaagatggcttctcactgtggtttttatttgcttctctctgatgattatgtttgttggacacttgcatgtcttctttcgagaagtgtctgttcatgtcttttgcctaatttttcatggagttatttgtttttctgcttgttcaatgtttaagttcctgatagattctggatattagatctttgctggatgtgcagtttgcaaatattttctcccattctgtagattgtttgtttcctctgttaatagtttcttcagctaagcagaagaactgtagtttaattaggtcccacttgtcaatttttggttttgttgcaattgattctgaggacttagtcataaatcctttcacaaggccaatgtccagcatggtgtttcctagattttcttctgggattcttagagtttgaggtcttacatttaaatatttaatccatcttgaattaagctttatacatatagtgaaatgtaagtgtctagtttcattcttctgcatatggctagccagttatcccagcaccatttattaaataggaagttgtttccccattatttacctttgtcaatttttcaaagatcagatggcaatagatgtgtgtatttatttctgggttctctattctattccactggtctatgtgtctgtttttataccaatactatgctgttttgtttattgtagccttatagcatagtttgacatcgggtaatatgatgcctccaggcttgttctttttgcttaggattgcttatatggtttggatgtttgctccaaatcttatgttgaaatacgattcccaatgttggaggtggggcctggtgggcggtaattggatcatgggaatggatccttcatgaatggtttaacaccatccccttgctgctaagtgaattcttgctcagttagctcacatgagatctggttgttgaaaaagagtcggggccctcctcccagttcttgctccagcttttcatgtgatgtacctgctcctgctttgccttctgctgtgactgtaagcttcctgaggccctcacaagaagctgagcagttgttgttgccatgcttgtacagcctgccaaaccatgagccaattaaacttcttttctttatggaatacccagcctcaggtattactttatagcaatgtgaggacagcctattacaattgctttggctattcaagttcttttttggttccatatgaagtttagaaaagttttttctagttctgagaaaactgacattggtagtttgataggaatagcattgaatctgcaaattgctttaggcagtatggccattttaataatgatttgtccactctatgagcatggaatgttttttccatttgtttatgtcatctgtgatttctttgagcagtgttttgcagttcttctcatagagatctttcacctccttggttagatgtattcctaggtattttgtgtgtgtgtgtggctattataaatgagactgcattcttgattttgctctcagcttgaacactattggtgtatagaaatgttactgattttattacattgattttgtatcctgaaactttactgaaggtttcagaagtcttttggcagtcgttagggttttctaggtatagaatcataccgtcagtgaagagatatagcttgacttcttttcctgtttagttgccttttatttctttctcttgcctaattgctctggctagcacttccagtactatgttgaatacgagtaatgagagtgagcatccttgtcttgtttcagttctcaaggggaatgtgtccactttttgcccattcaatgtgatgttggccatgggtttgtcatagatggctcttattattttgaggtatgttgcttcaatgcctaatttcttgagggtttttatcatgaagggatgttggattttatcaaaagctttttccacatctattgagattatcatatggtttttgtttttaattctgtttatgtgttgaacacatttattgatttgcatatattgaaccaactttgcattctaaaaatgaagcctacttgattgtggtgagttaattgtttgatgttgttgaatttggcttgatagtattttgttgaggatttttgcatctacattcatcagggatactgccctgtagttttcttttcttgtgtctttgccaggttttggtatcagggtgatactgacgttgtagaatgagttagggaggagtccgtgttccttgcctttttgctatagttccagtaaaactagtaccagctcttctttgtatgtttgaaagaattcaactgtgaacccatccagttcaaggctttttttggttggtaggttttttgttacttattcaattttagaactcaatattcgtcttttccgtgtttctaagtcttcctcattgaatcttgggagagtgtgtgtttccacgaatttacccagttcctctagattttctagtttgtgtgcatttaagtgttcataatagtctctgaggatcttctgtaattctgtgggataagttgtattgtcacctttgtcatttctgattgaatttatttggatctttttttctttgttaatctagctaatggtctatcaatctgtctgttcaaagaaccaatttttagtttcattgattctttgtatgcatttttgggtctcaattgtgttcagttctgctctgttttttttatttcttttctctgctagctttggggtaagtttgctcttgtttttctagtttttctaggtgtgatgttagattgttaatttgagatccttctaactttttgagataggcacttagcactacaaactttcctcttaacactgcttttgctctgtcccagagcttttggtatcttgtgtctctgttttcatgtagttcaaataatttttatagttctgccttaatttcactgtttactcaaaagtcatgcaggagcaaattgtttaatttccatgtaattatgtgcttttgagagatcttcttggtattgatttctatttttattccacagtgatccaagagtatggttactatgatttcaatttttctgaatttattgagactcaccttatggccgagcatgtggttgatcttggagtatgttccacgtgcaggtgggaagaacatatattctgtggttgatgagtggaatattctgtagatgtctattaggtccaattggtcaagtgttgtgtttaagtccagaatttctttgttagttttctgtctcgatgatctgtctaatgctcacagtggggttttgaagtctcccactattattgtgtgttgctgtcgaagtcttttcgtaagtcttacaaattcatatttttgactctgagtgctccagtgttgggtacatacatttttaggttagaaaagtctttatcctttatcattatgtaatgcctttctttgtcctttttaactgttgttggttttaaaagtctgttttatccaacataagaatagtgacccctgctccttttttgtttgtttgctttttatttgcacagtggatctttctccaactctacttggagcctatgtgtgttgttacatgtgatgtgggtctcttgaagacagcagacagataaatcttgtcttttgatccaacttttcactctgtgccttttaagtggggcatttagactatttacattcaagattaatattgatatttgaggttttgatcctataatgaagttgctagctggttgctttgtagttttgattgtgtggttcctttatagggtctatgggctaagtactaagtgtgtttttgtggcagcaggtatcattcttttgtatccatatttagaatgcccttaagaatctcttgtaagccttaagtaagcaaagttattaatcatttcctttataatatttttctttatttttaataacagctttcatgagctataatacacacaccataaaattcacccttttaaagagtataatttagaggtttctgcaaccatcactgctatttaattccagaacattttcatcacccaaaatccagtacacattagcagtaactcttctttcctccttccccctagctcctggcaatcactaatctactttctgtccctaatttgcctacactggacatttaattaatagtatcatataatatgtggccttttctgactgacttcttccatttagcataatgttttcaaggttcatccatgttgtagcctatatcagtaatttattactttttgttgatgaataatattctactatgtggatatgccatattttgtttcttcatatatcagatgatagacatttgggttgttttagcttttgctattataaataatggtagcgtgaacacttgtggatagtgttttgtgcggacatatgtttgcaattctgttgggtgtgtacctacaagtgaaatttctaggtcatgtggtaactctatgtttaacattttgaggaactgctaacagttttccaaagagggctgtaccattttatgttcccaccatcaacatatgagaattctaattattcacatcctccccaacgctcattattgtctgtctttcttattttagccatcctagtgtgggagaagttgtatttaatgctggttttgattggcatttccctaatgacgaatgatgttcagtattttttatgtccttattggccatttgtatgtcttctttggagaaatgtctaattaaatcttttgcccagttttgtaattcagttatctttttattgatgaattattttttctttatttttaaagaaacgttttaattaaagtattaatataagaaagtacacaaatcatagactttcaaaatgatgaattgtggtcaagtgaacacacttgggccaaccagatcacaaaacagaacataatagaaatagaatattacctgtacttcagaaacctccttcctggccctcccaaccttcacttttccctcctcttcttcaaattaactactatacagatatctaatactatcaattagtttagcttgtttggagaacatatattatatatgttcttttgtggctggcttcttccaacattattttggggatagtattcatttacgctattgcatatggcaatagctttttttttattattatactttaagttttagggtacatgtgcacagtgtacacgttagttacatatgtatacatgtgccatgctggtgtgctgcacctattaactcgtcatctagcattaggtatatctcctaatgctatccctcccccctcccccctgcatatggcaatagcttggtccttctcattgccatatagcatttcattgtatgaatattccactactgttttatccaccctactgctgacagctgtttcacttgtttaaagtttttagttattctacatttagttatgtgttatacctttttatttaaattaggtcttttatagctattgttagacttgctcttatatatttggggttttttaataccagtgtaagtgatattgttttctcaatttcatatcttaattgtttataactagtatgtacaaataagattcattttaaaatactggccagccatttggctaaatttatttactaatctaatattgtatatatggattcactgatattttctacagactcgattatggtacttgtgaacaaaaatgttttttttttctttctaatttttatacctaggatgtccatagcattatcgaacagaagtgatggtaactggcattcttgtcttattccttatatcatagagaaagctttcaacattttaccattgaacatgatattagctatagctttcttgtaactattcttattagattaagaaaatcctctacttctgagtttctgaaaaacatttttgggggccatggatggatgttgcattaatcaaatgctttttctgtacctatgaattatattcattttctcctttatcctcttaatatggtggataacatgattgatagccaaatatcagtccaactttgcattcctaaaataaacacaacttggtcatgtcatttatttgtcattgagttcaattcactaggatattttctaccatcagtgtttactcaggagattgcttgtaattttccttttttgtaatatatttgctgggtatgaatatcaaacatatgctggcctcataaaacaagatgggaaatgctccctctttttctattctagaagagtttctgtatgattgatttcatttcctcttcaaacatttggtacaattcactcaaaaaagccatctgggcctctaattgtttctgtttggtttgggtttttaggtttttggtttggtggtaagattttaatttatagaatcatttcctttaacatataagactactcagatattctatttcttcttaagcaagttttgacaaattgtgtttttaaaaagaattttttcatttatctaaaatttcaactttattatcacaaagttgctaataaaatcctctcatattttaatgttaataaggtttatagtgatgccccactttcatccctgatattggttatttttgctgtctctactcttcttgctgattctaaccaggatttgtcatttttgtgaatctcttcaaaaaaacagcatttagttttggtgctccactctagtatatgtttaccctctatttatttaatgttagcttttatgtttattatttctttctctccaccttctttttctactggtttaatgcgatctaccacaccttttaaatttacaatgtcttctctcaatcaaactgaatgatttgctctgccaaagacactccttatcctttctagactcgtggctcttatagttcccactgtttataaaccatattcccctttaccaaaatcatgccagttttccaaggctttctccaaatgctaccttctccaaaaagcattctgtcttcttctcttatttgatatcctttgactcctcatagctcatttgcccttcttaagtcactttataacctggtttatgtacttcattccattagctccttaaagacttagaactcagtttttcctgaaagcctcatcatggtgctgtacacaaaatagttgctcagtaaacactggtgtttattatgcaacttcaggagttagattcacaaaaactaacctgggtaatagcaggaattattgactggcaacatttagtcaaacatgtagagtcaaatatatcataagaagagtttggggggaaagggaaataattctcatcttctaaaaaaaaatcttacttgcttctaagtgacaaccatatatcatctagaactaacatttgacttgaccatcacttaaaaatcacattttgcccattatttaaggcaaatagttaaatgggataaaggggtttgttgttgctttatattggggggtccagttggaaaatgagaagatagagaaatttcccaagaaaaaaaagtaagctaaaggataattctaatattgtaaatgcacactgcacatcaaaacacacagtcctttacaagtttgaacaagttatcacaccaggctgttaaaaaaagacttcagagcaagacttaaaatgcagggggagaaacagggcatatgttggctgtaatgtacatatttggagccctatttggagccatgataacacatgcatgtaaaaaggatgagttttgccttttagcacaaaatacagctctgcacctttccaaaaatatcacataagccactccatctctcatgagctgcctctacccattctaggatgcaaacctcaatgcacaatttccaaagtaaatgttgaaagaaaaaacgtttgaacctttgggctatctttagaaaaggcagaaagaaggagtaaagagtgcaagagctttgaggagaaacttatgttcaaatctcagctgccaatctgactagctgcaggaccatgggcaggttgcttatcctctctaacccgtagctttctcatctgtgaattggggataactctgcctattcacaggtttattgcacatcaagtgctgtagcccttatgtgtggtagtgatgttgctgtcattgggtattactgggggtgcaggtgacatcgttgttgttagtgctgttattgtttttaatagccacaaaaggagcaggggcatattcttaaggcctaaaagccatcatcataattgctttactagaaaaactgggattggcacaaatttcatatgaacacagcatccttggagaagatgaatgaaataaacctaggtaggccctacagtcaaagaagtggcagctacttcatagtgtctctgaccagattccaggactcagacaagttcataatgggtattgggttgtgctgagtagtctaggtttgcctttgaactctctcccctttccagttatatgaaacttggtaaagttgcgaagtagtagttcttgacttcacagtgttccagtacatccctttcatattctgtggaactaaacaggctaaatttgaccaaataccaagataccttttaagtgaaacttaacccagctgcaggtcagctccatgcagaacaacagttatctgcctgggcacaaagacaaagtgaagtcttatttttataacaaaaaattaacctctgcattaaagttgcacctgaatgcaaaatcatatactttcaccaatagtaccacttatacttcagcaacttagtggagctcagtcttgctttgcttactacttatttccaattaaaaaaaaagcctggtggggacaaatgtcactcaagaggaacaactcaaggcacacaagtgccctcgctgaccgtgggactggaaagctaaatacccacaatccccacttcaattaccacagaaatactgcttttaacttcacattatgcctctggcttcttaatccactttagttaacaagttcaccaaatcaccaaacttttactaaaacccttactaaaaaccttttactagttaacaagttcaccaaacttttactaaaacccttatgtcactcatatatgtcttctttgataaattctgctgaaaacctgatagtttctgctatactagcaaaatgtttgtttttcccaaagaatatcatttaatgttttaagcaaatgaactctagaaaactctatgtattttcttttcagcttcagctgctaagtttggagtgaagctttatgtgtcatctcagtaattattattactctaagggttgtgtttttacattttttaaaaaacacaacattctccctgcccttccatttgtgatagttggagttgctgtagccatttgctcacaggcagggagaggttgcctgaaaatagagctcacatgaaggaagacaagataagggatggaatgagagaaaatgggatctgctaatatcttttgagcctctggatcaagctgtgcctgaagcaatacccctgtttttttccagtaaatttttttccaataaatttccttttgacttcagccactttgaaatagattttccttcacttaaaatttctagctaacaatgaaaaagggggttgagattatttgacaagaactaccattactgtcattcattttcttaaaaaaaaaaaaaaacaaatggctttatgaatgacccaagaaagtaaaacttttggacatcatgtttatgtcatgtcaaatttataataaaaataagttacacattctttcaaagaaattagcattaaagaaagaaaaaagagaaaacaagcctttcaactgtcattcttattgacagttatccacaagagcagaaaagaggagcttagcaaagaatctttagacacaaaagcaagagaaagaggagcactgcaatatctacaagaaactaattttccaagaaacacacacagtgttctaagtgcaaacttggaacatacctgccagaccaaatcaggatcaaaattaaaacttgaagcttcctgcaagaagataaatcacaaataactttattcactttgcttcctttcatttttcattaggtaacttcagcccccaggctcaactggctgcagtggatgtaatgtctgcaaaagaactgcccccagtttgatgcaggcagatgatatttcccaaggttcaccccagaaaaacatattttcacaactccaaagtccagagggggtacacaaaaatctagaaccagactgtggatctaaatagtgcttgaatttaggcaagatttcacagactttcacaacaaatgtcttttgcgagtttatgcaaagtgtgtatatggggacaatgggggttgaagctcacccttagttcctctaaaaagcaagaaacaaatagggataatctctgagtccaatttagtctaagaaatctcttctgtttttttttttttttttttttttttttttgaggtagtgtctcactatgtcacccaggctggagtgcagtggcgagatcttggctcactgcaacctccacgcccagggttcaagtgattctcctgcctctgcctcctgagtagctgggattacagctgcccgccaccacacctggctaatttttttttttttttttctgagacagagtctcgctctgtcctccaggctagagtgtggtggcacgatctcgactcactgcaagctccgcctcctgggttcaccccattgtcctgcctcagcctcccgagtagctgggactacaggcgcgtgccaccacgcccagctaattttttgtattttttagtagagacggggtttcaccgtgttagtcaggatggtctcatctcctgacctcatgatccgcctgcctcggcctcccaaagggctgggattacaggcttgagccaatgcacctggccaagaaatctcttcttaattttaaattctatcaaggcactagatgacattgatgtttacccagggctaaaatacaacagggtctcaagttccactcactaggcttaagggtcagttcgatttggtagtcaactctaaagcctgtacaatatgagcttccaatattcccaccaatttcacaggggtgtaatgtacaaaatcagatgagatcacagcctccagcctgagctatacacatggctgggatgaccctccaccagctgcctccctaactcaatttaggtatgttgaggatagatgttaatgggacccagacttctctgttgacaagacagaaggcagtgcttttgtaagttaataggcatccaaaaagacaacagaaaaacttgaggatccgtttccgtttcctgaaaattatattgctcttcatttgtcctaaaaatacaaatgcctcatgcctacaaattagcaacactggcatccatgaaaggagaactctaggctcaatttagtgataataagtagaaatgaatttgccctagaattcaagtttctctgccttcccatgtagatgacctaagtgagttttttatttataaatttttttataataaaacataatgctaaaaacaacaaactaggatcaaacagatttttctactttaaaaagtcacaaaaaaaggtaccaattatctttgtatggagacatttaccaggaaactacccaccacattagaagagatgtttctcctgttttttccaaaggccttggaaactcgctcttttttttttttttcttaaatgataatttggaaatagattgtatatacattctcttctccattactatttgtgctgactgggaaggtgggtgtggaggtggatggaagggggactgagtcaccctttgcaaaaacaaaaaacaaaaaaaaaaacaagtcttttgtccttttgtcttttcatttttcctctttttttttttttaaagccttaaccaagtatcaggtttgattccaatgtgaagtgaggataaactctgaattatgaaccactggcctaccattccccagtgtagaatgttcagtttcttttcaaaatgtttaaattatataagtttaaaacaactgatgagccagggttaataattattgtttaatcctattggcatttggtcccttcaaagatatttttcaaacccatatgctacacatacattatgagtgccttgactcatgtaacctcatttgggggacacatagttttaaagcaaatgacctatattattttcacaaaaatccacttggattaagaaattgtcattgaataagaaaaacaatccctactcagattgcacatgccaagaattcaagagctcgtattagtttcttttccctcaaaatttgggaatttgggggcagataattcaaaatcatatgctgcaagaaggattgagaagatgcattatcctatcagcaagctttagaattctcttgcaggcccacggtgaccagcaaactccctgagttttacacttgagcgtggaattttcagattgcaaacatcttgattataaacttgtttcttaatggaacacattaaatcaagaattatttattattgagataaatactttactatttgcatccttctggcaaaaactgtaaataaaaagattttaaatttctagatactagcaaagaaatggagtttcatttagaccagtttcttaatcatggatcatggcttggtcatgctcatttacttcatgattccttaaacgccctaaattctctcagaaggatttttctattcctttaaatagtgtatctctatgcctgcacagctaaataggatactttgcaagtacttagtaaagtgttattacttccaaacttggttaggagaaaatactggggtcaccagaaagtatcattttttgaaaagtaaattttgctgatagcattattttaattattaacaataccactgcatgtaaaataacttccctttgccaactcttaatttctcaaaggtgctttttattgtgatgtgaataggaggaaaagaattattgtagtttaaaaattttacttttaaaacacacataaaacctccctaggattagacatgctttgaaaaggaacccagctcctttcagccaatggattctcgagccctttattcttttgcccagaaaaggcatcctaattaaaggaccaatacattaaatgtgcccaggaaggtaaaaaaaatccagaagtaaagcatccagcagggtgcctagagaaaaacacaaggttcatttcatgtttatattaggcaccaccaagttagaacaaactcccaaggcataactgtttctgacaaaagtgcacagttcctaccttcatttcgatgacagtctggagagccttcgtcttggctggctccggctgaagttggcttcttcggtgcaattcctggggaggaacacgatagaaataagcctgacggttcatccttccgttacaccacaacctttacacaggtactacacagcctgctgggtcctggttccccttgcacagacataaacaagccacaggtgtctcttcccccacactctttagcatccctcctgcctggagcctgcgttccggtgaaaagctcctggcacatgcgctatttctgaaacttccatcaataattaatgtcaactgtgacaaagccagcaagtaatcatagtccaaatactgttcaacactggggctgatgcccagccatcaaatcataatttactaaattacattactctgtgctcccaatacaaacacagcaaggaaacagaggaaagaaaatgactaacgtggttgcaaatccgctgcacgcatggcattttgctaccgaggcaggtttgaaatgagcagtttaaaaccatttcagtacaactgtgtcacttttgagagtgatctgatgaaaccctgtgaatctcttgcttccgaatttacagtttcagtccttgtttaaaatcacatctgtgggtgatatatttatgtatcatgatgccaagaaattaaaattggcattagtatcaacagtgttacaggggagaaaaaaattgttaaagccagatgtggacccaaaaacccctggaacgatgatgaacatttctttaggtaaaaagcaaacaacataattacaacttttatcttgaaggtcactttttatatgcttctcctcaaaagaacagttctgttgagactttgaaaagttgtcttagcagaagagaagagataaggacaatgtgtgttcagatcacacttggattttcttaactatcaacagttttaggagagtgagcaatggcaggagtaatcaaaagtgctcacacatacccatgctggtgattcaggtcacctatggaataattctatcagtacttacttctgcttccacaaaaatcaatttagagtcaacatggggtagttctagactttcagaaccactggatcacaaacatttactttttttaaaaaaggagttaaaaaagaggatcaatatcatttctagctttctgcaagtaaaggcatttaaaattaactctacctccaccattatcatctactatcactgtcacttcaaaaagataggacatgggatcaggtgtggtggctcacgcctgtaataccaacactttgggaggccgaggtgggtggatcatgaggtcagaagattgagaccatcctggccaacacggtgaaaccctgtctctactaaaaatacaaaaatcagctgggcatagtggcgtgtgcctgtaatcccagctacttgggaggctgaggcaggagaatcccttgaaccagggaaacagagattgcagtgagccgagatcacgccactgcaccccagcctggtgatggaacgagactctgtctaaaaaaaaaaaaaaaaagataggacatgttaatgtaaaagctgtcagaacactcaagacacacaataaaagatagtcctatccaggataagataagcaggcaatcttttgcccacatcctattatgctgttcttattatatttgccagtggcccaagaaatcttacaggtggaccatagggcacatgtccaaggaccagtgtgggggagttaatgctacagctctggaccaggaatctgaaaagaatattttcttctccaactcatcactggcacaaatcagcaaccctgtacaaagctctttctcaacctccaatttgagaactatacttcctaactattcaaaatgctctcacatcagtcaggatattttttcccctaacatatccctgggaagggatgaagtcaaccattaccaaacatttatgaatacagaaacagaaagagatcctgtgtccctctagaggcactggactgcaatcatctggcaacactaccatttttggactctctggaaatggcagagattttctgaaggaaggaccctaaaggcagctgtcctttattgagcatctgtgatgtccctagcgctgcttgtctcattcaagcctcagcactaccaaatgaagaagatgttatgtgtggtgagtacagtaggctgctggaaattaaaaaacctgcacccccatggccaatatcaagttacccaagtggcatccctgaatgcagaattgggaagggagacacaatagcacccccattgtatggtattttctaccacacagacacaataaatgtaacaacctcaagatcttagataatagtaaagtgtaataagaaattaggaaattatgagtttttaatataatttatttaattgtgagtttgtacatttaatttgtaacattagttattagaagaagtttccaatcaatttggagtcaatgtgatggtttttttccagctttcataggtcactacaatccagtgccaacacagcattgggtggatcccatgagatttcaaattccacaaagaaaaaatctacttggtcctcaacattacttccaagattgctggagttcactgtaccaataaaaactcatggacaagaaaacagaaagtaagtcacttgtcagagtttctcttagtaagtgttagaagaaattcatttcatagatcacccattctgataccaggtggcatcaaaatcatcttattaaaagccaggaatgcaattcataataatttcataccataaccaatcctagttccagaataaaaattataacttgaggagagaggttaagcttgtataaaacaaggaaaaataatgaagaagcaaccaagcaacacagtgaaaataaaaaccataggtaaaggcaggtgctgttgtaatttctgccaaacacgaaaacattgtcaagggtaaacatgcaataaaaaagctaaacttgtagcaacagttattcaataatggaaacagagttctctttgctataattatacaaattatattataatacaaaccagctaaaaatcctgattgggcccttaccctctgtgtcactcctttaaaaataaaataaaatctccaattacccaagaattgtaattttcttaattacaatatttttcaatcctgacttcatagattctgaggctcatcttgattcctaaggtgtcaggtaaatgaaaattgtaatctatatccagacaacatggactgtctgaaaatcccatctcaaacacttcacctatctttgagatttgagattattacaatactcactctgtggtagaggaccagttgcccaaggaaggtttgtgctcctcttccatacaatagagttgttgctaggaggccccacaaccactacctaggtggggccatgggacttatttctgtccagtggaatgtggttagaaatgagcaacgcgatcaactttcataaaaacttcctaactagtcctcaactctccctctttttctatctactagctagaagtgaaggacttcaatatccaagaagatggtgtagcctcaagatagaaaaagcccacacttctgaaacatcatttgaaaggctgctgaagacctacatcacatggtgatatgaaataaaaataaacttctattaagttaagcctatgagctttcaggctttatctacagagatctcagctctctctgctttaagaactgcaatggctacaaggcaaattaataccttattagtcctgtattgtttgttgcttttgaatcaccaaagtgattttaacgtgtgattgcttgccaaattttctaaacagacagtaggatgaattggttgctggaggctccaactgcccctaaccatctgagcgatgcacccattatgcactaatcctaaacaactaatgaatttccccaggagcatttgatgtcctctcatataggtatgactgagtataagatttaacttactgtgatagttttcacatgacagtgttattaaatcatgaagtgcaatggtacttaaatttttctgcgtcacagatctctgtaaaaatcaaacaggaggagtggattctttctggaaatggacacaaaagcacatgcaagcaaaatggtgtgcaccatgtcagctggttcacagagcctggatcagcaccccagaagtttacctttgagccagactttgggctgataaccacttattgagaggaaagagcactgtactagaagccaaaagtcaggagcctgcagtcccagcctgagactttgggtatgctgcttcccctctctgatcagcagaatcaggagctttatgaattggtttctaatgctcttccagctctgaaattatccagatttttaataaacagctgacactgaaatgaggacctctagctggtatttctagtcccacctattctcacttttaaaaacaacagaaaaaaataagggaagaaaattggtggcatcacaaaatttaacatctcactgtgacatcaaaccccacattatatattttcctgtaatttcatgacaaggttggctttagctagtgcaaaattgctagctccttcagctgatcaacataaaagtacatgaagagcctagaattttgagcatgaaatctcaagtggttcatcagaatgatacttcttggcgttaatgagagtctagagtcagtgggttaatctggatggacactagcttccaagatgaacctgtcagaataatgttcacacaccacatactttcttcaacagaccaaataataataacaacaagtaaaaacttaactttcattccaaaggtaattattacatttatctggccttttcccattattgttctgtaaatctattactgtataacaaaccaccccaaacttaatggcatcagaccaccaccattgtattatgttcatgaattctaggtcagtttcttgcacaagagcaagaaaactacatggccttttattacctaaccttgaaagtcctatagcaccacttctgtcatgctcttttgaagcagtcacaagcctgcttcctaaaggaaggagtgccaaagaatttgaagccatgttttaaaattgccactattatggaccaacaccaattggaggaatcaataggaaaggaacactaaaatctcaaacatcaactcatgtcagtcttaaaacatgggaggttcagatattcaaataataatttgatacaggggatacaagaaatacagcagtgaaccaaacagaccaatatcccagccttcatagttgtttgtttttttttaaattccagattccagtggaggaaaaggcacgataattttaaaaggagactaaaccacatcgttataaatgttataaaggaaaataaatcagagaagtagaatgggaaatactagggaggcatggatcaattacaacttccaataggatagtcagagaaagcttcatgaaaaggtgacgcttaagcaaagatctaaagcaggggtgtccaatcttttggctttcctaagccacactgaaagaagaagaattgtcttgggccacacataaaatacactaacactaatgaaagttgatgagctaaaaaaaaaaaaaaagtcacaaaaaaactcataatgttttaagaaaatttatgaatttgtgttgggctgcattcaaagccgtcgtggtggcatgcagcccatagaccactgactggacaagcttcatctaacggaaacgagggaacaagctgtgtagatattccaggcagagagaacagtgaaggctaagtgtgtggctgaagttgcatgagggatggggtaagtagaaagccaaagaagtgcaggggtgggtgggaatgagaggatgagctccacatttggagtttgtcgtgaggacattgattttactctgagaaaaatgggaagacattggaaggtctgagcaaaggcaaaccatgacatgaggcactttcttaaaggattactcccaatgttgtattgcagcatggtttcggggtggtggtgataaggacagacccatcagagctagttagaggtaactggaataactcttgcaaggcatgatagaaccttggaccatggtagcagagtggaggcaaggagaaaaagttgagtttagatatgttttgaacatgaggtggacttggcttcctgatagattgcctgaggactaaagagagaagcaaaagatggctccaagcctcttagcctgaacaacaggaaaaatggaagtggaccaccaagacagggaagattgggaaggaaaggtgggagttatgggaactaagagttttggttttgtatgtgttaagtttgtaatgatattagacatttaagtgaaggtgctgagtaggtgattaaatagatgagtctagatttgaggggagaagtaagaactacaatgacaactttgggatcagtgaatagacagtatttaaaacctagatgaatcaaccagggactgagcatagaaagaagagagatcagagtattgaggacaggggtactccaagagtgaggggtcaggaagtcaggagcaagcagcaaaggagcctgagaaggacagctagtgaagtaggaagagaatgaagagcatggcctcctggagatcaagtgaagcagctgtgtccataatgagagcgtggccatcacatcaattgctactgagagatcaataggatgaagctagagaattgaccactggacttagtcaaggtcattagtgacctcatctagagcagtttgggggatggcaggagtgaaagtctaactagcatgtgctgtggaagaacaggaggagagaaaaccctcaggttactatatttgcacagtgggctatttaaccaatcattcatcttgtcaaaactctgctttagatttgtacacccaagttcatagctgcattatcccaataacaaaaaggtagaagcaacccaaatgtccatagatgaatgaatgataaacaaaatgccatgtaaacatacaatggaatattattcagccataaaaggacggaaattttaatgcctgctacaacatggatagacctcaaggacattatgttaagtgaaataagccagacaaatactgcatgatctcacttatgataggtatctagagtagacaaacttatcgaaatagaaagtgaaatggtgcttgccaggggtggtgataggcagaaatgaggagttgtataatgggtacagagtttcagttttgcaagatgaaaaagtcctagagattggttgtacaacaatgtaaatatgcttaacactattgaactgtacatttaaaagtggttaagacagtaaattttatatcatgtgtattttaccacaattaaaagtttttctaaaacagaaacagaaattgttgaagacccacaaccgttcccatctctatcctttcggagagtaaccatcatcttgaagttggtgtctatctttttcatgcatgtttttgtgctttcattatgtatgtatgtcctcataaataacataaagctaacaatacagtacgctattttttaacttacagaaataccagctgtctattgcacaaagcttttttgcattttgggttttacccaacaatatttatgttttcaaactttatcaatgatattaagtaattctataagtaagtgtttcctactcttttttccattacaaacagtgtttcaataaacctctcagtacatggaggcgtggagaatcaaatgtgttttaggtatcttaaatgcgcaataattctcttctttctaaaacatactgttatttctgtttggaataatactccacccttttattcccttttgtctacagaggttatcaaactacagcccacagaccaaatccagcccaccatctcttctggtaaataaagttttattggaacgctgctatgcacattgatttccacattatttatggctgctttcatgctgcaatggcagaactgagtggttgtgacagagaacatatggccctgcaaagctgaaaatagttacgatctggccctttatagaaaagtttgtcaacccttggtctaggatatcttcaaaactcatactagccaatctcaggaaaaagaattactcctcaggtggtagtttaaatcatgtccacaaattcttcaacattctctttataaagtgaagcctaaatgtcttctccttcactgtagactggactcagtaactcacttctaacaaatagaataaggtggaagtgacatgtttgacttctgaggcctaggtttaaaagaaattatggcttctttcttgctcatattcttggatcacttgttttggtagatggcagctgccacatcatgaggatatcaagacatcctatggtgaggcctgtgtgacaggaaactgaggcctcctgccaaaagccctgcgaatgagccatcaaaaaagtggatcatccagtcccattcaagccttcagatgactgcagccctgtccaacagcctgattgcaacctcataaggggcactgggccagaactacccagctaagcaactcccaaattcctgacctacagagtctgtgagataataaaggtttgttgttttaagccattaaatttggggtaatgtgttatgcagccatatattgcaaatatatcacaggaaggtcaacagctgaccctctagactagtctaacattccatacactcatgtatactctcatagcattgtgtacttttcctccatgtcactgaacatggccacaattttacactaatttataaaattaattaatccatgtctgtgtatatcatggagtggtaaactccatgagaacagtgactctatgcccattacatgctcagtaattaacacagtgcctgccaacagtaggcgctcaacaaacactgatggcttgattaaatgaaaccgtacaaatgacactgtatgtataagcctggaagtcctacagtactttcgaccaaaaggagtctgctgtgaaggatgataataactaacagttacttacacattgctatgcgctaagcactcttttaagtatttaataaatattaatgtgttcaatccccaaaataacctccctaagtaggtattatcaccattttattatcaccatttttcacttgaagaaacagaaatagagaagttattaacttactcaagaaaaccttactgaactgtactgcagaaatttatcccaggcagtctgactccagagccactgctcctaattgcctccctacactgcccccgtttcaccacttggctttgagttgatatttgaagttgacacctccattggcttctttcattataggcacttccctatttctcctttgattcagtctcatttcccattcttttcttcagtatttgaaaatgaaagaattttatcatagtagcagttgtctgagaccaatgtccatattagatattaaaacttaaaaggcaaacatggttggcacacagaagaagtggggcaaaaaaaaaccacaattactttcaaattttaataaccttctcaatctttgaccaatcaagcgtttataaataataacctaaaatatttacataatagaattaataagcctaaattaatagacagttacactgaactttggatccaataacctccatttgaagactcaatggaatatttaaagattgaccccataccaggccaccaaggaaaacctcagatggattccaaaaggcaaaagttaatatacaggctacattctttgtccatacacaataaagcaagaagttaaaaataaaagttgaaaataaaacctcactatttggaaaataaagctcataaaatctttaaatttaccctctagagtgagatcctgtcctctccacttactaggtgcatgaccttgggcaagttactggattttctctaatactcagtttcctcatggatgtcacagctatttcatcgcgtagagaggttgggataaatatatggactgacacacagcatacaatcatcattgaaatgtatccttatgactgtttttgctctttaatgattattagtgttcccgacagcacattaaagaaggcagtctggcagaatgccttccctgcctctttgttctgtgctctgacattggctagcattaatacactgtcactgggtctaattgaataattttcatttagcaaaaatccactattggccaggtaggacacacagagaatccctgccttcacggagcttatgttctagtgcatgcattctcaatgagggtgacgtcatgcctagaggatttggggaacggcaagtttcccagggttgttggagtggaaagaatgctgaggagaatgctgagagatgagatccaagaggtaagggctgcagagggggcagaatgtattagcccatatataaagatatatataaaaatatctttatattcttataaagatatttgtcatacacagaaggcttcaaattctagagagacagggaaacagtttccatggaaatagataaatacagtaggaagttattagtaaattatttttcagctgtcacaagtaaatggacatttgggagcctaaaactatgctatctgaatctctgtgcatgtacatttttctttaatttgtcttaatggataatgtgctccttttggtgaatctgcattaaagactttttcacagattcatcttggtcctttagatgttatggtcctggaaaccacagaaattaatagaatgaaattctattaatatttggccagttgtgttatgttagcaatgtcatagggagaaacaataaaatttagttatgtagttcaataattattggacacctaacacatgttaagcaatgcagagacagcaaagataaatgaaacaccatcccaggtctcaaggaacttgactgtctaatggaaaagggaatatatttcctggaatataagaccacaaatgttaatttcaacaataataacagcagctataacttacacaatgattatcatatgtaaagccccatgcttcccatctagtgcctgatttgctctgcacagcattccaccacataggacttaccgccccatggaaaaggtgcagccactcagactgagagagttaggtaacatacccaagattgcaagggtggtaagacctgagtacaagcacggtcagtctgaggtctaaactcgctcttttaattactaacataacacttggtttatattgctatctgcagttgcttcatcctctgcaaacatctagtattttaacagggatctgaatctgactcttggtttgtttctcagttccctgatagaaccccactcattttgaatgacatgctatgagagagaatgcaaaataagcatccaggcctgatgagggaagaatggctttggaaaacctcatggaagagtacatgtgggtgattaatcttcaaccagctttgcactactctgttggactccatttctgagctaaaatacacctccctgaaccttatgcactggcctttgtccctctcatttggggacataaagaacaaattgggccaatctgccactgtgacagctttctagtccaaagtttttcttactaaagaatcattattctatttcttacatgacagagtgtcctggtcactcacctcagcctatgcatctcatctcatctgatctcagaagctaagcaatattgggcctggttagtattggggtgagagagcagctggaaaaactgggtgctgtaggctttgagtgcagaggcaagaaccatggagtattattcccatactttaaaacctcatggatttcccagctggattttaaaactgcaatggaccagtggctccatcttaccttccttgttacctatttgaacattatattcatctgtaactgttatcctatgcctctaccaccattatctattgagagcagataacttgtttctctcattttgcaagcccactaaaagagggaaattgtgtccccaggagtggtatttaatggattatacccagagcctcatccatacataagcgatttagacaatgggacttttgaactgatgagatttagatgagattttggactgagttgatgctgcaatgggatgagagctttgaagatctgggatgaggtgaatgtatttattactttggaggaatgtgaatctttgggagtcagagggtgaaatgtagtgggcagaataaaaaagaagtccactttctatttctaaaacttactaatatgttacattatatggcaaaagaggctttgtatttgtaattaagattacagacattaaaatagggagattatcctggataatctgggtgagtgcaatctaatcacatgtgccttataaaagctgagaactttctctggctggaggcagagagagatgcggcagatgaggatgtcagagagattctcagtgtgagaaggatttgatgtgtcattgctgattctgagatgtaggggccacatcatgtgcaaggaccacaggaagcctctaagggctcagggtggcccccagctgatgaccaacaaggaaatcaggaccttggacctacaaatgcaaggaagtggctttggccaaccacctaaatgatttgaaagcatatacatctcaagaaccttaaaaaaaaaaaaaaaaaaaaaaaaaaaaaagagcacagccctgatgatacttaattttgaccttgtagaacttgaagcaaaaaatctagttgagttgtgctataccaggatacttctgacctgtgagctaataaatctgtgttgtttaagctgctaaacatgtggtaatttgtcatggctgcaatagaaaactaatattgaatagctaatctctcctttgcactcctctgttggagagtttttttttctgcattgaggggaaataattcccctgaagcttccatacactggcctttgttctactcattcaagggcataaagaacaaatcaggttcatctccgatgataacagtatccaagtccaatgtctttcttactacagggtccttttgttgttgttggttttgtttgtttgtttgttttgttttgtttttgagacagagtttcgctcttgttgcccaggctggagtgcaatggtgtgatctcagctcactgcaacctctgccctctgcctcctgggttcaggtgattctcctgcctcagcctcctgagtagctgggattacaggtgcctgccaccatgcctggctaatttttgtatttttaatagagacagggtttcaccatgttggcgagactggtcatgaactcttgacctcagatgatctgcccacctcggcctcccaaagttctgggattacaggcataagccaccgcacccggccagtcctactgtttcttatatggcacgatatcaggtgctattagcaacccctgggtcacttaccttagtctacttctatatgtcaggttgaattcctgagaagcagagcctgagacaaggacttccatgcaagtggtttattaagagagggctcttcaggaaagctttaagggagggaaagatgccatatagagaagacagggaagttaagcaagggtgttgtataggaaatctaacctgagcctggacttgcagggagctctagagagtaagctatgctgtagtctgttccccttgaggcaagggggctgggcttctgtaccctcgctccagtcagcctctgcctgtgggttcccccagcacttctggacaggaaaaagtttggcaattctagtcatgaaaggcacacttccaggaaaggtcacagatatgagctgttggcaacagcactcacagccactggaggatgggtgcatctgcccagcaaaagggttgctaggggtctgaattgggcaaaatgagcatctgttacaatctacgattcagaggttgtacacagaactccaggttttatctgaaccagcatggagtaaatagggtaggactccattatttttgttttaggtaagtggctttaaaacttattttagcagtataagccttcaagcttgttttgtccccagatgagatgcacgcacatacacgcatccacacactaaaattaattaagcatctactatttgttagacactgttataggtcctgcagacaggaaggaattaagacggaatggctgctaccaccatgaggcttactgtctgttatagacagcagtcagaaatacgtaaatcaacaagttaaaaattgtaaatgtatacaggtaataagtgctttacaaacaacagcaataagaagatgctgagatagagaatgatgggggagggaattataggatccatatgaggtctgcctcccaaacatgtagtataaatgtcaactcgctagccctaaagtgcagtaccaattaagacattgtatcttcccctgttatcatcccactctaactttaagctggcagtcaggcaaggtcccccaaaggagatgacactcaaaccaagacctgaaggatgagcaggaaccagcacgcaaacacctgtggggaacgtggtcaaggcagagggaacaggaagaggaaagaagtggatttgctctgattaatagggtgacagggggaggaaagggcctgtcatccatccactaagtccactgcaaggatccctgaggtgtcttcttgaaactctaaggttcctctgaacacaacttgagggccacccttctgggcatcatattttgagtcccagagtctaaaactggattgaagaaagcctctggctctccatccagttgccctcaggagccacccaaacatcattccacattcctggatctttacacatcttccctcacacccctttctctctcgagtacgtggagaaggcgtgggagagggagggtctggctgcttcacagctccagccagagggcccattttagagatgccagcaaggaatggcatatgaatcaacagcgtgttccctacacacccccacggtccagatggctgcagatcgcaggagcagagggcggctcctacacagacaacttccctggctgcagacacgtgccacacttcagaccatgagagaacacagttatggtggtggtggtggtggcagcggtggtggtggtgacatttttacagaaaagggcatggtctttcttttgctgcagattttcatttcaaacacttgtctgtaatgaagccttgtagtataaaatgctgagggctcacagaattggaaagcaccatgggaacaagctggtccagcttctctctcccagcctaaatcttttcacatccttgatgggggtcactgggctgaagcctgaaagatttcagattggggcagtcatgcctccgtgacgcagctctgatagttggaaagttctctccttataaatgttaagccaaaatctgctgtccgactctcccctctttggtctagttcctcattacacaaaatttaataacatcttactggccattcatcaaggtcttgccatgcaccaagcattgcgctaacaacttgccatgaaatatttcatttaacccacaccccaaacttaggaggtaagcaccaatcttatccccagttttcaggaggaaaccagagtcttgaagaggttaatggagcagcctaagaccagaccactggaaagcaaaactgaggtttgggcccacatctgtcattctccaaagatccgtcaagcttttgacagctacacagcataacctccacagaatgaatctgtttctttcttcataagacggttctccaagtatgggaagccagaccactgctctcttctaaggacttttcttctttacgtgagatacctccaggtcattcaactgttcttgatggaatgcaagagctcaaataagaaccatcctggtgactcttctgtggaaaagctgcggcttctaattgtcctaaaatgtggtgtcaagaactggccattccacgcacagcctgacaacagcagcatctgttgagtccatccttctgggtctactcaggccgctgaaaatctggtcagaatttgaacagctgtgaatgatgctgttctgcatcaaactaagatgttcctgaatcagaaatggtgtgtccatacatgtgtgggacaaagtaaggggttctgtatcaaggggctcacagtgaacaagtccgggccaatccccctagagaattgccttctgtgagggctgttcttggcatcccccatagaattttccaacatttggcttgcaggcaccacacatggagccttttaagccattatccatgcatggaattggagctttagggtatcagatggtgaacacaacccgctggcactctctgcaagccaaccctccacctgctcaaaaacctcaccatctaatctctgcagccaggtccaagcaactctggaatattttatggcatttgcccttattttattaaaattagaggaaaactgaagcaaaaggactgacataagtgacaacacatgaaagcccaaggactgagacaggtggcattagtgagttttatagtgttcaaaatggttcatctttagcatgaatatgatgccttaagccaggcctcaagtatgaggctaagcgacaaaattgttaaggctgccagaaggggatccctaaaggctgtatctaaaaaatgaaatggaattagggatggtagaatttttttcacatctctggtaacagtggtcccttcctcctataaaacatgtaagtacaattactgacttttgaacattttatttgcaaacctcttcttgctctgccaccaacaagctgtgaaaccttgggcagggtgctagccctttctgtggctcacagcctcatctgtaaatggggatgacagctgcaaccacctcattgagttgtgagaatgaagtggttaccaggtgtaaagccagccagcagtggtgccaggagagtatctggaacatagttcaataagtgttagctatctgtctattcatttaagacaaggtctcactctgttgcccaggctagagtacagtggtgcaatcatagctcactgcagcctcaacctccctgagctcaagcgatccccccacctcagcctcccaagtaagctgggaccataggtgcatgccatcatgccctgctaactttttaaaatttttttgtagagatgaggtcttgcttagttgaccaggttggtctcaaattcctgggttcaagtgatcctcccacctcagtgtcccaagaggctgggaccacaggtgcatgccaccacacccagataattttttttatttttgtagagatggggtctcatcttgttgcctaggctgttctcaagctcctgggttcaagagaccctcccacctcggcctcccaaagtgctgagattacagatatgagtgactgcacccagccaagtgttagctatttaacatttatgtaatagtatgacccaagtgaaaagataacatcctcataacagcctggagtacagagggcaccaagataagtcaatgcaggaagagcagggtgctagaaaaagggtgtgtatcctgacagggagccaggaatagtcacaaagagaggttgctccaagatgccaggtggtctctttagcaaaatgtaacagagaggcaacctgagcagaagggcacaggtggagttacaggcacaggcagagctggccaaggggaggccctggaagagaccttgctaggcaggctggtagccagaggtaggtaggcaggcagtgggagggaaacccaggggagaactgtggttttcagggggtccagggaaaacatgccaggcctcagtgttggagcaagaggtatagagtcctcagccacgtactacccctggaggaggcacactgcaaactgtctgagtctctgacctagctccccagcatgcagcataccctctggcacacggctgaaataacagcacctaatatccatcaccaagtgtcctctctatgcctgagccagtttaggtcttcttcatggtctctctcacacaaccttcactcacaactccatgagatcctgcaatcaacctcattttacagaggaggggagtaaggtccagagaggtgaagtgacttgcctaagtgctcagatgaaggatagatgaacagatgggcaggtagatgaaataaggttgcagtgctgtcgcaaacccaagacagaaaaccgtttcctagaaagatgttgcacatcaccctccaatctcatccccagccagttaactaccctgatgttcccctgactgcagtcacactcacccacatacactcccccaccccagacaccaggttcacacttacccaggaggtcccttctattacattcccttcagtcatgaactcggatgaactcaaatctcatctgctgcacaggccacacacacacacacctgtgcacaaatgtctcaattctttcctcccatcctgtactttgcttttatttgcattagaacactgataactatagtcaatatttcaggtattaatagtgtccatgtagcaggtacatgttaagtatacatgttctgtgtcctttaatcttcacagttgttcccattttataggcaagaaaactgagaaaactaagtgactggcctaaaataacacaattcagattcaatctccagcctttcctcttagccattattacctacatctctccaacattcttcatgcatgaatatagttatgtctcccacaggatctctgggagggttgggcagaatgtggcactctgctctctaacatgactccacagtgtctcacccaaggttgacactccccattgtttgctaaatttacttaacttctttaagttccatccatgtttaaaatgaggttaatagttgtaacagggcctagcacatagtaagcatgagataaatgtctattaaataactaaaataactcctggaaaataatgtacataatctcatttatattctatccatttatttctactcgatagtgttccagaagaagtttaaagcaagccttacatcaatcctctgtggggcatattattatccccacttaacagctgagaaactgagggtcagagaattcatgaaattttacttaagtcacagggttggtgagcagctgatgtgatttaaacccaggcctccctaaacacagagaccatgctttctattacaagagactcaggctgggacccaggcaggagtgggaatcaccataagatggacttgatgctgtgtcacctgtaccaggtgaattgtcttcaatgagaggggcaatggggtcttggaatggagctaagcctgaagaaggtgacccattggcctcagtcatggcccaatggggaactgaagatctttagatactgggatcccagcagatcttaaccaagtccacaggaaacacattcatttgacaatgggtatcagttttccataaggtctcccactaagtagtaccactaaggccagcaatcatcccaatgaaaagggtcccaaaggcagaggaattatttgagctgcactgtccataaactacctacccgattttgactctcctttgtgtataactgtttaatcaatttacaaaacaggtatatggtagattggcagcctatattaatgatgttgggaaagaaaattcatgaatacagggaaatgttcacaataggttaaatgaaaagagtagtttagaaaacagtgtgtactccttgttttaataagaaaatataaaccgtgtgaaaaagtgactgaaagaatatatatcaaactgtgtgctggctcacgtctgtactcccagcactttgggaggccgaggcaggaggatcactcaggagttcgagatcagcctggccaacatggcaaaaccccgtctctactgaaaatacaaaaattagcagggagtggtggcacatgcatgtaatcccagctattcaggagactgaggcaagagaatcgcttgaatctagaggcagaggttgcagtgagccaagatcatgccaccacactcaagcctgggtgaccgagcgagactctgtctcaaaaaaaaaaaaaatcaaaatgttaccagaaattagttgtaggcaagatcgtgagtaattttcaagtttcttttttgtaaatctgtactttctaaattgcctaaaatgagcacacattaattgcataagaatttatgcatagtttttttaacttccaatgcatgagctcattttcatcatgacaagaaactgatgagaccagtactattattatccccattttgcaacagagaaacctgaggcccagagaggttaaatcacttgcccaaagtcttagaaccttgtgattggtttgaatccgaaagccaaattccacagcccaaatgctggatctcatagggacagcatgagtaaaagcgtggcaataaaatagccaggttaaggacacttctatgtttatggtcctatttggtctttataacttttctggtgagttagacagggctaccaataaactgggactcagggaggttaattagtttgggaagatcatccaataagctagtcatcagctcttatcaaattattcattgctttagtgtctacattttccatcatgccataaggtccctaatgacaagtaaatcatctgttttattcactgctatatccctagcatgtgacaaatacccaacatgtagtaggtactcatataaagatttttttgaagagtgaaagaatagaactaaaaaacagtatgtgttgagttgaatagtgccccctcctcccgccaccaccccacaaaagaagatctatccatccagaatccgtggattaactttatttggaaaaaaaaggtatttgcagatataattaaattaaggatctcaagatgagataatcctagattatgcggcgaggcccgatccaatgatgtccaatgtgcttataagagaaacggcaggcaccactgtactctacagcctgggagacagagtgagaccgtctcttaaaacaaagaaagccaaaggcataaaagatgaaaaatggtctacctatacagggcacttaccatgaatggagtttgtaggactggaagttgctctggatcagtgagtgagtgagtggtgagtgaatgtgaaggccgaggacattattgtacactactgtaggctttataagcactgtacacttaggctacactgactttattttttaaaataaagtaattgtgctacagcgttacaacagctaagacatcactaggggataggaatttttcagctccattataatcttatgggaccattgtcatatgtggcccacagctgactgaaacatcattatgcagtgcatgacagcaggcttgaaaaaaacgtgaaatttacctctaatcccactgtgagagataactgcagtcaacggtgtggcacagacatgtttctagatcttttctacatgaatgtgtgtacaatagtcctcacttatccaaggagaatatattctaatacctccaatagatacctaaaaccacagatagtaccaaaccctgtatatactattatattacctatgatgaagctgaatttacaaattagacacagtaagagattaacaataataaccaataataaaatagaacaattataacaacatgccaacatcactgctcttgggctttggggccattattaagtaaataagggttccttgaacacaagcactacgataccatgacaactgatctgatcaccaagatggctggctacaagtgactaataggaaggtggcatagacagcatggagaccctggacaaagggaagattcacgtcttaggtgggacaaagcagaacagcgtgagatttcatcatgctacttagaatggcatgcaatttaaaacttatgaattgtttatttctggaattttccatttaatattttctgaccaatgatgactgtgaataactgaaaaaaatgcaaagaaaaatcgtggataagggggaactactatatatatgtatgtttagggatgtgtttgtgtgtgcgtgtgtgcgtgtgtgtgtgtgtgtgtgttctctccaattaaaataggacaatactggccaggtgcagtggctcatgcctgtaatcccagcactttggggagtagaggtgggaggattgctggagtccaggagttcaagaccagcctgggcaacataggaaaccttgtctctacaaaaaatacaaaaattatctgggcatggtggtgtacctgtagtcccagctactggggactctgaggcaggaagatcacttgagcccgaggggtcaaggcttcagtgagctgagattgtgccactgcatcccagcctgggtgacagagcaagaccctgtctctaaaataagaaaaaaaaaataggtcaataccatacatgctgtgaggaagtctactgtctgcacttaacattgaatcctaataacctgatcctttgtgtaaacctgaccatcaggacagcaggggacaaaggaggccaggggagcagtaggagtggcccaccacagcacagagtgttgtatcactgcattgtttagaaacaccaaagcacgaggagagtatatgcatactgatttttagccagctaaaaattactgttctaggtcttctgcagataatccacactactattgctgctcctaggtgggctgcatccaccacctccccttggcaagctgctacaccagggaagatggtggtttgggtggggcaggggatgggcatgcttcaccagaaggcaacacgacagaaggtacacactacgtgctcattagacaaagttagaaaaccatcccacactccctcctcacagagatcttgattaaacatatgagataatgtccactatatcttttgtgatcttgagaggaaaagcactagaataggtaaatttaagtatattaaaaatacagcccattttccatcaagtccaggcaatggtatccacagtcaagcagttcccctctaaactcgctgctgagtcacaggacagatgactttcttgccttcttttttttttttttttttttagcatatcaaagaccaaaacttcttgagatgagttattgagaagatataagggaaactgaataaactgctttaaaaaccatcaacctgtccacaaagacacaaatagattttagcttctaacaactacagtggtataattttcctgttagccatttcccttgaaataataattgaactggcaagtccattcctcataaacactttcatcatctgtggcttgacgaggcctagctactgagccacagataaatgtttcttcaagatagtaaatcatgagccatatgttagaaattacccttcacccctataaatgggactataccccgctttgtcctttccaaaacagtggaggggatttttggcagccagactcacattagaatccctgggaataacactgctaatccccagcatgacactctgaagccttcagagtcatatttcacaatagtattttcacagtgtctgcagagtccgtgtttataaaaacagattcaaaacaattaaaaaaacataactggaaactgaactccagccatgtcaggtgtgaaaaaagctcttggtactggctttgcacatgcctgagatacaggcatgatcctaagaaatagcaaaatgtcatgatggaaagccccagctctgcagccccagtggcctgaattcaaaatctggctcctctcatttctaggtgtgtggcctcgggcaagtaacttggcctctctgtgtctcagcttcagtatctgtaaaatgggaatggtgataatgcttgcttcacagggataaaagagttaaatgtgacaatataaatgcttctaaacttcctgatcacagctttctgaaactacgttagaatacgcctaccatagcaaacacttaagggacaagttgagtcaagggttttataggccaagcctggaggtggaatattcacttttgttcatattccattagccagaatttagtcacatgaccacacatgcaaaggtatccaggaaatatagtccagttgtgtacacagtgaagaagaggggaacacaataatggtagcaatagccgtctgtacaacacacatttaatagaaactaaagtttcatgaaacaactcctccacttactatacatgagaaagggtgatatttctgttttactccattccattccatactaatctatttcatttaaaacacattggtcttcacccaactggctgattttcacaatccactgatatttcacaattcactatttcctcaacaagtgtttgctgttgtcattggcaatggtagtggcagtgagcaaaaggataaactagatacttccaaatttttccaaaaattcttagtgtttgggttcacaagactttacagtgatgacatactctagttttgacttcaagtattaggagtcagaaatatgcatctagaaacactgatcaattcctggaacctaggctgcctgtggaacacgtagttaactataatcatacattgtaggaactaagaggaataaacattcacacacacacatgttgcatgcatacaaatggatgatgaccaacaaaaagaggccagaggagacataaaggagaaagagccaaggcaagaaaaagggaaatttgtccattctggacacataacactggcacagagcccagaacagaggaagcaccaggtactgctttctcaatgaatgaaccagtgatgcatcaggtcttgctcctcagctccttgccctagaaattcctcacaacctgtgcataagttagttcaatgttcttccctggccttcttaatgggctaaggaatttgaccttgctttgaatagtcacagaggcagtgtaagggtttaagatgggtaggacatgatcaaatgtgcatttcagatggatacctagggttgtactgtggctggcctgacctgaagcagggaggccagggaggaggtcagaggagactgcggcctgagctatggcagatgataggtagagaaagaagggccctgaatcagagaatacacagatgtccaaactgataggtgtgggtgactgatttggagataggatgctcagacttctgacttgggacaactgagtacatgaaagtgctatttgttgagataaaaaacacagaaagagaaaaagagaatttgatgaatccaatttttgtacaagttgtttcttaggcctctgacgttcagtcaaaatatgcccagttggcagtgggagcgtggactggaggtaaggaaagagtgctgtgtagactcaggttgagaattattatcaaatgaatgatggttaaagtaagaggatcaccctgggactgggtccagactatacaagatcacaggccaccacaacaactcccaaccttggggccgccagcccactgtaccacagaagtggcgaataggaatgagcttagatgcccaccagacataaggggaaaccacctaatgcctaggtgaccctggattatggctcagtttctttattcattcaacaggtatttattgagcatctattatatgacaggcactgtgctaaggactaaagaaaccacggtaaacaagaaagacatggtacctatgcatgatctgttgggtaaggcagctgaaaacaaggaagcaaattttaacactcaaattgttgggaaatgctatgaaggaaacaaacagggtgttgaggccaagaatgctggggaaggggaaggatctactgagaatacaagattagagaagccttctcttaacaggtgacatttaaatggagacctcaagggtgaaaaagaacccagtggggaatggtaagcagagtgaactggattctagacaaaggcaaaggaaagagattggatgtttgaaaaactgacaggtaagtgttctggagctgagaaaacaaggggagtggtaattaagggttagatcatgagaaggagtttgattttaactctaaaggacattgaatatgttcaagcagaagaataacatgatacaccacacacattttttcccctagagacagagtgttgttctgtcacccaggctggagtggaggggcatcatcatagctcactgcagcctcaaactcctgggctcaagtgatcctcccacctaagtctcccaggaagctaggactacagatgcataccaccacacctggctaattctttaatttttttgtaaagtcagggtctcactacgttgccgaggctgctctggaacccctgggctcaagtaatcctcccatcttggcctcccaaagcactgggattgcagatgtgagccactatgcctggccagccatacgctttttaagagcaccactctggctgccatgtggagaatggatgaaggagaaactgtggactcaggacactagataagaagggaatgatgatggtgatctatacaagaggataagtaggggtgatgcagaggagtcaaatggctttgaaatataattggaggtatagtctttaggacatggttataaataggatgtgtgggtatgaggaataatcaaagatgatttctaagtttccagcttcagcaactgaatggattgaatacctatctctcaagagttagggttactgtgaggaattcagactataatatttatacatcacccagcaccagggccagtacattaggtgagtggctataaacaggaggcttcctcaccattactgcattactcttcccccaagaaaccctcacacagagcaggtttaatgacttctctgtcctcatttttcactcacctccatcacacagaatccaggactattctcttcacttttttcccacacagtttgcctactcaaatactcaggggaaaaaaaaaaaaaaactacctagtatctttttactaagaaaaatatctttcctcccagctctaacaagttactcagattaatcagttcctcccaccagggccaccctcacccaactgtgaatcagaaagtgttcctatcctcatgtctaaaactccaagtggctgttgtccaaagatgtgagtctagaaatgcccccaagcaaaattcatatctgagagcctagcaattatttccaataatattcctcacattaacaccatgtgtcttttagtaactgagtcaactttctgctgcttaggctaaggtgacttgaggagaatactccatagatacaaaagggggaattgcaaagacttcaaggattacacaaaagaaggaagccgtctgtgtttgttggaaccaggtcgtaccagctcaggagctgaaatccccaactatccattaaaagaaattatgtcggtagcttgaaatgggccatggtgggagtaactatgccagagaaatctgcaaatactacaaatcaggaatttcattccccatccattatgacagccggttgttaaacgtttaccagcacatcatgggaagcagcttttgtttttaagctaccatttaatgggcaattactatgtgccaggcactgtgctaagtaccttactcatgtgacctccctctgctcagcaacccccagtttgctgaccttgtcagagttcttggtactcatcttgctgtctcatcccacctcatctaaactttcttcagtccttctgcctggttttcccttctctccccatcctatcttcactaccatctccctaacatctgacacagctccccttaggaagcctttgctgaattcctcaagaattaaatccagcaaactatctaccatataccaagcaaacagaattattgctcctctgtatcccttctgtgtcacatacagacttgtctcatggacgttaattacttgaattatgtgaaaatgcccatttagttttacttataaaacatatgatggagcccttctggggtcagttcactcttctcagaagaactgtatggaaaccaaaactttattccaaggagtgtgaaaagtcagcaaggcccaagccctctttccttaattgtcttttcctttctaaggaactaggaatagaattagtaaaacagagcttgaagcaattctaagaatctcattaaaatatgtgtctggcaaagaattcattcccaacactcaataatcctctgtttatacatatgcagcccagccaccagggaaggactgatcaaagccatttgcttcagtgggtacaacaggctacaccctcagtagaaacccaaactgttaggcaagttctttttaaaaacacaagacaatatataactatcggacacataaatgttgctatcagcaaagaataaaaggttaagaatatgctcttattcataataaaatagttcccatggaacaatttcttctttacaacagtaggagagcaacatcttactatgtttccagcgaattcttctttccttctggaagcctgttttctggatcagtttcagaaaggatgctttattaacatgcttagctacatgagaagcaaatgctgccattaactcagagtcaaattgcaaaaacataacttcttccagttcctgaatcaaaatagtcatcagtctgttggtttggccatctttgtattccaccattaggcagaataccgcaggccatctgagcacagcacaaggttttagcttgctgcaacatccaaagtctgcagtcactttccctagtaacccgtaataaccccaagaacatccccaggtaaaaacctcatttgggttttgaaagcctcaaattaccttatccatgaattgcagtgcattttagcagggcataaaaattattcatgttgaggataaaaactaatttctcttaattatccaaaacacattaaacacgtttataaatagctataaaggtaagttaaaattccaaaatttaattataatgattttgcatttatagagtctccaggaacatcctaactcatatgcaagaactcaaatgcaactgcactgcaatctacagcaaaagagagtttgcaaacataatagggtattctgagcatctctaaactcaagcttttttttttttgcttatttatagatgtatttatatgcggctttatgggggtataaatgaccaaaaaattatatatatttaaggtatacaatgtaatgttttaatatagatatacattgtgaaatgattgtcacaaggaaatcctgtcatttgcaaaaacatacataaacctagaggaaattaggctaagtgaaatttgccagatatatatgatatgtatggaacctaaagaagttaaactcataaaaacagacagtagaaggggacaaattttcagttataagatgaataagttctagagatctattgtacagcatagtgactacagttaatgataatcacatacatgaaatttgctaagaggtagatcttaagtgttctaaccacaaaaaaaggcaggtaactgtgaggtgatgaatatggtaagctcaagctcttaagaaaacaagcctttgctattaacttctttagaaaaaataaaatgcattccacaaccactgacattgaaatcacacatgtcttaggtctaaagaatcatgggccttcaagctaagaaagctcttgggtaaaagataagttggtattgtacctgggctcgtatttcctgaaagacagtatagaagtttctttgtgcagctgaaacataaacctcttagggaaacatttctgcccattaccagcttatcagagaccatcaagaatgggatcacccagtatctccttcttgatttgattaaactatcattaagtgcctgagagatggacagtggcctgacagcctctgaccttaaagtaactctaagagctatttgtagaagctgaaggagaccggatttttcgtccacttttgtagttcgtgacctttggcttaaaaggggtacaattaggtcttactcatgctgattaaggcaaaaataaagaattatttctgactggagaaaaccccaattattaagttatcgtatactctccaattgtctataattttacagcaatttcactaaaatctgcatcaaacgttttctacatgacttaataaataaaataccaattaaaatgttccaggtatgaggaaaaggcacattctcctatctaaattgtgtttatgacatatcagggattgagtatcccctgaatcatcccaattattttgtgactattctccagaaaagaagcatattaaaaacaaaatatacaaaggtcaaattgaaaccctggaaataggaatgatgatactatttacagtggacgtgggaggaccatatgagtggaggaaggtactggataagtgctaactgagtgatatctcaaaataagatcacagattaatctaaagaaccaccttgtgcagaggacctgacaagagatgtcttacattgctttaggaaaaaactaacaggccgggcctggtggcttacgcctgtaatcccagcactttgggaggccgaggcaggtgaatcacgaggtcaggagttcaagaccagcctggccaagatggtgaaaccccgtctctactaaaaatacacacacaaaaaaaagttagccgggcgtggtggcagtcacctgtaatcccagctactcaggagactgaggcagataattgcttgaacacaggaggcagaggctgcagtgagccaagatcacaccactgcactccagcctgggagacagaaagagactctgtctcaaaacaaaaaggaaaatgctaacaatacaactttgagtgcatcaggttgctctaagtgccatgaggacaggggttgtttgtcttgctcacaacagagtactctcatctcccaacatggtgcgtggtacacagtaggtattcaaaaaatacttgtgggttggatgcatgatttaactttacttttgctctgctaactatgtaaagtctcacttttattaagagacacacaaacatttgtaattagttctcctaaagtttttaatgtgacacaaacatttaattagatgcttttattttattttattttattttattttattttattttattttttgagacggaatctcactctgtcgccagcctggagtgcagtgacgtgatcttggctcactgcaactctgcctcttgggttcaagtgattctcctacctcagcctcctgagtagctgggattacagtcgtgtaccaccatgcccagctactttttgtatgtttaatagagatagggtttcaccacactggccaggatggtcttgatctcttgacctcatgatccacctgcctcagcctcccaaagtgctggaattacaggtgtgagccaccgcacccagcctagatgcatattttgaaaacactggaatatcttcacagtcacatcaataagatacaagattgtccccaaaacagccacttacactcagaaaaaaagttttttttttaaccatgggacgtgtctgtgtgtgtgtgtgtgtgtgtgtgtgtgtgtatgtctgtctgtctcattataaagccacatgctggatttaagttgtctttgaattctttctcttcaaaagtactttcacataaactcttttaacactccataaaactctgccttttcctaatgtaactgcttgcctcatgtagaatctcaacttctttggacaaaaagcagacccagtccttactatctgccacccaggctttgacatctccttcactgaagaaatcagcaaggaatatgataaccaggtttcatctgattttctttttcaggccatggacgactaaatgcttgatcagagcaagcaggaccctgtgttccataatcatgtgtgacaatacgtaaaattgctatggaaattttcctcattaagcccatctgcaaatgtttgtccccaagtccagggtgcactcttagaaagaggagtatctttttacaatttgggtcactggagtgcattgcattctgagcaggaccccaattactctagcatctgattaatgtctgtccaaactcttgccccgtaacaagaccctctgtaactcagctaaccacctaacaacccacatcattagggcctattatcttttacaatgttgattcttggtatccaagggctgtggttcagacaaactatttaaaggcattaaaataacaaccgtcttgccagctgtgggcatggccaccgaaactaccaccaggtcacaaaaccagatgcaacagatgccaggaagaagactaaaaggcagagggaacacccacttgagaaaacaaatccacttgtgtcctacaggagagcactgggcagcaaatcccaaggtctggagaatcaatagctggtaagagagatgtagcactccacatcctttacctaaccctgctgaatggctctctgaaattttatctcctttcttgccaaatttaaccttgaacaaggcttaaaattattaaatctcagacaaattatatctcctttcttctggccataagactcaacactacaaaaatcatatatggggtttctgatagcaactgttactcaccgttgtcctttcaagttaacctgtgactgtaagttcatgatggaataggtatcattgctgagccctcactacttaggcatggttaagaattttgcctgtccttataaaactaacttctgttttacaaatgagaatggggtcagggaatgtttagtaactttctcaaaatcacacagccagaaaaacacacacacacacacacacatacacacacacacacacactcacatacacaccaagccagggtttgaacccaggtctctctgacaccaggattcttatccatgcctccaaagcttttgggtcttagaatttattccagacattttcattcagtagttcccaattttccaatgatgaagacacctttccaaatgacaaaacatttcataagtcaacatatgaaaagctcagcatagaatctgatacatactgaacacccaagaaatgttaggtgagttgtcaccatagcattgttacaagggaccccaggatagcaattgtactttcaggatgcattgataactatgcttatgaaatagttaatttttatccattataagagttacattcatctgagacaaaaagagtactctgtgtgtataaatataggtatgagggtactatatgtgatttgctgaatacaaaaaatacttgtagcacatatgaatatgcagaccttataaaacacacacacatcccagattaggaactcctcttgaggtcccaacttttcactgagtggtattccaggacattcccttagctgtccccttcctcccatttgtgaacagtgtatccgtaggatgctgcacctccaaatacacatgttatgcatatctttacttaatttcaccactttttaacatatttaagtacttgcctaggcaggaatttaaatagatgcaacagagctacctacataaatcagcccatcactgcaatatataatttctcccataagccaataataattcaattaaataattatcagagctggatggagatgagcaaaataaagagtgactttaaggagagaggtaaagcatttagaatacgagaaacatggagataggaagattatcattagttgcggctctcactgttattttagagactctaatatgtttgctgtgggcatctttatgataatattatgattttagagactctaatatgtttgctgtgggcatctttatgataatattatgtctatttcaattcaaaacaagggattatttttaataaccttttccctaattacaaaagtaacatgattttttaaattaaaaaaacacacaatagtttagggcaaaaagtaatcataatgcccttacccacacattatagagctattaacattttcattaccttcactcagtctcttacccatatatttatttatttttctaactatttatatatccttatatttctgtacttactaaaactggtatcatatgatatataaagcttagttctgcctctttcatttagcatcatatattgagatatttcccattaactattcctcaaaaacataagtaatggcattaaaatattccatctcacaggcttaaagataattatcattgtgattctttactatcatttagaaacatgaacatggcagaagggaacttttctcaagaagaaaaaaaccttttaaaaataacttttatggtgttaaatgtaacttggtaaacagcaaacaaaaggatacatgcaacctcttcaccatgagattaaggaccatatttgccttatctaccatatcttcaaggtctaggagagtccctggtacaatgaatatttatttaaaggaaggaaaatacatatggctaggcattgaagtttgaaggttatacttggagaactgcacacttcaggagtctagaaaacttctcaattccccaatcaccataagctgccactagatgaaatggtgatcaggaagaaaagacagtaaaacattatgttttcctgtcttgtagatggcatttgtgttaagcgtaaactgcttccattttgcagcatgcaaactagctggcaacacagcaaagtcgactgtagtaatttgatccccaaaatgcatgaagaatttatcagatccagacaatgtgggaataaactgacgcatcttcaaccagattttccaatcattcttcctgggacataagcttgggcagggtagaatttccatgattcatcctatcaaatcataaagatgtcatagggctgccaccaatggaccattaactgttgccaggaatattacattcattccttcgactaaaaagatggcaattctaacattcatagagggattttgaacatttacttaaaaataagctttttgctctcaatttagacaaagttcattctagctttgctcttgctttgtttacagttaagttccactttagtcaacaggttaggaatttaggatacctgcttgttttacttatacttgtctcaaattgtagttttaaagcactgctttgccctatcttattaatttacagatttaacagcaaacacaaggccaagatattataaatccccagtgttcagagcagtcaaaaataagtagcaattcctgaagaagggggacatttgtgctgctcttcacactgaagatctttcttgtccttgggctgtgtccaggggctgctaacttctcagaagttaactcagtgacaaaagacattttggtgcctcattagacacaggcaaaggccagaccgtaaactctccagcaggaaagaaagtgcctagctagcggtactggggttgggaggtgctctatagtcaaggggggcatctatgagataaagcaagaaatgtcacaactaggccaggggaaaattcaggctgagaaactgcagaatggtcacagcctcagacaccaactcccttaggaactcaggcccagaaaatgagaaatgaggggcctggtgacttagctgagccccagagtccatttcaccttccatctagtttctacagtatagacatagtcaaatctgatcactcccctcctctgctgaaccccttcaaaggctcctcagcacccaatggatcaagtccaagcatctcaaggcagcacttgaggcctttttgccactctgcccagcctcctttcacaccaccccctttttctcactagtttcagatcactgctgatttcagtgccagtgcatgagagtgtcattcatacccttccttgtcttgaatctgcacccctgctccacctcccatctatttgctcctcctccctctgtctggcctgcttcctgactctattcaggccttcaagatgccttgcttgacctcccagactagactgccctctcctaatatacaccacaactctccttggtcacagtccttattctggaaatgtcctttgagatgtcagccaggccagagggaacaggcaggttgggacattcccttagctgttccctcttagactgtaagctccatgagggtgtagaccatttctgtcaatttattgctttatttcccatgcccagcacactgaggcacatagccagtgctaaggaaatattcactaaataagtggacccataaactgttttgttcctcgttcaaagggattcagaaggaagagcattgggtcttgcccaaagtcctctcacaggtaggtaaaacaagggtctgtctggggacccaggcccaccttggctgctgactcttaattacagagaatagtgtcagtaagcgcaaatagcatcctcctcatttttaacctacagacaagcagcagttccaggcttcagaaaattctcaagtgagttgaccatgaaaaatacaactgaaagtttcataaagtcacagcattcagtcccttcaggcagaggagcattgctttgtggagttgagagaaccacatttcccctcttacttcgcccttgacaacatactacagtataaaaatacatactttacacacaaacaaaccccaagcagaaacctttaaagtacttttatgattagcagacattttcccaatatcatcagtgggagatatgtaaacatatattgtagtaaattaaattgcaagtaaaactcctgatctcatttcttcctcctaactgacaatagttctcttttgtgcaagagcgaactacctgggggctgataaatcagacataaagaagagaacttggcaagggattctagtcagttgctatggagatgtgcatttgtgtttcctttaataaaaattattatccacgggaaaaacaatttgttgagcccatctaattgaaaagaagggaacaggccaaaaatggcagagtttaatatttatgactcaaaatctgcttttaagcctggagaatgcatatataatagggataaactatttttacataatttaattattgcctgatggcatattcttgagggaatccatataggtgtgctttgtactaaatactacattttatgctataaaatgaataatgcatccacactgtaggtgtgggcttttactttgtgcttaagttacactatcaggcattccttaggaaattccacaactgaagactcaaaattgaattaagctaagtaaactgtcaaagccaaaaatctccattaaatgcagaaatcttggataaactgctgggccttttcagtaagtgttattttgtttatgtctcatctttcagatctgcatgttttaaaaactgtaatataaacataaaattatttgaccaactttagtcatccctgatattcaattaacatttaatagaagacaacctgtatctacatttgaatatctaccatatgacaagaaagttacatatactgacacttttaatcttcacagcaaccctacaaattagaagttcctagctccattttacagaagttgaaacaagaaactaaaagcttaaactatactttctgaataggagtgatatcaccaccaagggggcaaaagttggttcttaggggatgaaaacactatagatattacaatagttgctagacttccaaagctaaaccctattccataaaatttatctcattaggtagaacttaaatttaatataatttttcagccagagcaatcatacaagagaaagaaataaagggcatccaaattggtaaagaagaagtcaaactgtcgctgcttgctgatacataactgtatacctggaaaaccctaaagactcatccaaaaacctcctagaactagtaaatgaattcaataaagttttaggatacaaaatcaatgtacacaaatcaggtgccctgctatacaccaacagcaaccaagctgagaatcaaatcaagaactcaaacccttttacaatagctgtgaacaattaaaataaaatacttaggaatatacttaagcaaggaggtgaaagacttctacaaggaaaactacaaaacactgctgaaagaaattacagacagcacaaacaaatggaaacatatcccatgctcatggatgggtagaatcaatatcatgattaattctacacaatagcaatctacaaattcaatgcaattcccatcaaaataccaccagcattcttcacagaagtagaaaaaaaaaatcctaaaattcatgtggaaccaaaaaagaacccacatagccaaagcaagactaagcaaaaagaacaaatccgtaggcattacattacctgaccttcaaactattctatagggccatagtcaccaaaacagcataatactggtataaaaacaggcatatagaccaatggaacagaatagagaacccagaaattaagccaaatacttacggccaactgaactttaacaaaccaaacaaaaacacaaagtggggaaagaacaccctattcaacaaatgttgctgggatatttggcaagtcacatgtagaagaatgaaactggatcctcatctctcaccttatacaaaaatcgactcaagatggatcaaagactcaaatctgaaaccataaacattctagaagataacattggaaaaacctttctagacattggcttaggcaaagacttcatgaccaagaacccaaaagcaaactcaaaaaaaacaaagataaatagatgggacttaattaaactaaaaagcttctgtacaacaaaagtaataaagaaaacagagaacagaataaacagagaactgacagagtaggagaaaaattttcaaaatctatacatctgacaaaggactaatgttaagaatctacaaggaactcatacaaatcagcaggaaaaaacataatcccatcaaaaagtgggctaaggacatgaacagactattttcaaaagaaggtatacaaatggccaacaaatacatgaaaaaaattctcaatatcactaataatcagggaaatgcaaatcaaaaccgcaatgtgataccaccttactctttcaagaatgaccataatcaaaaaatcaaaaaataataaatgttggtgtggacgtggtaaaaaaggaacacttttacactactggtgggaatgtaaattaatacaaccactgtggaaaacagtgtggagattccttaaagaactaaaagtaaatctaccatttgatccagcaatcccactcctgggtatctacccagaggaaaataagtcattacatgaaaaagatacttgccacacgtttatagcggcacaatttgcaattgcaaaaatatggaaccagcccaaatgcccatcaatcaacaagtggatacagaaaatatgatatatatatgtgtgtgtgtgtgtgcaccaaaatatggtatatacatatacatatacacacacacacacacacatgcacatgcacacaccatggaatagtactcagccatgaaaaggaacaaaataatggcatttgcagcaacctggatggaactggagaccattattctaagtgaagcaactcaggaatggaaaaacaaacattctatgttctcattcataagtgggagctaagctgtgaggacacaaaggcataagaatatacaatagactttgcggactttggggaaagggtgggagggatgtgaaggataaaagactacacatgagctacagctcccagcatgagcaacgcagaagacgggtggttactgcatttccaactgaggtaccgggttcatctcactggggatcttcggaaagtgggtgcaggacagtgggtgcggtgcaccgagcatgagccaaagcaaggcgaggcatcacctcacccaggaagtgcaaggggtcagggaattccctttcctagccaaggaaaggggtgacagatggcacctggaaaactgggtcactcccaccctaatactgtgcttttcctatggtcttagcaaacggcacaccaggagattatatcctgtgtctggctcagagggtcctacgcccacggagcctcgctcattgctagcacagcagtctgagatcaaagtgcaagtgggcagagaggctgggggaggggcgcccaccattgctgaggcttgagtaggtaaacaaagcagccaggaagctcgaactgggtggagcccatcccagctcaaggaggcctgcctgcctctgtagactctgcctctgggggcagagcatagccaaacaaaaggcagcacaaacctctgcagacttaaatgtccctgtctgacagcttggaagagagtagtggttctcccagcacgcagcttgacatctgagaacagacagactgcctcctcaagtgggtccctgactcccgagtagcgtaactgggaggcaccccccagtaggggcagactgacacttcatacagccgggtactcctctcagacaaaacttccagaggaacagcaacatctgctgttcagtattcactgttctgcagcctccactgctgatacccaggaaaacggggtctagagtggacctccagcaaactccaacagacctgcagctgaaggtcctgactgctagaaggaaaactaacaaacagaaaggacatccacaccaaaaccccatctgtacgtcaccatcatcaaagaccaaaggtagatagaaccacaaagatggggaaaaaacagagcagaaaaactgtaaattctaaaactcagagcgcctctcctcctccaaaggaatgcagcaacggaacaaagctggacagagaatgactttgacgagttgagagaagaaggcttcagacaatcaaacttctccgagctaaaggaggaagttcgaacccatggcaaagaagttaaaaaccttgaaaaaagattagacgaatggataactagaataaccaatggagagaagcccttaaaggacctgatggagctgaaaactacagcacgagaactacgtgatgaatgcacaagcttcagtagctgattcaataaactggaagaaagggtatcagtgatggaagatcaaatgaatgaaatgaagcatgaagagaagtttagagaaaaaagaataaaaagaaacgaacaaagcctccaagaactatgggactatgtgaaaagaccaaatctacatctgattggtgtacctgaaagtgacggggagaatggaaccaagttggaaaacactctgcaggatattatccaggagaacttccccaatctagcaaggcaggccaacattcacattcaggaattacagagaacgccacaaagatactcctcgagaagagcaactccaagacacataattgtcagattcaccaaagttgaaatgaaggaaaaaatgttaagggcagccagagagaaaggtcatgttacccacaaagggaagcccatcagactaacagctgagctctcggcagaaactctacgagccagaagagagtgggggccaatattcaacattcttaaagaaagaattttcaacccagaatttcatatccagccaaactaagcttcagaagtgaaggagaaataaaatcctttacagacaagcaaatgctgagagatcttgtcatcaccatgcctgccctaaaagagctcctgaaggaagcactaaacatggaaaggaacaaccggtaccagccactgcaaaaacatgccaaattgtaaagaccatcgaggctaggaagaaactgcatcaactaacgagcaaaataacgagctaacatcataatgacaggatcaaattcacacataacaatattaaccttaaaggtaaattggctaaatgctccaattaaaagacacagactggcaaattggataaagagtcaagacccatcagcgtgctgtattcaggaaacccatctcatgtgtagagacacacataggctcaaaataaagggatggaggaagatctaccaagcaaatggaaagcaaaaaaaggcagatgttgcaatcctagtctctgataaaacagactttaaaccaacaaagatcaaaagagacaaagaaggccattacataatggtaaagggatcaattcaacaagaagagctatctatcctaaatatatatgcacccaatacaggagcacccagattcataaagtaagtccttagagacctacaaagagacttagacttccacacaaaaataatgggagagtttgacaccccactgtcaacattagacagatcaatgggacagaaagttaacaaggatatccaggaattgaactcagctctgcaccaagcagacctaatagacacctacagaactctccaccccaaatcaacagaatatacattcttctcaacaccacactgcgcttattccaaaattgaccacatagttggaagtaaagcactcctcagcaagtgtaaaagaaaagaaattaaaacaaactgtctctcagacaacagtgcaatcaaactagaactcaggattaagaaactcactcaaaaccgctcaactacatggaaactgaacaacctgctcctgaatgactactcggtacataacgaaatgaaggcagaaataaagatgttctttgaaaccaacgagaacaaagacacaacataccagaatctctgggacacatttaaagcagtgtgtaaagggaaatttatagcactaaatgcccacaagaaaaagcaggaaagatctaaaattgacaccctaacatcacaattaaaagaactagagaagcaagagcaatcacattcaaaagctagcacaaggcaagaaataactaagatcagagcagaactgaaagtgatagagatacaaaaaacccttcaaaaaatcaatgaatccaggagctgactttttgaaaagatcaacaaaattgatagactgctagtaagactaataaagaagaaaagagagaagatcaaatagatgcaataaaaaatgataaaggggatatcaccaccgatcccacagaaatgcagactaccatcagagaatactacaaacacctctacacaaataaactagaaaatctagaagaaatggataaattcctcgacacatacacccttccgagaccaaaccaggaagaagttgaatctctgaatagaccaataacaggctctgaaattgaagcaataattaatagcttaccaaccaaaaacagtccagaaccagacagattcacagccgaattctaccagaggtataaggaggaactggtaccattccttctgaaactattcccatcaatagaaagagggaatcctccctaactcattttatgaggccagcataatcctgataccaaagcctggcagagacacaacaaaaaaagagaattttagaccaatatccttgaggaacatcgatgcaaaaatcctcagtaaaatactggcaaaccaaatccagcagcacatcaaaaagcttgtccaccatgatcaggtgggcttcatccctgggatgcaaggctggttcaacaaacgcaaatcaataaaaataatccagcatataaacagaaccaaagacaaaaaccacatgattatctcaatagacgcagaaaaggcctttgacaaaattcaacaacacttcatgctaaaaactctcaataaattaggtattgatgggacgtatctcaaaataacaagagctatctatggcaaacccacagccaatatcatactgaaggggcaaaaactggaagcattcccttttaaaactggcacaagacagggatgccctctcaccactcctattcaacatagtgttggaagttctggccagggcaatcagtcaggagaaggaaataaagggtattcaattaggaaaagaggaagtcaaattgtccctgtttgcagatgacatgattgtatatctagaaaaccccattgtctcagcccaaaatctccttaagctgataagcaactttagcaaagtctcaggatacaaaatcaatgtgcaaaaatcacaagcattcttatacaccaataacagacaaacagagagccaaatcatgagtgaactcccattcacaattgctccaaagagaataatacctaggaatccaacttacaagggatgtgaaggacctcttcaaggagaactacaaaccactgctcgacaaaataaaagaggatacaaacaaatggaagaatattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaacaaaaaaacagcctgcattgccaagtcaatcctaagccaaaagaacaaagctggaggcatcacgctacctgacttcaaactatgctacaaggctacagtaaccaaaacagcatggtactggtatcaaaacagatttatagaccaatggaacagaacagagccctcagaaataatgccacgtatctacaactatctgatctttgacaaacctgacaaaaacaggaaatggggaaaggattccctatttaataaatggtgctgggaaaactggctagccatatgtagaaagctgaaactggatcccttccttacaccttatacaaaaattaattcaagatggattaaagacttacatgttagacctgaaaccataaaaaccctagaagaaaacctaggcaataccattcaggacataggcatgggcaaggacttcacatctaaaacatcaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaacaaccccatcaacaagtgggtgaaggacatgaacagacacttctcaaaaggagacatttatgcagccaaaagacacatgaaaaaatgctcatcatcactggccatcagagaaatgcaaatcaaaaccacaatgagataccatctcacaccagttagaatggcgatcattaaaaagtcagggaacaacaggtgctaaagaggatgtggagaaataggaacacttttacactgttggtgggactgtaaactagttcaaccattgtagaagtcagagtggcaatccctcagggatctagaactagaaataccatttgacccagccatcccattactgggtatatacctaaaggattataaatcatgctgctataaagacacatgcacacgtaggtttattgcggcactattacaatagcaaagacttggaaccaacccaaatgtccaacaatgatagactggattaagaaaatgtggcacatatacaccatggaatacgatgcagccataaaaaatgatgagttcatgtcctttgtagggacatggatgaagctggaaaccatcattctcagcaaactatcgcaaggacaaaaaaccaaacgccgcgtgttctcactcataggtgggaactgaacaatgagaacacatggacacaggaaggggaacatcacacaccggggcctgttgtggggtggtttggggggagggatagcatcaggagatatacctaatgtaaatgacgagttaatgggtgcagcacaccaacatggcacatgcatacatatgtaacaaacctgcaagttgtgcacatgtaccctaaaacttaaagtataataaataaaataaaattgtaaaaaaagactacacattgggtaccgtgtacactgcttgggtgatggatgcaccagaatctcagaaatcaccactaaagaacttactcatgtaaccaaacaccacctgctcccctgaaacctattgaaatttaagaaaataaaataaatttaataaaatttttcttcttaggtgggacaataatgaaaaagaagactaagaaactctggtctaacctccagcaagtgatggagccattcatttacttcttaaacagacatctggggaatgtctgtgggctacacactgtgcaggggctaggtgtatagtggtgaacaaaaccaatatgtatcctgagtttcccaaagcttctagccccaagagggacacaaacgtaaatcaaataaccacacaagcaaagatactattgaaaatcatgaagactgctctgatagaaaaagagagtactgagaggtcagaaactgcctctttacaggtgcgactttaggctgagaattgaaggacaagaaggctcaagtgcgaaaaaaaaaaaaaaaaagaaatgggaaagagtgttgggctcagagaacccaccagaaagacatgctgccttggaaaccaaggaagtaagagaggagctgctccctacttccagagatattattacttcaatggcttagtggccaaagactgatttccaggttcaaaccacaactttactcctgataagtttgggcaatttttttcatctcgctgggcctcccattttggcattcataaaatacagataccattgcccacacgtggctgttagggagattaaaatgaaaattgcggaaagtgcattgcatatgataaaagcataataaattggttgtctacaatagttatcattatcataaatagattaatacgacaaacaaaagcagatgcctctgaatggcacaaagactgggtctggcctccagtcacagtgtcagtaattgccttctgtttatcccctacaatatcttacactgtgattatagggctttatgcagataagaccagcagcacacacagggacttctgaatcatgattatttctatgtgttataattagacactatcctcaggttctgttacgtcatgccattctgcatttcccaaaagattttccaatattctgatgccatgaaatgctttattaaaaaaacaggttacacagaaaaatggttttggaaacgctgcctacaatatgggtctgctgggttttggaaacactgcctacaatcagggtttcggttgcaagccaaaaattggctgactgaagcagaaatgtattgaaaggttacagggcagctcacaggatcattgagagggatggagaatcaggctgagatgtctctcagtcgactcacggcccaaagcacaacataaagctgtctcatcagtcagcaatgccactgtagctggcgtgcctgtcacaaccatctccagcactgaccactgaacagtgccgctggctccactgcaattgtccctggagcctgtgtgcttcagacttcaccactgccacagagaatatcactagctgctgtccaaatttctagactaacacatctgattggcaaagccaaggtcacgtgctcaagggatggttgtctgggaagttgggaagtacacatctggtatttcctagttatttggtgggagtcaagttctgcttcctactaagactcttaaggtcgagaatcctctccaccaactatagaaaggaggttctgatactgaaaaaaagaaaaaaaagatgaatgtgtattatatcaatgggctccaaatgttttgatcaggtactcttatcaatgaaaataattgagcatgcacccttagtatatgtgcacatatttctaagttaaatatacataatactctaatactatgatagatgaagcaacctgatagaagtcacacacataaacaaacatctgttagagacacacagtgaagtaaggaatttcaaaatctataatctaatttgaaaattgaaaattttcaaattagattatagatttttacagctattactatgattctctttttctctctgctttttgtcaggctaacattaggtactgactaagcattagcaagtgtcaataatgcagaagccacccacttctgcaaaactgggaattgaattcaaacaatgttattcttctggttttggttatagaattcaagagatattatttcagagtctacaaaagttgtcatctcaccaaaaaaaaaaaaaaagtaattcttgctcattgactttatttatgcagcattccctgtagaataataatagatgctttacacagagtcctgcacagcaatcttgcaacctcctatagaagagaacactgagggcaggttatgaacttgcccaaagccacactcaattccaaggtgtactacctacctccatgtaaacatcctgtcatttctgcataaaatctaaaaagcagccgggcacagtggctcacgcctgtaatcccagcactttgggaggccgaggcgggtggatcacgaggtcaggagatcgagaccatcctggctaactcagtgaaaccccgtctctactaaaaatacaaaaaatttgcagagtgtggtagtgggcgcctgtagtcccagctccttgggaggctgaggcaggagaatggtgtgaacccaggaggcggagtgagcagagatcgtgccactgcactccagcctgggcgacagagcaagactccgtctcaaaacaaaaaaaaaaatctaaaaagcatttcaaaattcctgaaacaatctacacaatagtacaatgagaagctctgtcatcttctgattaaaaaataaaaactgaggatacaagaagtaattgatgactcagataattcactcatcagtgtaagaagagataccattttactgtcaggtactgtcaagagtatattaaaatgtttttagtaatcaaaggcaatgctactagcaacataggactccagatactgaaaattactgagggtactacatccatgtgaaaattattggtgctgagaaaggcagataatatgagatatactggttggaaggacagagcagattaaagttatagattatatcttctgtttgtgagaaatgtccacaacatacagcttgaacccaggttctctaagccacatccacactacattcctcttagtttcccatgcaaacaatttctgtttttccctgacctgctgcagagaatgtcccccttcatggaacaccatggacacaccaccaccaccacctcctgctcccccatcatccattggccaactgttattcttctctcaattctcaactacaacaccatttgcttggtgaggccttgtctgactgtttaaaataagcttgggtgctcttgcgtaccactgcccaaaattttctgtcttccccctttctgaaccatctactcataagtacttatctaatttttggctcccctagaatggaaggtcagagtacagtcaccatgtcgatcttgagcaatgaatatactccacacctcccccatagtaaatgctcaacaaatattgaatagatgaatgaatgataaacaaatgctatacaaccgctatagctagatgcaaaatacatcatagtcatcttgtttctatgggtcacaaaaccatacaaaagcctcctggccacgacatgtgaaatggaaaaaaggagacctctagacagactccctcaagcctggcagagcttcaggcaatgcctgtatctttcctccatcctgggaacaagcagttcccttcgttggcttcgtattgagaccatcatacttgtctcctccctctatctgctcagggagcagccatccccagctgggtgcctcttctcatgacaggaatgaacacagactgtgccaccacagaccaagctcagagagaagaatttaaccacttccctcccaaaaacagggcagctgaccatgtctgtagacaaatgtagctctgtggaatctggactgtcctcatctcttcatgttccatttttcaaaggaatctttgtttctaaaatgaacattttgaaaaccaggaatagagcatccaagtaagtcagtatgaatgatcccactggaggagattcctttgctggaagagcaaagcttgctggcattgtggtgggacctctgttaaccactgtccccatttcacaccacactgattgaattatgcctcttagatggaaaaatattttccccaaaaccaagatggcacataaattgaaggcaacatacgcaagaaagtggaagccacatttgtcaaatgcagagaggatgaattaataaaaggacaacaaactcaaaggctaccaaagaaaaatggcaaaaaaaaaaaaaaaaaaaaaatgacaaccattttaagtctagttgacttagcaggataaccacactatttctgctgacactttagccctgcaatgtatataactctccccttttttaaaatccctgcttcttggcacctataccctgactactgaacctctctttggcactctctgtagtgactaattaggacccagccctagtaataaagcagggggccaacattttatcttaggatccttattctctgagtgactatttctatgctaaaaattacttgcagtattttcctctccactaagtacatttttaaaatacattctacaaaacattatctccacatgttaaaagctgctaattctacatgttaattcaatcacatctttcaatgatatattcttacataacttcaagtgaataatatgtaaagagatatccatagcaacttagaatataaacaaaaaatgacatatagattttaaagtttgtgtatgtccaccatctgtcaattagtttcactaagtaatatattcatatactcacagagttatgtataatcatatttttagattcagatcagcaagaatgctcaagtttagcacagccaaaggctggctagagtgtggaaaagtcagccctctcatgctctgtgggtggatgtcttaagcagcacaactcatttataagggaatgtggtaaaattttaattaattgtcccaccaatcccactactaggaatttgtccagtgaattatttacacaaggaccttagtgtttacgttaaaggatgtctatagcagcattattcagggcacacacaaaaaaaccaaaatgtccaaatccagaataaagaggaaataagaaagataaaaatgaccaggagttcaagctacagcttgagtggcaggggtgaggggtttttcatggtgatggaaatagagatggcgggggtaaaaggaacacagagcaggtgaggagagtacttgtttattattgtaagggaacagtgccacagtctatgcatcctttgtcatggcatatgacaaatttaactatagaactttgagcaactctgaaattattattgtggctgcaagacagacacaccatgcaaacactgaaacacgggtcaaggctttccaagaaaaacacccacacacgggttttaatatgcaagaatacccacagttacaaaccaaacatgcatgtattctacatacagacaactgcacattattctcttctacattccacttcctgggaggccccaagagatactaatcaaaataagtaaatactaataaaaatcagagaaactgaatacccattatgagccaggaacatgctaagggatttacatgaccaccaacacaatgttggcaggtgacccagagttaactttctcactgggagtgttatctcctatcaactcttttcttggcctctgataagaggggacctgctcccattcctcatatacctcctgcctattcccttgttccccctgtccatgtgtcctcgggcaagtcctttctcatcaacacccagctcttctcatattctcctgctctcactcttgccttctaccctattcctaggtttctttagtaaaatctctcaagattttctccactcccaccatgtgccccctccttttttccccatttgttaactgtttcaaaaggatccctgaaggtatcagcacactactaagggggaaaaaatgaaaaaagggggaaaaaagcattatctgacatctcaaagctggcctggcactcacaccaggccatgataatccacaattggacataatagttctcacagaacacaacttcagacaaggttacactgagaccatgataaggccacatcataactttgtctaagcgcagacaataatgtcactgtgccacccacaaaataccaaacacttccttcacttggctaaaataagtgactgcttcttatttaccaatgaaaattttatctttgctctcttgtcttcatcatagataacatttattgagatacccaatcatagaattgtgcccaatttctaatctgcagcaaaatctcacttctttagacccttgcctgaatcacccaacccaaaccgaaatcctaaattaggcttttgtctaacaccttcttactaaggctctgcattgatgcatgttctccctcattacaacaagtgataaaaccaatataatcaacaacaggtgtgttcctggtactctgtgtttaggtagcattgacactaacatcaaagggaaaggaagtcctatgttctgaagaaaaataggatgtcatcctattgatgcttccagcccaccaatgaccaggcaggcaaacactcatgcccagctcacagggatccagctggaacttcacatcctcagaaccaacaatctgccttcctaagcactagcatttatggcaatcagaactgcgcctcatgcacttgtgtcatctttctgtttattgaagtactatcgcgacagagatgctttctactattctactatttttccagtgaaaatatgtaatatttcagccagtgaaaagaactcggatcctaagcaaatgaaatctgttatttgctccaagatacaaattacctacctacaaaagatttaatgacctatatttcacttataattgttcctatgagcaatcgagtctcatttggtaacttagagaaaatacttccagcccacatgcaagaagactgcttctgtttgattgtttttaattaatcctctgcaaggaaccgagttttgtttgccatcatctccccagcacctagcaccatgcctagtggtgctagaaatataacagaggctcaaaatatttgctaacgttctgtagttgtacaaaattaaaagtgcacgaaaagtggttattaaaagacagggaagatactcaggaggctgaggccggagaaaggcctgagtccaggagttcaaaactgcagtgtgctatgacattgtcaccgcactccagcctgggcaacagagtgagacctcatctctctctgtctctctctctatatatatacataaaaagacaggaaagagatgtgaaaaggtgaagttttagaggtatgatgagatagtacaaggcactacgggaatgacaaatgggtctccaccctactcccaggctacactctcaactggtggccagggagaaagagcatataaacactcctgtctacaagtcctagactcactagctctcttctccgtcttaactcctaacatccttcttggcaacctccaccttcctacgacagactcatccaaactccctgggcctcttattttttacccttcttctccaataatgttttaatttgctgtattgtagatgcccatgattactccaaagacattggcagcacccaaaactgccccttgtttaaaattcttatgcaaacacacttctctttaaactcactttacctccagcttacttgctcaactacctccacctcagtgtgctctgtaacctacagatcccaccacattctcatcagctctccctaatcattcccccactggccctgcttggattccaagtcactcatcataaccactcctttgcaaataccctcacatcctttcctcctcttgtcccatagaattcacctccattcttaatgttaaatacagatacagtgtgttctgttacaagatctgttttcataaaaccaatgagctcaaatgtaattggtgaacaggggaatgaattcactataatgtggaagttgcatcggttcctgggcagtttttctaaagcaatggggagtaaggtataggagcacactgacagcctccaacaggaaagaaagcaaacagctttcagttcggctaaaatcctctctgctctttttttttttttaattaaaaaaaaaaatccctttagcatgtgaaggtccctccctacaagggcataccccaggtttactggatgtcacgttgtaccaaattgtacttctccctgtgccctcccgaacagaagcccccctgactccgctttgcttccatctgcactgcctctgcacccaaaaactagttttccaccctactctttcttgtgcctttgtattatctcatgagactgacagcaccatgagctggtgaggatgtgacactagaacatctacgtggtgctggtgggaatgcaaatcaggaaaaccactgggaaaacgatttagcagtatctaccaaactactttgtgccccagaaattccacccaagagaaatgagcgaagatgtccaccaaaagatacgcacaagaatgctcatagcagcactacatagaataaacaaaagcaggaaacaactacatcatcaacaggggactggataagcaagttgtggtatattcacataatgggaaattgcacaataataaaacataagttacagatatggataacaacatgaaagaatttcatagacatgaccatgagagaagaagtcaaacacaaaagtagatacaatagaaatccatgtatgtgaacctcaagggctggcagaagagtgattacctcgaggagacaatactgatggggaggggcatagtggtctgctggggacaggaaacttcctatattttcatctgagtggtgatgatataaatgtaaatttttttattcgtcatttctaactgtggtaaaatatacataatatttaccatctcaaccatttttccctgtagatttcagtggaataagtacattcactttgttgtgcaaccgtcaccaccatccatctccggaacttcccaaattgaaattccatgttcattaaacaataattctcccttctctcatgtcctacccttgtaccagctattggcaaccatcattctacttcctgtctctatgaatctgactgctctaagtacttcatataagcagaatcatacagtatttgcctttgtgtgatttcacttagcataatgtccttaagtttcatccatgtctagcttctgttggaacttccttccattttaagtctgaataatattccattttatgtctatatcaccttttgttttgccattcaattgctgatgcatgcctcagttgcatctacctgttggctactgtaaatattgctgctatgcacatggtgtacaagtatctgagtttctgctttcagttctttggtgtatgtacccagagggtataaaaattactttaattcatcaaactgtatgtttaagatgtgtatactttactgatttgtacgttatgcatttttaaaagtgtaaaataactaaagagcaatgacaacaacaaaaatatcccccaaaatatcttccagctgcacttagatgcctacttgggccgcctttatggctttttgggggatggggtagggcagggaggggttccagttcatgtttttgttaatgctttggttataatgggtaagagtccataccagtcctatttttcccacaagccccaatcctaatattaatgcataattttacagaatgcttttttccagaacttcacgtactttgttataatatttaaaatatacccaacatatacttatttggcatatatttaccaagtgccaggcattattcctatttattgaggatacagcagtgaacaaaacagacaaaaaggccttgccttttaagggcttgcacactaatagataaatgtttttaataggtattcatatgttatttatcaacagttcccccatggcatataaactccatgagggcaagttctgtcctatgtccactcctaagcacagtgcattatacatagaaggtgcttctaccattcttagagctatcattcttaaagcacttttggccaacctctggatttcacagataaaggcagtttcagagaaatgataatagcagcccaagtcacactgttaataaatatccaaccggaatggaactaggactctttcatacagaacaggacaaactgtaagagctaagggttcttagatatgatacttaagtacaaagtctgaaggggttttagtctttgctcagagaatcattcaagaagaaaaacagtaacaagctaaagcaatcaaagataatgaggcagtccttgccattttttccagaaggcttctagtcttattatgaggcttattaattacttaagcagaagacatgatgtggattgagacatctctaataataaatgaaaaatgagagtaaattttattgtgcaaggaattgaaaacattctaactagtacatggaattaggaacattctgaggctcagctctaaaaactctataggttagatcattttctcctttggcaaatatctagtctttttttttttttttttttttttttttgagatggagtctcgctctgtcgctcaggctggggtacagtggcatgatctcagctcacctccgccttctggggtcaagcaattctcctgcctcagcctcctgattagctgggattacaggcgcctgccaccacacccggctaaattttgtatttttagtagagacagggtttcaccatattggccaggctggtcttgaactcctgacctcagataatccgccagcctcggcctcccaaagtgctgggattacaggcatgagcaaccatgcctggccaaatatccagtcttacaatgatgttcgttaataatttaagcagaagacataatgctgattaagacatctctgatgataaatagaaaatgagaatatacttcatcgttcttaaatagcatccatcacactattgagccttaaatttagtaagtaaaataatttatcaaacccattatttgaaaaggtgataaagccaatttcaaaaccagtagtaaataaagcaggactgcatccatgtatcacccattaaattgggggttttttgtttgttttttgtaaagatggggtcttgtcatcttgcccaggttgatctagaactcctgggctcaagcactcttcttgtctcagcctaccaaagtgctgggattacagacatgagccgccacagttggcctaaagtggttttaaaagcattcaaattattataaatagggtattcccttagaattcttgaattcaaagtcattgctcaggaaaaaaaaaagaattttataatttatgtattgcagaattatgtatgtaagaaaacattgccttcttaatagctagagctaaatgaaacatttgtgctttttggaagcattttattgttagagtaggagaaaaagataaactcaaaattgtgtcaaaaaatgaaaacagtataaatggcattcacatgttctttgccacttctctcagtatctccaggacacacattacctcttatacatattattgaaatagtttttaggcctatttcacccaagtgataagaaaattaaaaataggattaaaatatgcatcaggtgctgcctaagggcaaagtatcatgacatggtgttttatcttctttcaatcctcacaataaccctaagaagtaggaactattattactcccattttacagatatggaaactgaggcttagacctattttagttgaaattcaaactaggacagtctgattccagggctcatgcctttaagcattataatatatacatgtatcatagcttctgctctgacgccagattaagctcgctaaactgtggtgctccaataccctggatgactccttctgcattaagaaaagaattattttaccaagcattcaaaaccctccctgccctgaccccaaaacctatctttgaaggccaatctcttgcacttctatcattgactgagcattcttttctcaatatacaaaagactttccaagcctttcacctgtgtacacactcttctctcaggaatgcccttccaattcatcttttccagtcaaatcgcaacacattatctgagacctggctcagaagccaccacctgccattgtggcattccctcaaccaactatgcatgtggggatagcatctagactggctaccttgtatgcaaacattacaattagaactccatgacagttcatgatgtaagtatacacaatgcattataaattacagttgttgaacttgagacaattatacagaggttagagttatgatacatttatctgcactgaacatattcctcttttttgagccatagagaaccaggtcatgcctgatagcctgaatttcagcagctaagcactaccgtcagctgatctcttcatgaaaaataatattaaaattgtcaatagtgacttcactaacagacccacagcctagttactgagcatcagaccatttctctcatagatcccctagataagaaaggaaaatcattctaaataaattaactcttcagttgcctccacacaaaatgaggtaagcaataacaaactagaaaaaaaaatctttatagaatgtaagacctagacatagttttttttttttcttttttgaaacaaagtcttgccctgttgcccaggctggagtgcagtggcatgatcatagctcaccatagtctcaaacttcagtgtataattgatcctcctgcctcagcctcccaagcagctgggactacaggcatgcaccaccactcctggcttttttttttttttttttgacagagctggggtctctgtttcccaggctagtcttgaactcctggcctcaaggaatcctcctgcctcagtctcccaaagtgctgggattatggatgtaagccaccatgcctggcctatattttgttaattataaaccaaaacaatccaaaataagaaacaaaaatccactctaaaataaaaataaatatataaataaataatcctctcttacctagatacattagatcaattcaaggagaatagttttgggacagtctcccaaaccaagcacggtgcctctctaagggctttttcctaacaatctataattttccttcttttatctttcagaaaacatccttgtgtgtgctccagtagcctccattccaggtctacgcatgattatctgggtctatgaatgcctgggacttcatccttgtgctacaagtcacaatctcaacaggacacatacagagataaaatgctcaaccagcaacccaaagaaaaaactgaaagtgaagtggccagggccatgatgttgctctgctatcctctatcacacatcatcagaaataccctcacctctgtagtccttgattcactcccaatttaaaatgtttccatggattcccactgtatttacatccaagacctactccaccacactctttgctgcaccttctacacactagaattcttcagttcctcaagagcaccagggccttctgcctcagaccttcaaacatgcccttcctcattatctcccgtttccgaataattctcattcagccttcagagctcaacccaaaaatcacttcctcgaaaaaaccctcctgaacaccccttcagatatgcattggcactttctttttataacaccacgtatgcaactaaatacaactaaatacttgtttatctggttgtttaatgtctgtctccatggaacacagctctctgagggtatggactttaatggggtttactggctgttaaattcccagtgcctgtagatgctcaatcaatattgccaaatggatgggtttccctgtcagaccctaagtcataatttctgtcatggaaaataaagtcaacatttgtaaacagacttcattttggtcaccattgtattaatttcctattgctgctgttacaaattaccataaacttaaaaattaccataaatttaacagcttacaacaacacaagtccaggcacagtggctcacgcctataatcccagcactttgggaggccaaggcgggcagatcacctgaggtcaggagtttgagaccagcctggccaacatggtgaaaccccatctctactaaaaatacaaaattaaatctactaaaaatacaaaaattagccgggagtggtggcaggtgcctataatcccagctactccagaggctgatgcaggagaattgcttgaccccaggagctggaggttgcagtaagccaagatcacaagactccgtctcaacaaccaaaaaaaaaaaaaaacatttttgctctcctatgtttctggagataacaagtccaaaatgggtctcactaggttataagcaaagtgtcaacagggctgcattccttgtgaaggctctagaggttaatctgttcctttgccttccccaccttctagaggtggcccgtattgcttggctcatgggcatcgaccatcttcaaagccagcaatcacatcaatctgacctctgtctctaccatcacatctccttctctgactccaaccctcttgcctcactcttcacttttaaggaaccctgtaattacattgggctcacttgtataatctaggatagtctcctcatcttacaatctttaattaaaccacacccacaagatcctattgtcatgtaaaataacataatcacaggttttggagatccagatgtcctcatctttagggagatacgcctgaaagtgttttatttaatgtgcctctttccttacaggaatcctaataacaacaacaataataggaatgataatctactacaattctatatcttagagaatcactataaaaactcaagtacaggcaagacaaagagtagcagcatgaaataaactcaattcactcttttcttgaaatgatttctcaggtcctgtacatctcagatgattcactcaatccaaagcaactgccttaatagccaaaaaatggaatgtagtaaaatggcacatacaactaaagaggatggcttttcccttcagtgggtttttttataagttcaaatgggtaattggagagctgggaatttaattccattagattttataagttgtataacaacatcccaaaaatgcaattccattagataaactattactaaaggcaaaggtcttggcccacagttcttaacattttttagaccatgaaccctggaatttctgggacattcagatggttaatgggaattgtcttagtacattttgcatggttataacagaatatcagagactgggtaatttataatgaacagaaatttatttatcctggttctggagactggaaagtccaagattgaggggccagcatctggtgagagccttcttgctgcattgtccaaaggcagaagggccgagaggatgagacaaagagatcaaagggggaaggtgagataaagagaccaaactcatccttttataagaaactcctgtgagaacagcattaatctacacataaggacagtgtccccactaaccaaacacctcccattagactacacctcccaacatcaccacactgggaatcaagtttccaacacataaatttagggggacacattcaaaccatagcaggtattaagatagagtggtttcagttgggatacagacatcatgacaagtattagcagcaacagcatttttccctatagccttgaaacaatcaatgcttcccgatctctttagggtttatggtagaacaactgctttcacaaagagccttccctgtccagagtcctttggtctgtacaacctctccccctacccccaatcccacttttaatttatttttaccttatgcatacaacaatcattcaacaactatcactgaatacctactcaattccaagctgaaaactgagatgtaacagtaaacaagataggtatggcccctgtccacatgaagctttcatttctactgagaacacaaaagaaataattacacaaacagttgtaatagtgatatttgctacttgccatgtagaactcagagtgaagtcacaaaatgaatacacatggacaaaatgaatacacatgggcaaggcaaaatttggcctagcattgtagatagttgccaatgcttttttgaaaaataagatttcacaataaaataagagttttcttgtactctttttaaaaattcattggaactgagtagcagctgcccctttttgatagggcatatggtttctggttttccaccattctcaacactcccttctgtctccctgaccgagtccaagttccagaccccatttttcatcccatttatgctgctatttttcccatagacctgcaaagtccaatgcagtagccactaaccacaaatgactatttaaatttaaattttacataattaaatgtgaaatataattaaaagttcaggtccttatttgcaccagccacattttaagtactaatagccacatgtggctagcggctaccataatggatcaggcagatatagagcacttccatcatcacagaaagttctgctgtcaacaatccctttcattttttacatcattcacttgaatcctacagacatatcagtttgaaagccctggtaaataacaatataaaattatttaagtgggaggatcaaattggatctgggaattcaaagaacactctcctgtggaagtgaccagaaaggtgggatctgaaagatgtgataatcttagttgattgacagtagttggggaaaaagttattcaggcaacaaaaacaatgtacaagggaacttacagtggaaattttgcttatagaaatatttcctgatgatcttagctcacttcatctctccttattaaaaaaaaattaaatccttggtcagcacatagctgagcaatagagggctgcatatagatttggagcttcaaataacatttcgatacattttttttttcaagtatcacttgagaaaccatatccactcgaagaaaatcaactttttttcctctccacttcagcatgatagtttccgatcctgagaccatccaggccctgaatgtgaaggccatctgctgagcaggccatttccctgggacagcaagtgctcttcttgagtggatttcaccaaattgcttttcctttctaaaggagattgacttatttgtagaggagggcatcccatccttggggcttttcgagaacttgtatcttcacagaaaacggtgtgctttgagagttgtttcagatcctaggctgctgaaggccaaggttttgctaacagcttctcaagcactggggtctatttattatattgaggtattttgggctccttgatggtaataatatgaaagcaggtccaatctatgcactaagaggcaccttgcttttctacttccatagaactaacatctactaagtgacaaactatttccaaggcttcactagttttgctgggaatagagagaaaacagatacctgagtattgccctaaaaaattcacagcttagaggtaaagccaacataagcacaattcctccaatcgatgcaaaaatagacatacgtaacaagtgttgaatgaacaaccaacacgaatgttggtaaaaacatcaggtccagccaacatgaaattacagaagaccatctctcatacagttcctccactgacctctcgcaggacatccagctgcagaatttgaggcaaaaacagacccaacttgccacttttcagcctaagcccttctgcccactctcctctctcagatcctttagaccaataagatttaagattttacttccattcacagactccccaacccacaaaatacctgcctgcctgtgcctaaggctgcattttatacttcattaacctagtatttttccagcatcagtggagatctccatcatgccaccagatgacggcgtcacccttcctggactccacatgtgtttactgcaagaagaaactaaaatcttccatactcaagcccttccagttggcctaatagttgcttatactttcatctttactatgaagcaactctgttaaaaaaattatttttcaggtgccaccatggatatatccaccctttgatcagggagaaaagcatatgtgaaattgagaaaggacacgttttccttttcctgggcaggttttggggatgtcagtcactgtaaaaatcttttcttgggaatgccgtccacatctgcaaactgttcctgcaaggtctatgtagaaatgcatttaagaacatagtttttcttaagcaatcctctctggaaaacaccaacctggcctcctcagctgaactataaagtcacattgctttctttttttttctatgacaggacagaaggaagtgattcacacacctgaattccctaagaaacagacattttcacacaggaaggtgttttgatagcttttctttctttggaagtcacgacgtacatgtgagttttaagggttccttattcagcagggaaagaaaacctaagatgggatgataacaatgtgaattataccctatttaaatgatttctgcctttctattttttccttttttttttttttgcactttatcagaagcaagcatgattcaaattataatattggcagaacaaatttgtagtttctaaagaagatattgtcacatctgcaccactattgagctgcataatgttgcccaagctcctcaatctctcttagacctaggccagagggactcttgtcctgggccatggactttagagggcacatgacaaaccccaaaatgcagggttttttcttttcaatcttaaatagaagttttgtttgttttcttaatttaataactgactaagccaatgggagggactcacctgaacttggactccagaccggagggtgctgaactgagagcccatgagagaatgaaccacagcctctgtccttggaaaccaagacgaaataggtgtttagtgttgaagtagacaggatcccccagataactctgttgtctcccttctccttgttcagaggatgtaatctgagaggcacttagaacccctggaaggcctgagtcagacaagtggggcctggaagtgaagaatctgccttacttgcctccctggggagcttgagcaggtcattaccacctgctcaggtttggtgagcccaggagtcttgggcgtggttccaactcccacctagccctgccccagcagatcagtgctgccacacagcctctttagtctgcagggctggcccaggggagactgaagctccaggcagagggctgcagggcccaggagagaaggcaggcatagcttaattggaccattggcatacttagatatttggtctgcgggtctctgttagcacttctccaggccccagcaatgctagagcaacttgcttctagttccttctctaaaaataacaggactcaattaaattgctctacagtttggacctgctctacaaaatcattatattttcatttaagtaccttaagataaagtgacataaaaattgcaattcaagatgtcagaaaaaaataataaactaaaatttatttttccagagttatttcaagaagaaagctttaaatgaattacagcttctggcttgccctttcctacctctcaggttgcatgccctataaaaaggatgtcattaagtaaaactatggtttgaaatgcataaggatccgcacacataaaataccacaaatactacactgtaaaattctccatgtggcataagaatcacagtttatcacactctaatgatcaactggcaattaatccttaaccacctcccagcactgaagatcctttctaaaatatacaaagggaaaaaattatgaagagattaccctaagactcagcatccaaacaataactttataaagaataaacgagccaggcatggtggctcatgcctgtaatcctagcactttcggaggccgaggcgggcaggttgcctgagctcaggagtttgcgaccagcgtgggcaacatggtgaaaccctgtcacaaaaaattagccaggcatggtggcatgcgcctgttgtcccagctactctggaggctaaggcaggagaattgcttgaacccaggtggcagaggttgcagtgggccgagatcccaccactgcactccagcctgggcgacagagtgagtctctgtctgaaaaaataaaataaaataaaaagaagataaaaagaataaacgaaagccatgctaaaagcagataaagactagaaacactgagaagtatttactattattacttgggagcattaacttagaagtacctagagatgtcaactgtgaaatactaatctgagttttaatttttctcatttttatactaattacaaagacagatgtgcttactacgcgcactgcttaaacaagtatagtaaaagaaacagctttcccccttctgatcggaggcataaataatatttctgtagtatgttctattcccatatatcacagaactggctgaaatgtatctctggcttccataaatcataagtacagttaagcagaacctcctcctccaatgtagaaaacaaacatagagcaatgaaatctagagttacacaatatttgagtgtgagtttcttcatagtccattttaattgatttatacagacaggaaagagggggaacattaaaccttttacaaaccttcccgagtttgcctaattaggccagtcctgcataaagagcttcatagttttggaaaatccaagagcaatgaaataaaaatgagataaattaggggaaaacacacatattctaacacctgttcttaaatcctgtgcttctaacaaagggaaagttataagtaatggacacgaagaacaatgaccagcttcttcaccaggccacagaattgtatctctgaaatttcaatccacattttacctttaagaaggaaatctgtgaaacaagccaaaaccatcaaaagtgtacatgaaaagtcatgcttgatgggagaagtttatttaacagaacattaactgagatgtgtaaaataactaatctcagtcaggactgaagatagtaattttttaaaaaagcattttcaatttttgtttaaaaatgtgctcagaatcttcatgtctagtaagttgctgagtaaatgtaaatgtaaaaactaaaatacctaaagtaaatgaccctgtttaaaaaaatatttaaggcagtgctaaatcatctaccatatttcttctgaatttaagacaccaacaattataagaagcatcttaatttatacccacagagaaaagaaaatcttgtaatagcaccaccaactgtgagatgcagtccaatttcagagacacaaaaatatgcttaaaaatgagtcatttaaatatggaaaacatatccagctattaaacttgaaaaagctagaataaacatttgtgtaaaacgaccacttagcaaatacttgtagaataaatggaaaaacgaatgactttacaaacaactttctttttaaaatttttttatatattcaggggtacatgtgcaggttggttacgtggatatatcgtgtgatgctgaggtttgggtttccattgtacccatcacacaaattgtgaactctatatccaataggtaatttttcagtcctcactctcctttcctctcccccattttggagtccctagtgtctactgttaccctctgaatgtgtacatatacccattgtttagctcccacttacaattaagagatcacacaatatttgattttctgtttctgagttacttcacttaggataatggcatccagctccatccatattgctgtgaaagacatgaaaaggactgatatccagaatctacaaagaactcaactcaacaagaaaaaacaaaaaccccattaaagagtgggaaaaggacctgaacagacatttctcaaaagaagacgcacaagcagctaacaaacacatgaaaaaaatgctcaacatcactaattatcagagaaatgcaaattaaaaccacaacaagatatcatctcacaccagtcagaatagctatcattaaaaagtcaaaaaacaacagatgtcagtgaggctgtggagaaaaggtacgccttatacactgttggtaggaatgtaaatttataacagctctatggaaaacagtgcggagatttctcaaagaactaaaaataaaactaccattcaacccagcaaatctactacagaatatcaacccaaacaaacaactttcttgatagaaaattggaataaggaaaatttctgtatatatgatcatagagataagatcatagatcatagagctatacatatgatcatagaaacagatagttcccccttcaccgagtctttcccttactactttggaccacctttctcttccatctcagagttcctacaaatgttggcataaaaaagcacacactctaacactagttttacatgcaaacacatatccacatacatacacactcacctacatgctagagcaggggtcaactaatgatgacatatgggttaaatgccagctgccagttttgtaaataaagctgtatttgaacaaattcatgctcacttgtttatgtattttctatggctgctgtttccatgctacaatggcagcattaaataattacaagagacagaatggccctcaaagcctgcagtatttatcatctggccgtttaagaaaaagtttgctgaacaattcacaattgcaaaaatatggaaccaacctaaatgcccatcaaccaacaaatggataaagaaaatgtggtatatgcacaccatggaatactactcagccataaaacggaacaaaataatggcctttgcagcaacttggatggaggccatttttctaagtgaagtaactcaggaatggaaaaccaaataccaaatgttctcatttataagtgggaggtaagctatgaggacatacaagcataagaatgatataatggactttggggacttggggaaggatggaaggcggaagagataaaagactacatattgggtacagtgtacactgctcaggtgacgggtataccaaaatctcagaaatcaccactgaaggacttatccatataaccaaaaaccacctgttcccccaaaactattgaaattaaatttaaataaataataaataaataaagtacatgacagcagcaatttagaaagtgcataatttattacatttataagctcataacaaaatgaatacttaggaacttttaaaatgaatttgaagtaacaattagatgtaaaattctcaaagcttggaacctgaaatattaaattctagaatttcttaaaaacttcttcttatgtaagagaaacttgcatagtttgaaaattattatgttcttccaaggaaaaaaaggaggaattaaaaaaaagaaacaaagaaagaaaaagtttgctgagctatgcaagaaaatataagaccctagagcacagaggccatgttgtaggctggtcttactctcccagcagcacctggcaccaagtaaaaagcagttaatgtatgcttattggtagattttactgacctaaaagtaggatatctctaaatgtagctgaaaagtcttctgatatacatacgtttcacacttgcccttattcaggctaatttccacttctagaggaagctctttaccctccattttacccttctttttgtaagttaatatttagtacctaaattaatcccacactagctgtatgactaatacagagagtactccatgtataccctgattaagttcactggacagatgctttgagggccatcagttgcctttcacaccaagaacaatatataacaaagaagcttttaccacctagcagtaatttcaaggcatcagtcatttcccagacatctgttgggcatgttctctgggctactctagataaagggctaccaagaagaattagacacagcctccaccttcaaggagctgagagtgttcttagacttaatctctttagactcatttcaaagtgaacacagagtaaatcgcatgacagcaaagaggacctcaagctgctgacaagggaaaaagatccgctgaattattccatcaggacttgggtgtttcctgtgttcagaggtcctggggcaatagaaggatgtacagtcacggctccttacctgaagccatatacaggacagggacaaggacaatgttgtgtcataaaaaagagcaaatggaagaagaacacagtcctttggatccctgaagaaaaagagattaattgtgacaggatcagagttgaagaggaggtaagagaagacctgtgaaggaggtttttaaatatattttaaacaagaagatgaatttcaacagaaaatcatttgggatgagggaagaataaaggcacaaagatagacaggtgcagtgcctggctgtattgtccatgctctataaggggagctattgtcatacagtcaccaaatgtttattgagtgcctattctgtgctaagtgatgtatctgagagcgaggcaagttccctttagaggcagaaaaaaactacttcccaggtgagtttatattgtcatccttctgatgtaaagaaagcacagtgtgggtgaggaacatggtggaagacaaggctcaacaggtaggcagggatccaactgtgaaacgcctgggatgcctcgccaaagaggttggattctactgtaaagatacttataatattttacatattatatattaaatatagatacagtcatgcaccacataatgatgttttggtcaacaaggaacaccacactatatacaatggtgttcccataaaattataatggagctaaaacttcctgtcaccgtgacatcatcgccttcgtgaaacagcagcacgaggcattactcatgtttgtggtgctgctggtgcaaacaaacctactgcactgccagttgtataagagtataacacatgcaattatatacatattatttagcaatgataataaatgactatgttactggtttatctatttactatattatactttttatcttgattttggagtgtgctccttcaatgtaaattttttaaaatttaactgtaaaacagcctcaggcaggtccctcaggaagtatccagaagaaggcattgacatcataggagatgacagctccatgcgtgttactgcccctgaagaccttccagtgggatcatcaacatcaacagtgatgttgatgatcctgatcatgtgcaggcctggactaatgtgtgtgtttgtgttttagtttttaacaaaaaagttaaaacagtaaaaaaaattaacagaaaaaagttcataaagtaagaatataaggaaaatatttgtatagctttataaaatgtaaaaatttacagtaagctaaaaaagtttaataaatttagtataacctaagtgtacagtgtttgtaaagtctacagtaatatacagtagtgtcctaggccttcacattcactcaccactcactcactgactcacccagagcaacttccagtcctgtaaactccattcatggtaggtggcctacatggttctcctaccttctctctttcataccacatttttgctgtaccttttctacgtttagatatgtttacagataccattgtgttacagttgcctgcagtattcagtacagtcgcttgctgtacaggtttgtagcctagaagcatatcacataggtttgtagcatattgcatagctgtatagtagactataccacataggtttgtgtaagtatactctatggacattcacatgacaaaatcacctaatgtcacatttctcagaacattgccccatcattgatatagtactgtattataaattaaatatatatatatttaatataatataaattctgctcacattttagggcactaaggatcattgtaacactggtcttcaaaaccaagcgcatttacagcaaagaacagaacataatatgaattcaactcactatgagacgtattaccactcatcctcaaatgtttgaacttgatcattttgggaaatacagaaggggcccagtatatgtcagtacagcaggcaatgtgctccttgtattgctagctatggattagagatcatttccaaatgacccaaacttaatattctatacaatttgccagacgtatgtatgtgtgtgtgtgtggtatgttgtgtgtgtgtgtgtgtgtgtgtgttaatagatatacactcttagtcatatgattattatttttttttttgagacagagtcttgctctgtcacccaggctggagtgcactgcaatctccgcctcctgggttcaagcaattctcctgcctcagcctccccagtagctgggattacaggtgcatgccaccatgccaggctaatttttgtatttttagtggagatggggtttcgccatgttggtcaggctggtctagaactcctgaccagtgatccacccaactcggcctcctaaagtgctgggattacaggtgtgagccaccactcccggcccttagttgtattttaaaagcaacaaaatttccttccctacctgaatgctcctttatgagatagctccagacatggcagtagatacataccttttagcagcttaatccccaaataaaggggatttttcatggctttttcaagattagtccaccagcttttatgtcctaaagtggcctatttcctaaaagcgacttcttttatccttccttagtgatatttcttccctaatcatcagtttttcctcagattctttaaaaaaaaaaaaaaaaaaaaaactcatcttcatgaattgtcatcccataatatgccagggtgatttaatatttcagcttttcttggctaatttatcttgacttgactgtgtttattaggctctaaataaggatttcccaacctcgacatcattgacattagagaccagataaccgtgttgtcgaggggcctgccctgtgcattgtaggatgtttagcagcatccctggcctccacccacaagctgccagcagtgccccttcccacacacacatccaccttgtgacaatcaaaactgtctccagtcattgccacatctcctgtggggggcacaatcttcccctgttgacaaccactgttctaaactttttagtttcattttattataataataataaaagataacacatattgaggtttacagttagccatccactattccaatcatgtttccagattaactcaatcctcacaatgacccccattttaaagatgaagaaatactcagacaagataagtgtcttgtctaaggccacgctgctgctaagtggcagaatgatgtcttgaacccgattccactgatgtcagacccttagctcttaactactagaccatttggcttttctgaaattgttcaaagtcaacaccagtagaacaggtacaggctttctctttgtcttccctacttagtgtcctgaagccatccagaaaacccagcacacatttgaggatttatcatttgtatagcaggaattctcgcatcttcgcagaagtcaaattcaactatctaacaactggtgtggctcggcatggatggatcccatggatgtggatcataaacaatccatatgagtatgaccagccatctggtgcctacaggatgaatggaactctgcattttcctcaactaaagttttattttgcccaagcagtcactgccttgggtatgcattcatagagtacctgcagggtgcagagaactaaaaactggtgtggacactttaaaaagtaagagatgagattctgctttccaaaatttcaaatcccattagtaggacaaaacacccagctacaacatgacattaagaagacttacagtgcatcacacagcaaacattaatttcaactaagcggggggtggggatcccaactcttatgcaattaaaagttagaattatagaatatttttcttagaaacaactttttaaaagcaagtgatcaatcaggctaataatatgttatgaatatgcacacctaagaagcatatttaataaatctaaaaatgacctgaagttctcctatcaatttgtttataatgaatagttttctattatgcttgaaagtaatttgtgctctttaatgataaaaacatttcccttctgcttcagtgtaatctattaatttgcttagtaaatgctttgcaaaggcaaacttttgcccagtccatacaaactggtgcaaattttaaatggttgggttatgtaataattatgctttcattagagaaatagtctttcttacaactattgaagactgaccaagaataaagtggtgggtgggaagtaacttctcagatggttctaatgagcccctgagctgaaaacaactgggtaaaggaatgtcggtgcataagggaaatgaggaatggctaggcgcaccgtggtacagactgcaagctcctggacccctgagttaatcagctcttctaccagctcctgctctatgaccttcagcaagttatttcctcccactgatctttagattcttcctttgcaaaatggatttgttcagtggaacaaatgagaaaactcatgtaaagagtttaacatgctatctgaaacacaggacatgcccaataccttttaataataattgcaggcattccacatgaggtgacttttgagttaagtcttggtcttgatggtgaaagtaaacctatcttcctctaataattcttgtaattttttcattcctaccaattcttttccttagtttgttggtttattttttgttttagagacagagtcttgctccgttgcctaggctagagttcagtgacacaatcatagttcattgtaacctggaattcctgggctcaagagatcctcccacctcctcagcctcccgaatacctaggactaaaagcatgcaccaccatgcccaggtaatttaaaaaattttttttacagacagagtctcgctatattgcccagactggtcttgaactcctggcctcaagcaattctcctgcctcggcctcccaaactgctaggattacaggtgtgagtcactgtgcctggccctactaccaattattttcttttaaaaatgggatttagccacaaaatgtattgatatgctgcacggtcttcctatttataatcaacattcaagatcgaattttccatttgctcctcagttatcccaaatcaaactgatttgttactctttatctcctgaatccttgagctccctactctgctttcaatagcgtcccatccttgccaacaattatgcaaacatttgcaccacctcaaatggctaaggcaaagacatatttgcttctacatgcttctttccaataactaattctgtaaacacaataaagtacattccaggcagtgctgaattttttacagtattagttataaacccctaaaataatttataatggaaattctgagatattcttcactacagaggatattggtcctagacccagcaacaaaacacgtgttcacaggcacacacaactgtatgtatgcaatacacgtacacagaaaagagttctgttcacttaacccaaatttattcagaacagtttatgttatttattttcatgagttttagacaagatcttttttagcacattacagaggcctggaggggctttctgcataaaagacaaagccaagcactgttaatgcaaagtatagtaactcagtgttttgagaaacatggccaaatgtatttgaacatgaggccatcaggccaagaaatcttggtgtctagagctgagagcaaaattggcagttgggttcttattatcaggagaatttcttgctacattgtggccactcagcttagcccacctcaaccttacaaggatgcatatgcatgttttgaaaacatttaagatgcaaatatttcatatcatacatatgctggtaaaacatgaggcatgagagacctgtttgcagtccttgctgggccacttacaaagaatgtgacattaattcaccttttttttttgagacagagtctcgctctgtcatccaggctggagtgcagtggtgcaatctcagctcactgcaagctccgcctcccgggttcacgccattctcctgcctcagcctcccgagtagctgtgactacaggcgcccgccaccacgcccagctaatttttttgtatttttagtagagacggggtttcactgtgttagccaggatggtctcgatctcctgaccttgtgatctgccagcctcggcctcccaaagtgctgggattacaggcgtgaaccaccgtgcccggcctaattcacctgtttaacctttctaaccctcagtttcttcatctgaaaatgtcatagcaatagcatctacacactacaggttgctgtgagaattaaatgagctaatacatgtaaaatgctaggcacaatgcctgcaacagtaagtgctcaatatgtattaactaagattagtatccattttatctgacatttccattataaaccacactcacaaaatctgcatcaaatttcttttttttttttttttttttgagacggagtcttactctgtcacccaggctggagtgcagtggcacaatatcggctcaccacaacctccacctcccgggttcaagcgattctcctgcctcagcctcctgagtagctgggattacaggcgcccgccaccacacccggctaatttttgtatatttagtagagacggggtttcgccatttgggccaggctggtcttgaactcctgaccttgtgatccacctgcctccgcctcccaaagtgctgggattacaggcgtgagccaccacgcccggccatcaaatttcttaaatggatattcttacacagtaagagtgcacccacaaatggttttgcaccataccacccaaaaatctaaagtccaaagataaactaaaaactagggcccatgccatgctgtatattatggaggaaaaagcaaagaaaaatctcccacaacatgaggcaagagacaggagtagatcagatcatcacactaagaaaactgctattcaaacagcttacctttaggaagtatgagaattttaatgtccttggagtgctatttggggttcaggaagaatcttttcctggaataagatctaagagggcttacaaatatttcaccttcaaaatgtagcattgaaagagcaagatgacacgctcgcttcagcagtacgtacaccaaaactggaacagaagagcaagctgaggcgcttgttccagagtttggcttctcacccactccacatacgcacacatattcaggtaattcaggaagcacttcaggaagccccctcattatatattttaaaagctccctttccatcaataaaaaggcatacatttctaataggtaaacatccgtcagttgaacaaacctgaagcatgactatacctaagtaaagttgccttcattttctaaaactcctgggcacacttaaatggatgtgtgaaattccatgaactccaagtatgggacggggatcactaaggtgctttaaccttataacagtgagacccagtgaaagatggactaactgatgaacccgcaaaccagcaaaatcttaatgcctaatagcaaactatgttgaataaagagccaatcaaaaatttactagaacatgaaggagactttaagagaccacttaacacaggctgcctggagagtgagaccttctgaaggtgcactgccatctaaacacgataatattgcagggatcccaaacaaagttatacacatgtaagggctgaagacatttctcacccaccatagaaactaaagaagtttcccaactgccaccagaaactacagaaagttcccaacagcctcacaatccaacctttcaagttgatcaacagaacaacccaaatgtccagttaaattctgtctggctaaactctgtaaaatgcaaaaaagtaagacattatcagtattgttcagtgagtttaaaagaaaaaaagctcaaaaaatcatatactatttcaatcttggctggtatttatccctacagttgatacaactgttttattttaaatggattgtaaaatgttaccagaatggccttaaaatcaatttaataactgatctgcactctcctggtacacaggaaaagcaatgtccaaaaatgtccaaagagaaacctggcaagaagaaaaaaataaatctcattcaaggctgccatctagtgggcaaatgaggtggctgtaatgttgctaagcaacatttggatggcatatttaaaactgtagaaatttggagctaagaagaaacttagttcagtgtttcccaaagtatatttcttgatagcaggattctgccatcaaatgcatttaacacatgctaggtgaaatgctgtggaaaatacatcttaaccataggatatctcacagccttaaatatgttaacctatattggaaatctctaaacggagacgtggcattccgcacttgtattcagtcagggaaactctttacttgtagatgcctctgaactcctcatagagtgctggagtttctcaaaacaatgtttgggaaatgctaatctaattcaactcttgcctccatattttacacaggagggccccagtaattgaagtaactggtcctcaattgaagtaattgaagtcctggttctcagcgctgccttatagctggtcaagttccatggcaggtgtgtctttgtaacccgagggctgggtgaaagcaggagggaggctgtaaggtgctcccccttgctcctcatccttagcattaaaattctcctgtgggaggtctggaggcttcatgctaagtgcctattaggcttggacatcctataacagttaaaatattgattttaaaacctaaaataatactttccttccaagttcttatggttattttttaatctggctgaaaattgatcttaatgttatagttcatctctatacgttttattgttatagttttgtaaaaacacaaattaagagtgtgtgagagttatttctgatgcctcccatacatgttccatctaaggttaaacctgaaggacaaccacaatatctagcaatgactgtggacatcaaaaaccaaagtattacgcataaaataatagctttaacaggggcatgcctggccgggcacagtggctcatgcctgtaatcccagcactttgggaggccgaggtgggcagattgcctgaggtcaggagtttgagaccagcctggccaacatggagaaaccccgtctctactaaaaatgcaaaacaattatctgggtgtggtggtgcatgcctgtagtctcagctacttaggaggctgaggcaggagaattgcttgaatccaggaggcagaggttgtggtgagccaaggtcgcgccattgaactccagcctgggcaacaagagcaaaactctgtctcaaaaaaaaaaaaaaaaaaagacatgccttacatttgcccaactgaagaaaatattacatgggatgctaacattggaattacaaaagcagcttccagagatgttattacaaactatcctgaaaacttaaatagatcttcacttggaaatagatagaaaactttttaaaaatacaactgtgggcattgtgcttatgggcaccccagggaacctatggagacgtcagctatgtagcaactttcagagtactttgttcaggtggtcctggctaagtggtctcaggttccacatcttctagggacagcatgagccacagccagatctccaactctcacacctgttccagtgtttttcactgctgtaccttaccagctggttattctaagaaggaatcatgtgttcacaaactctggctccagagaccattcccttctctcaagactgaaaaatgtaataataataacttaatgaagattaaaaataaatacaagtaatcccagcttggtacttttaaaataattttgatggctatatgatattctatcactgccagattcctatttagaaaattttaagttttctcttatttaaaaaagttttaccttatttaaaaaactgtttaagaaaacttacttttctttttctaaaaaagggaggaattgctctcaacttctttaggcacaaaatgttttctctactaaaaatcatctctaaaggatatcttccagaagtggagttacggaatcaaaaggttagactcatttatgttgacaagcttttttcccaaaatagttgtcccagtttacaccaaatttggaacattttagcctcagttatgaatgggaggcttgagagataactgtaggtgtacagaccacttgtggttcagtccaggtcaaacatgcacagcaactggaaggctctggaaatgctcatttgtttgcacatctctcagactttaagaagcctctccctatatatgagatacaaatgctaaagactccccaggtctgttgtggtggctctataatcccagcactttgagaggccaaggctgaggataacttgagcccaggggtgcgaatctgcaacgagttataatcgcaccactgcaatccagcctgggctacagaggaagatcttgtctcaaaaaaataaaataaaaatttcccaaactcaaagaaaagctcttacttaggaattcaacctcaaggtcttaataagagtttaatacctgcatataggattggtgtttcaatgggattaacagggaccaaaatgcaaagtggaaaccagactaaagtattgtcagttagtttagatggattgggagagggctagcgcccaagtttcaaacctggcacagctttgcaccagagagctggcttgtaattgctttatgtcgtccccttttattttccccatggattgctgcggcatgatgggatgttgcaaagtgactctaacaggcagagactaatttgaaatacttccttggctcctcacatattctaaagcaccccccaacaactatactcagcccaagagttaacagcattccttaagagcccttaaaccccttttttttttcactttgaaaatgtaagttgatggaatcctgctcgtttacattctgtgtattttctgacaggacccgcaagtattttcaaaggctccactctgagttagaattagcacattagggacagcagattcactgttaaggaggaggccccacctctggctcatttttctttccttaccttgctcagaacaggattccccacataccaactggccagctgacactgttgcacatttgcacaatcattcattcattcattcaaatatttactgtgctcttattatgtatgtgtcaagtcccgggccgggatctgaaagcccaaaatgaatgttgaatcagtaactccagcctcattcatctatcagttgtgtcaccttggacaagtaagctaattttcctgagcctcagtttcctcaactgtaaaatgtgggataacaatagtctctgcctcacaatattaaataattgtacatacttcccaaattaagtgtaataatatacataaagaacattatatctaacacctgttaaatagtcaaagaatatagtttagtcactaatgtgaaaaaagaagataataatttagctaattccggtgaaaaattattgtagcaattattcaaagaccatgtgccaaatataatgttttatttggtatacaaatattatatctccataatgaaatttcaacgtagttcacaattcttatttccatcccctagtggagaataaagggacaacggccttaatcttgacttagaagtaacacagttatcatttgttcacacctgtccctgaagactctctcctttctccatcttttcatctacctctaacttcttgacactgggaaagtggcctctggggcacacttgtcctctatggatgtgtgagaatagctggtgccatctacatttaggtgttggcctctggcatcaactacttaaggctgtaacccccaccacggactccaacaaggtccacacactcttgagtccttctcatccccatcctgggcttccctagttttccaactgtctcagctccctttgatagctcaagaccccgcagctgctttcgccacaccacactggggcttgagtcctataaggctgtcctcagccactaccatcttgaccatgcaagaggcctattgaatgtgcatcatctcatctccctgggctgccctgggaggcaagctcatttaccctgcttctctgggctcctcctgaggaatatacagcctagatactttcgagaaatttctggatctgaggagcccacatctatttccttcttccctcacctggaatgaggcagagtgcagggaatctctactcaggcacccatctgctttgcaagtccaatcacgtccccttggatccatctctttctgccagtgggttgaattctttctttcctttgggttggataagtgctctcctgccatttaggcattctctactctatggcttagaccctcactgttcaaaatggtctgcggaccagcagcatgaatgtcgttgcctaggagctaattagaaatgcagaatctcaggctccacctcagacctaattaactgaaagctgcatttgacaagattcccaggtacatggtaagctcattacagcttgagacacagcaggttaaagataaactccaaaacagttccctcaatgtggatcttcctctacaaggacaagaaaaatcatctctctttccacaaggctagctatggcaaatcaaacgtaacttggtgttcagactactgtaattttttaaactctgtctgaaagctttaaagtgagccattaccccttccacagaacgaaagaatgcctatgaattgccaggaggagacctgcagagacaactaggaacaaccagtacttaccatgaatgaaaatcacattggttaatatttcaaaaacattaacttgctaagtgctcatttccaacaggtgattaaaatcaccttgaaataaagtgagtactgaataacagagagttggacacaaaattaaactaacatgagctgactgtggctctgaagttaatagctcctaatgagaattatctcaatatccaggtatttgagacagatttattttctctccttaacatgtcgagagagtttgctcttgatttccaggaaaacttcataatttatcttttcttttgttgtaaccagtgacttaatttccaggaatttttttttttttatgggaggcagcctgatgtaacagaaagactggaccatgatacggtttagctttgtgtccccacacaaatctcatcttgaattctaattcccacatgtcgagggagggacctgtaatccccatgtgttgagggaaggaagtgattgaatcatgtgggcaatttcccccatgtggttttcatgatagtgaatgagttctcatgagatctgatggttttataagtgtttggaggttcctccttcacttttctctctctcctgccgccttgtgaataaggtgcctgcttccccttctaccatgattataggtttcctgaggcctccccagccatgcagaactgtgagtcaattaaacctctttcctttataaattacccagtctcaggcatctctttatatccatgtaaaaatggactaatacaggccatatgtttaaatacttacttttgtgaccttgaaaagaattaaccagcttccatatcttttaaatgggggtaataattctacctcagagggtcaccatgaggattaaatgagataatgtatgtaaaaccactggaatgaaacaagtgctacccacccccaatctcttctaggttttcgattccaggtgatcttccggacacctccagatgactttcatctatatatatctaaaattgtgcttggttcaacaataaatcccatcctctctgatttaaaatactgaaaattcatttccaaacatatgttccaagtttctgccctagtaaagtggcaaaatatttcaattcttttggtttataatacacattaatgcatcatggttacagtcttcatcagggatggcaagcttgagaaccacctgcagttcaggcaatttaacttacgtcaaaccaaacagcctcatccttatctgcccaatgctaaggctccatttcccaccctgaataactctagcagctcatatttcactgaagttacaaaaacagcaatacttgaggaatttaccaagcaaaaggccattttccatggcatcacgttcaaggccaaattaatgtgttgatgctttcacaattaggacaaatatagaggatttggcacattttgcttttcggccattgccttgcatgtatgacattcactccattagtcaactccagtcatattttctttttttaaatctgattctagcacagaatgaagtttatcatctttgtctacaaaaaaggggaaatggactgccagagatgtaaaagcaattcccagcatgttagtaattacagaggtttatcctggcttaaaaattctcatcaaggattttttattttttaggttggagacatcatgtcacagtaccagccacttcagttcacaatggagataattagacatattcagggtgaccttctctctcttctgaatgcgtccctgtgctttcagaccggcagcttatacacaattttttaagtaggataatcctttcattcttcatatcaagtcatgcacagaagcctgagagcaaaaagggcagccaaactcctctggatgcagcaggactagggggccagatgccctgccctgctgggtctcacctcacagcagatcctagactctaggaccctgcagtgcacctttaaaactcactgaccaagatgatctagactagggattggtaaattctttctgtaaagggccagataataaatattttcagctttgaaggccatacagtctctgtcacagctactcagctctcttgctatagcctgaatgcagccagagacaatgtgtgaacaaatgggtgtgctagtcctccaataaaatatgtactggccgggcgcggtggctcacgcctgtaatcccagcactttgggaggtggaggcgggcggatcacgaggtcaggagattgagaccatcctgtgaatggtgaaaccccgtctctactaaaaatacaaaaaattagccgggcgtggtggtgggcccctgtagtcccagctactcgggaggctgaggtaggagaatggcgtgaacccgggaggcggagcttgtagtgagccaagatcgcgccactgcactccagcctgggcaacacagcgagactccgtctcaagaaaacaaaacaaacaaacaaacaaaaaactttatgtactaaaccagggagctggctggatttggcccatgggctgtagtttgccaaccctgatataaactggaaatgtacctttgttcacgtgatattcgagatggagaagcagcatgtatcatagagagtgccccaaactccactttgtacaacttaaactttgatttattttcattttacccctaaaatttaccaaagtagttaatataggaaaattgtatctctttcattcaccaggtagctgctttgaaccttaaaactatgtttttcttttaattaattaattaattttttttttttttgagactgagttttgctcttgttgcccaggctggagtgcaatggcatgatctcggctcacagcaaactccacctaccaggttcaagtgattctcctgcctcagcctcctgagtaacgggattacaggcctgtgccaccgtgcctggctaattttgtatttttagcagagacggggtttctccatgttgatcaggctggtcttgaactcccaacctcaggtgatccacccaccgcagcctcccaaagctctgggattacaggagtgagccactgcccccagcccaaaaaactatgtttttctttataaatcatgatcatctcaaatgtaatctttcacacacagtgcattttaattcttggaagatgtacgttcactgcaattctataggtcaacccgccttaccgcaaaaaatatatttcataaataccatataaaattaggttgtgtccctcctctcctgtgtaagtagccaattttatgaaaaattgagcagaatcaaaaaagtttccttataaaaaacattatatcagagtgactggggacacaacaggtatgggggaggaaacgtgggttttagaataagttttgatataatatcccagataccctctaggttattatattatatatttatagtatgtaattctggtacagatttgatatgatatgatatgatatgatatgatatgatatgatatgatatatgattctgaaaacaatcaaacagagcccctgccctaagggaccatggaaagggctgcccagaagccttgctttttccatgtggccattctcagcaagctaggcctgactggtacaaggatgaaaactgacccaagctgggctgcctcccagcttttggctggatctataaaaggtaaattcaagagctatgggttggctgatgttaccacatagacccaaatgcagaaaaggcaggagagatggaacccccgataggctcgggttcccaccaccagcgcttcctcagggccagcagcacccagcacttggattccataagcttccttttcagtgaaaactcattttctaatgttgctaactagagtttcttgcaaccacagagtctgaacttttcatacactgccctgccccacttctcattccacctttccagccacactgctcagtcttctccagagagaatgagaatttgctccctcagtccacttggtctgcaagcggggaaagcaagctctatgagaatgttgtgggggaccctcaggaaaccactcctccccgtaagtcctgggactctctgccactgccaaacatcttcttatgggaagcagatgagaataacagactttctataaaagttaagtgaaaagcttaccaaataaggcaaaaaaaaaggttgaatgagatgtcgccaagggcccttaatttctgtaccaagtgaaacaattaaaaaacaggagaacatcgcccccgcgccccagccctggaacagcaattcacagtggctcccaggggcttggctgcaagctcaagcagcccttctgttacccacccagagctgtgggaggtgggccagctctggggacaagcactgctcacttagttgaagcatccttccttcagtcaaaccgaagatggcagatccaggtttggctctggccataatagctccagagcctgtgttattaaccgctatgctccaccacttccctctggcttctcctcctccctccataccctgacctgtccaacccatgttccactccagatcagccttccttaggagcagctttattatcatcactttcttgctgaaacccagcagctgcatcttgttcccaggccaattctcagaatgccaatttgattatgtcccagcatgacccacaaccctttagtggcatggtctaccatatctcacaaaatctttctctaatgctcctctgtgtcctaatgaaaacctctctccttgtccactctattggtattctcgacaaattaattcagttccttggttgcactagccactgttcaagtgttcaagagtcacacgcgactgtaactaccacattggacagcacagctctaaactttccttggttcttctaaggtcccagctctctgctgcctccagcctttttaagctataccctctgtctttagcgggttcccagtctctctttcccaaccctcttcttaaattccttttgatccttcaagtctcagcttaaacacaactaatccaggcttcacaagaagctttccttgccctctcatgcctaggttaagtaaccctcttaaacactccagaacatatttaataattgagattatttatatacaatctgttatttcccataaggatacgtacactatcttataaacggctctatctacactgtctagtggacagtcaataaagactcactaaccttattcttgtatataacgtctacaagaaggggaagcctcccctacctttcaccctgaacttcctctgatcctccctgcctctcctacaccccagccattaaataaattgcacagcttgtaactcactctcctctggactcatcctgtgttctcactcgagcttttcctgaactgtgccctctctggctatcccatcccatttcagctctcaaactctgcccctttcaaatgccacttcctacagggagcctttaggattctcaacattgagctgaaattgtttattctttactttttttttaacttttattttaagttcaggggtacttgtgcaggatgtgtaggtttgttacataggtaaacttgtgtcatgggggtttgttgtacagattatttcattactgaggtattacgtctagtatccattatttatttttcctgatcctctccctcctcccaccttccaccctccaatagtccccagtgtgtgttgttcccctctatgtgtccatgtgttctcatcatttagttccgacttacaagtgagaacatgtggtaatttggttttctgttcctgtgttagtttgctaaggataagggcctccagctccatccatgtccttgcaaaggacacgatctcattctttttcatggctgcatagtattccatggtgtatatgcaccacattttttttatccagcctatcattgacaggcatttaggttgattctatgtctttgttattgtgaatagtgctattctttgaactattttgtagactatgtttggaattgctactcttcaagtgtgtgtctcctcctgctggcccctgctgtgtggcttgaagagcaggggccacatcatcccagtacccagcacccaccactgtgtctggcacatggcacacactcaatgaaggtgaagttgtgggggaccactgaatatcagtcagagtcatcaacaagtgaggatctgctgagcttggatagttaacaaagatgatggcagaagaggaactgcaaagtaactatttgagtagcaatgtattaaagaggcagcagagaaagctaatgaacctctccagtatacttttggcaaactgattctcttttaaaagacagtagtgtaaaggccaaaggagtaacagatattccatcatggtagctgtcaattttactggaaaaattatgccctaatgaaaactgatatttgagtttcattctttgttccttctaaaaatgagcacagtttcacttgtcacctacattttgttaaatgtaagagttaaacactcatttcataccatttaatttcatttgcaagatgaaggtccaatctaaagttactaactttcctctcattacatatacaaattttggtccccaattttggtatcaattggttccaacatgaatatcctcacataaggaggatctccttcatagggatacagttgtaatgaattccctgtaacaatttaacattccaaagattgtcacttcttctttggtctcaagccaattcacctagagcaaaattatcctcttaatacccacatagaaactggccagagatgttttcagaacaggaagctctacagcagcaacaagcaaagcaaatataatactagcccatttccattcatcttactgcctttggcaaggaagagcccttaacatttcactctcaggcttatgtaacttacaagatagtaacttaagttcaaagtgttttttatttttagtctgataattcaattcacttttgattttctcactgatttacaaatataatataagaaagggtgagacactagcaagatggtggagtaggagaccccagccatcacttcccccatgaagagcaacaattcagcaactgtccatgaaaaaaaaaagtgtttctggaagagcttagcagtctacttaagtagcctcaacaatacagtgaaattaaaaaaaaaaaaaagccatgagaatcacctcccaaaaataataggaagaacagtttcattttctctgcaccaacccatctgtcatctgccctatagctgtgatcagcacagagaggaactccctagctccagcagccccccgcagagaaaaggatcagaaggggttgttataaacaactatatgccaacaaattggataacttagagaaatagataaattcctagaagcataacctaccaagactgaatcaagaagaaacagaaggtctgaccaaaccaataacaaatatagactgatgtagtaattaaaagcctcccaacaaagaaaagcccaagaccagatggcttcactgctgaattctaccaaacattaaaaaaagaattaacaacaattcttcttaaattctttcaaaaatagaactagaggcaatacttccaaactcattttataagaccatgattatcatggtaccaaagcccaaaaaaggcaccacaagaaaagtataggccaatatctctgataaacatagaagcaaaaatcctcaataaaacatgagcatcctgaatttgataatacatcaaattattatacattgtgaccacaatgtatatccctgggatgcaaggttgatttaacacatgcaagtaaattaatgtgatacatcacattaacagaatgagggctaaaaaccatatgatcatctcaatatatgcacaaaaagcatttaacaaagtttaacatcctttcatgttgaaaattctcaagaaattaggttaaacaaagtagtttcctcagcataataaaggtcacttatgagaagcacacagctaatatcatactcaatggggaaaaactaaaagctttttccttaagattccatatagggcaagaatgcccactcttgccacatctatcaacgtaatattggaagtactagcaagatcaataaggcaggctgggtgtggtggctcacgcctgtaatcccagaactttaggaggccgaggcaggcagatcacttgaagtcaggagttcaagaccagcctggccaacgtggtgaaaccccgcctctactgaaaatacaaaaattagctgggaatggtggcgtgcacctgtaatcccagctacttgggaggccaagacaagagaatctctagaacctaggaggcagaggttgcagtgagtcaagattacaccactgcactccagcctaggtgacagtgtgagactccatctcaaaaaaaaaaaaaatcaataaggcaagaacaagaaaaggcactcaaatagggaaggaagaagtaaaattatccctatttgtaagtaacatgatcctacatgtagaaagccctataaagaccccataaaaaaactgttaaaataatagatgaattcagtaaagttgcaagataaaaaaaatcaacatacaaaaaccagttgcatttgtctacagcaaatatgacctatccaaaaaaaaaaaaaatcaagaaaatgatccgatttacaatttcaaaagcaacaaaataggaataaatttaaccaaggaggtgaaaggtctgtacactgaaactataacacattgataaaagaaatcaaagaagacacaaataaatggtaagacatcccatgttcataaattggaataatcaatattgtcaaactatccatactatccaaagcagtctacaggttcaacataatctctattaacattccaaagtcatttttcacagaaatagaaaaatagttctatgattcatatggaaccatgaaagacctcaaataggcaaagcaatcctgaggaagaaaaataaagtggaggcatcacactccctgacttcaaattatcctacaaagctacagtaatcaaaacagtagggtactcacataaaaacagacacacaggccaataaaaaagaacagagagttcagaaagaaatccaagcatatatggtcaactaattttcaacaagggcaccaagaagacacaatgaggaaaggacagtgtcttcaataaatgctattggggaaactggatatccatatgcagaagaatgaaactgcacccttaacttacaccatacacaaaaatcaactcaaaatgaatgaaagacctaaaagtaagacctgaaactgtataacacctagaagaaaatataggaaaaaacttcttgacattggttgtagcaatgatttctcagatgaaacaccaaaaacataagcaacaaaagcaaaataaagaagtgtaactacatcaaactaaaaagcttctgcatagcaaaggaaacaacaacattaaaaggcagcctatggattgggagaaaacatttgtgaaccatatatctgataagaggtaaatattcaaaatatatgagaaacaaaactcaataggccaggcacagtggctcatgcctgtaatcccgacactttgggaggccaaggtgggtagatcacctgaaatcaggagttcgagaccagcctggccaacatactgaaatcttgtctctcctaaaaatacaaaaattagccaggtacagtggtgtgtgcctgtagtcccagctactcaggcggctgaggcaggagaatcacttgaacctgggcggtggaggttgcagtgagttgagatcatgccactgcacttcagcctgggtgacagagtgagaatccgaccaaaaaaataaaataaaataaaataaaataaaataaaataaaataaaataaaataaaataaaattcaacagaaaaaatacaaaaacaaaaacacaaataactagatttttttttttttttttgagacggagtcttgctctgtctcccaggctggagtgcagtggcacaatctcggctcactgcaagctccgcctcccaagttcatgccattctcctgcctcagcctaccgagtagctgggactacaggcgcccaccaccatgcccagctaattttttgtatttttagtagagacagggtttcaccgtgttagccaggatggtctcgatctcctgaccttttgatccacccgcctcggcctcccaaagtgctgggattacaggtgtgagccaccgcacccagcaaataaccagatttttaaatgagcaaaggacctaaataggcatttctccaaataagtcaaaaaatagtcttcaggtttatggaaaggtgctcaacatcactaatcatgatggaaataacaaatcaaaaccacaatgagatatctccccactcctgttggaatggcattagcaaaaaacaagaggtagccaggtgaggtggcacatgcctttagtcccagctactcgggaggctgaggtataaggaccacttgagcccagtaatttgaggccaacctaggcaacacagcaagaccttgtctgtgtaaataaataaataagcaaacaaacaagaggtaacaaatgttggcaaggatatggagagaagagaacccttaaatactgttggtcagaatgcagacttttaaataaaactaccatatgacacagcaatccttcttctagatatatactccaaggaaatgaagtcaccacctcataaagatatctgcactcccacattcactgcagcattattcacaatagccaagatatgggaacaaccaaagtgtctgttgacagataaatggataaaggaacacatacaggttgagaatcccttatccaaaatgcttgggaccagaagcattttggatttctgatttttttttcaggttttggaatatttgcattattcttaacagttgaacatcccaaatacaaaaatccaaaatccaaaatgctccaattagtttttcctttgaacatcatgtcagcactttaaaagtttcagatattggagcatttcgaatttcagatttttgaatttaggatactcaacctgtatacacacacacacagtggaatattattttgcttttaataaggagatcctgctatttgggtcaacgtgggtgaagctataagacattatgctaactgaaataaaccaaacacagaaagaaaaaggctacatgatctcacttacatgtggaatgttttttaaaaatcaaatacaatagaaacaggatagaagaatggttatggcaggaagcggggacagtgggtaaaacagggagatgttggcagggcgcagtggctcacgcctgtaatcccagcactttgggaggccaaggcgggtggatcatgaggttaggagtttgagaccaggctggccaacatggtgaaaccccgtctgtactaaaaatacaaaaaaaaaaaaaattaactgggtgtggtggcaggcacctataatcccagctattcgggaggctgaggcaggagaatcacttgaacccaggaggcgtaggttgcagtgagccgagatcttgccactgcactccagcctgggcaaaagagcggaactccatctcaaaaacaaaacaaaacaaaaaaacaggcagatgtaggtcaagtacaaagttgtaattacataggatgaataaatctagagatctaatgttcagcatgaggactatagttaataacaatacatattattaactatagttttatagatatattccagtattgcataatggaaatttgctaacagagtagattttaggtactcttaccacacagacacaatcaagaaaggtaactacatgacatgttggatatgttcatttgcttgaatattgtaatcacttcacaatgtacagtcaattcctgcatcatgatgtctcgataaatgacggaccacatatatgacactagtaccatatgattataatactgtatttttactggacgttttctatgtttagaaatatttagatacaccattgcattacaattgcctacaatattcagtccagtaatatgctgtacaagttagtagcctaggagcaattggctataccatatagcctaggtatgtaggaagctatactatccaggtctatgtaagtatactctacaatgttcacgcaatgtcaaattgcctaaaacgcatttcttagaacgtatccccatcgttaagcaacacatgattgtgtatcaaaacatcatgttgtataccttatatttatacaataaaaataaataaaaagcacatatataaaaaacaaaataaatataagagaattctaaaattctaaaatacatatttgttctagcccctacacaccttcagcaagtaaaaacttgagaaattctcagtattccagaataatacagaatttatatttgctaacttacaaaataaatcaacttttaatgtgttataattgtttaatttgttatattatagtaagcctaactggtataagtgacttgactcccacttaatctaaagcaagtctaataacttttaaatttcaattaaacattgaaagaccaaaatagaagggcaggccaatttggtaaagtttactcccccaatctaacaaaacgtatcgctttacaagttctaattttcaccagccttctcccagacctttccacactatatactcagctgactttaacctgatgtggaatgtccctaaagttgattgtgcatgactgtatatgtatatcaaaacattatgtggtacgccttaaatttgtgagtgagaccattcctattttctagtaacaatcagctaggtttgaggttaaagatacaaataggaggcaaaattataatagaaaaaaaatttcagatccatcaataaaaagaaaacaatggaaatttcattaagtactagcactttggctaacgttataaacatgcaagatcctaacagcttggaaaaaattgtaacacatccagctgtaaaggatattgagaagaactgagagttccaagcaccattttgactaaaaagcagtaaagtcaagttactattctgaggaattagatccttcctggttctcatctcaaatttatttcatcacaagctttatttcaccagtgctgaaacccacaaggagctacctaaactcactggcaccacaactatctagaagtcctatcttagatgatccaaattcaacacactaagacacactcaatttcctcatgggtgagtctgctcagaccctcctctgcataattttaacaagcttggcaatctaactcccagcctaaagaaaattaacaaacaaaagctgaaatgtgagaaaagtgctacagacacaaatattgtcaaaagtgagaggtgatgtcttagcaacataggaggaactaggggaaaaaaacacaaaacaccaaaagtggacattaaaagttcatctgagaccacttaggaaggaagcaaataaccctatattcccaaatacatctaaaggcacccaccccttcacaggaaagagtaataatagacatggttaatcatgaccctcagctatgaagaaaaggctccaatctgctcagaacggtctatgtgttaagaaagccaggaaaattcaaatagttgtaatttataaagatttcactcagagtggttaatcagttttgaaagtgttgacacttaaagggtgaggctctggtcacttggggaatagtcttataaaaaaaagctcctttttcccaccccatcagttaatgaagcactgcatatggacgctccacattggaagccgttccaaggacagcattccaaagtcagctataacaacaaacagcagatgtccagaaaggcacagatatctcctccctacacccaaaccatttaaggaggaaaaaatagaccataaaatgtgtgaccagataggcataattgtcaattagctgaaaaacaaatctctaagtttccaatgagggcacaagagcacctaaaaaaaaaaaagaaagaaaaacaacaaatcattctaatttttacaaaaaaatgaaccaaataaatttttccttgaacaactgccaggcctacaggcagatcttccaatacaaaatgatcaaacctgaagaattttcccaagagagtagatacttccaaacagcaaatttccattttaaaataagcacatttattgccatttttccagtttccagaatgtgtatggttgttaaatattaaattctagtttttaaattccggtaatggaggaaggatagcccatatttagggtggggccatgtgagggatgaatacccccaaattaataaaatctgtcaacttggcaaagaccagaactgagatctatctggatgaaatgtgactatcatggccaaatctgagctgtagtgtgtttcccaccagcatggcaggctatttgtgtattcatttataattttttcatttcttctacaaagactctgtggaagatctatggctgaaaacaaggcctataaaagaccagccatgggcagggcatggtggcttatgcctgtaatcccagcactttgggaggccaaggtgggcggatcacgaggtcaggagattgagaccatcctgtctaacacagtgaaaccccgtctctactaaaaatacaaaaagaaattagccaggtgtggtggcgggtgcccgtagtcacagctacttgggaggctgaggcagaagaatggcatgaacccagaaggcagagcttgcagcgagccgagatttcgccactgcactccagcctgggaaacagagcaagactccatctcaaaaaacaaaacaaaacaaacaaacaaaaaaaaccagccttgtactttcttcacacattttctttacgttgtgaaaaacttaagtgggaaaatcacactctcattcaaactgttcaaaatacaggtaacaatgccaaggaagatgaagcaacccagtggttcccactttatccattctttgtctctgtcagggcatgcaccctagtcctctagggtgatgaactcctcctggttttcccaggatttccccagccttaatgaaagtctcatatcctgggaaacccctcactctcaagcaactgggacggttggtcatcctacaggagcaatgacatccacgtgggcagcacctggagatatggttatgcacagtcccttgggaaatataactgaattcaagtaagtaggagtctcttgttcatatctgggttcaaatctcatcccttctgcttcccagcagtgtgaacttaaactctctaggcctcagtttctacagctataagatagagataacagaaccttacacaaggaattatatgagaattaagtacaatcacgggcccaaactaaactttctattatataagccatctagtagcattagctattatctccatcatcattattttttaacttttattttaggttcaggggtacatgtgcaaggttattatataaggaaattgcatgttgcaggggtttggtgtacagattatttcatcacccaggtaataagcttagtacccaataggtagttttttgatcctcaccctcctcccaccttccaccctcaagtaggtcccagtgtctattgttcccttctttgtgtccaagtgtactcagtgttataagtgagaacatgcagtatttggttttctgtccctgcattagtttgcttaggatgatggtctccagctccatccatgttgctgcaaagaacacaatgttcttttttatggctgtgtagtattctgtggtggatatgtaccaaattttctatatccagtctaccattgtccatcatcattattatatataatcataaagtttagttttagcacattatttgcagatttcatgaccttaattattattaagaacaaattgttacctccagatctaacaattaacgctcacacttgggaactctgctacattcaccactataaaaatgacatcaccaccaaaataaaaatccatgtgagacccttcttcgcaattcaaagtaaccaacctgggcacaccaaaaccaaataaaaacaaccccaaaagtatatcacttgaacaaaaaaagtagattttcctccatctcattcgctgtcaataattgctttctctctttcctgctctgcctatctagaagagtcccattatcagcatcaccaaggctgttgcctaaataggccaggttgaaaccaccattttcccatccttggtgactattcagatgcaattctatgtgaaactacagactccatctagaaagaaatggagatatggagataaggccaggcacagtggctcatgcctgttatcccagcactttgggaggccaaggcaggcagatcacctgacatcaggagttcaagaccagcctggccaacatagtgaaacgctgtctctcctaaaaatataaaaattagccaggcggggtagtgcatgcctgtaatcccagctattcaggaggctgaggcagaagaatcgcttgaacccaggagctggaggttgcagtgagcagagaccatgccattgcactccagccccagcgacagagattttgtctcaataataaaaaacaaagaaagaaatggaggtaaaaatgggtaactgcaggaacatgtctcaaccaaagacctaacactaggcaaacaaaaatgctcacatgaccaatgctacgttatgggaacagcccttgcatccaataagcaaagtcctgaagaacatacattagatgtagtctcacgtataaaaggggtaactcgtcctcatctctgtaacgcaataaccatgttaaccactttccttcatagcatcagctgatcttcaaccaatcacagctgatgagattcttccatatatcctgattattatctgctggacctgtgtcagcaaacctctgctatttaaatgatttcttccttcccttggaccactgggttgcttcatcttccttggtattgttacctgtatttgggaagtacggcagcatgaacagaggcattagcaaatgtgccaagatgaaaggggcattcaaggacacctcccactttttttttctttcttttttttttttttttggtgacagggtcttgttccattgcccaggccagagtacagtggtgatcatagctcacctggacctcctgggctcaagcaatccacccatcacatcttcccaagtaccaaggaccacaggcacacactaccatacccagctaatttttgtagagacagggttttcccatgttgcccaggctggtctcaaactcctggcctcaagcaatcctctcatctcaacctccccaactgtcagtattacagtagtcagccaccacacccggtcaaggacaccccttttacggaggattctttttttcacattcatgaaaatcaaacaaactgtattttttttcttatggctctcagccatattttttctttgggggtaatgatttgtattattttgcacaccagagtagaagctcccaaaaaaaggcaagatagcagggctgccactagcccatatgactcctttgtgcaaattagaaaatgaagccccttcccaagacacttcacttctatctgccagaacactgttgcaatgtactgattttgttagataagaaactgtgttgtcatcttctgacaagcgtataaaatatatgcaaatccatgatctccatgataaaaatggtgccctctagagttgtgcagtgcccaatctacacaattctgtacactgactctaaatgacatctcttcatgtttgtagcatcacaacatttcagataaatcacagttgtctcttggtatagatgaggaattggttacagcaggggtatccaaactccaggccgccaaccattactggtccatggcctgttaggaattagaccacatggcaggaggtgagcagagggcaagggagcattaccgcctgagctccccctgctatcagctcagcagcagcattagcttctcttaggagcctgaaccttattgtgaactgcgcatacaagggatctaggctgcatgctacttatgagaatctaggtaatgcctgatgatctggggtgaaacagcttcatcttgaaaccatcccctgcccagccctgtttgtggaaaaattgtcctccactaaacaagttcccgatgccaaacaggttgggaactgctgggttacaggaccacctaccacagcataccaaaatccacacacactcaagtcctgaagaacctgaatacacaaattcccctccataaacatgggttcaaatccagggaaacctgtattttcaatctgcatttggttgaaaaaaaaaatccacatatgagtggacctgtgtagttcaagcccatgttgttcaaaggccaactataattgtgatttgcctaaaaactgtcgtaacaagtcagattcaaatattgtttgtgtgggtgtgtgattgttctgtgtgtatgtacctttattatatattatttaaataaatgttgccaaaaaggagaattgtctatgtcaggttagattactggcccacagccatgagaacagctattcttgatataccaggaagagaaattttaaaatacatgccatactaaggcgatgacatggtgagagaaagaagaaaaaagaaaaatctggagttctggagcaatctgtttattcccaaggcaaaaatatttatccttaacttgtataaccaaaaatgtttctaatggtcacaaaaataattgccccatttcaaaatccagttgctatagtgcaggaataaagtttaccatgtgagcctcatcttccttaaacacttctacatttagctgccatcaacttcacctttcccacctttagattctggcctttaaatgagaccagtaagagttcacaaggcccaggataatgagttttccagaaacacgatcccagtttcccaagcaatggaagggccagactaccatgagagtcacagcttaaagaaagtaaataattcaaaaataaaaatttgtaaataagcagatttttttatgacctcctctgctggcagagcactaactcaagcagactgcttttcctcaccctctgatatcatcaccactagcaccagtgagtgtagtacggccaatgaaaacagcagagaggggaagaagccagcccagttgagattctaataagggttgggtatacccttcttgttgcttcagctcaatccactactatcattgtcataacacagaaagtttcttagtcccattttaacagaggtggaacctgagtctcagagcagttaaacaacttgccagaggtcacatagcttttaatggttaggcatgtctgggttcaaagctcttgcccttctgctacaccacactgccctgggtagagctttagatcagtgcatctcagaccttcatgtgtccacaggtctcttgaagatcttgttacaatgcagattctaattccagaggcctgggacacagctcttagctagcaaactcccagaagatgttgatgctggttgctggactgcacttttagtagcaagactttgaatcagtggtttttcaacaggggatgactctatcccacaggagacacctggcaatgtctgcagacatttttgattgacatgacttgggggagtaatgctactaacatctgatagatggacgtcagggatgttgctaaatgtcctacatgaggacaagcccccatccccagcaaagaactatccagcccagaatgtcaacagtgctggcgtggttgagaaacccttagagggcctgagttcatttagacttctttcaaagccgctgtagatttgcaaacttgcactggagttaaaggtagctctagtacttaagaaattctccataaagcctgatagaaatgttgatgccatgtaactgatagctggagcatgatgaagtttaatttcctcacaaatattctgtcattgtgctgaagaaaatcaaatcagctgattacagacaggggttccagaaactgcccagagtttctgtaaggtccttgtatcttatcactggatgtcacaatagaaaatgcaagggattagattatttttagatacaaattttataatttcctgttctggcagctcaaacctttaccttgttagcaaggatcacatgaaaccatcttttattattcagcattagctcctgaaacctactatcaatatcatgctgggatactgccatgctctgcacccagcatccattcaactcccaaactcagctaaaaaaaaaaaaaaaaaacaaactcagtcattcatctggctctttaatgtcacagcaccaaaaaattagttcaagttgaatatttttgactaaagtaaccatggcatattgtggtgttaagaatctttaaatgccatattgtttaattacagcatatgcttaggaagactacatttgaatataatttgagaggtgaattaaggtttggttaaaattatatagcttctttgggaggaggaggatttgagaaagaacaacgcatgtgctagtgcaggggtgtccaatcttttggcttcgctgggccacattggaagaagaattgtcctaggccacacataaaacatattaacactaatgatagctcctgagcctaaaaacacacacatacacacacacaaaatctcatagtgttctaagaaagtttacaaattttggggggccacattcaaaaccatcctgggccacatgtggcttatgggttggacaagcttgtaccagtatatcagggcccgaggccatacatgcccccatctttcctacttatctgtcgatgaactttgcctcatccctagggaccaaacgcaaaggtccctcccatgagagtctctatcatctcagtgtccccttcaagacatagtttagagttaaaggttctccataaaacaactgaatgcaagagtgaatgaatgaatgaatgagttctctcgcccttgatggccctgttttctgggttctccctcctctctaaatatttccttctcagtttttttcactgctcctcttccttcttatttgtcttaaacagagatatgccctaattctatcatcagaccctcctcacttgcagggacagggggaggtgaaggggtatctaaactccatctcttataaatgcttcccaaacccacatctctagcctagtcttctgccttgaaatgcaaacccatattttcaaatgccaaacattccttctcctcccaaaaccctgcctccctcgtgactgtcacaggcattagaaatgaccctgtccccaaagctgaaaactccaggctctccaatacctccaccctcctcattctttaggttcttagatgttcctgtttcaaggcatcttcttatattcctttccctgtctattcccactgtcatcaccttaattctaccttatgaacagtctcctaggctttcaaaactgactcctaaatggtgggttcaggatttccgttcacccatatattttcatacttcctagacacttgaagcctgattaaaaaacaagccaaattaccaaaaaaaaaaaaaaaaattagtataaacatctaattttctttagggaaactggcaaggaaactggttacagagagaataagggttgggattgccccttgggaagcccttgttactcagcaggctgcaccagccccactccgactctcccacacacaaaggaggcagagtagcccgaggattgggagcacaggactgttggccccctgactgtgacttcctgtaaggccttaggcagagtaatccccttcctgtgactccattgcttcatttgtaacaaggggagattaataggctcagctttaccagggttgttgtgaggattaaaggagttactacatatcaagaggttagaatagtgcctgccccaccgtgggtgactgataaatgttagtcatgatgatgacaacaacaactatctacttagtaaagactgcaatatcccagagcagagttcagactggtgggatcaacagtattcaataaaatgacctagcaacatcattaactctgtgttccaatcccctgagagggacatcacattgtttctttcaggaatgcatgacctttgtccaatcatgcgaagatatgggaagggtctgaagtgagggaaattcagctaaataattgatcaatactcttcaagggtgccaagatcatggtagataaggaataactaaagaattgttgcaaactgcaggacactagggagaaataacaactaaatgtaacataggatcctggaatggcaataaaagaacattggtagaaaaactggtgaagtttaaatgaggactttagtttggttaatggtatctactgttttagtccatatttgtgttgctatcaagaaatacctgaggctgaggctggataatttataaagaaaagaggtttatttggctcacagttctgcaggctgtaaagaagcctgacacaggcatctgctcagcttctgatgagggcctcatgctgcttccactcctggtggaagaggaaggggagccagcgtgcagatcacatggtgagggaggaggtgagagaaaggaggaggtgccagtttcttttaaagaaccagctatcatgggaactaatagagtgagaactcacccttatagcaccaagtcattcatgaggaatcagccctcatgacccaaacacttcccactatgccccaactccagcattggggatcacatttcaacatgagtttttgagtattacatatccaaattatagcatgtgccataccaggcagaaatggtaatttcctggttctaatacttgtactcaagttatgtaagagaggaacactgaggaaagctaggggagagacatacagaaaccctctgcctgatttttgcaaattttctgtaagtctgtaagtagttaaaaataaaaatctgatccttcacaaaagaacactaatgcagcttcactccaaaatcattccctaacagttttgggtttttatcatatactaaggcattactagggttcatggaagcatcagtgaactggacatggttcttccttttgatatttcacagtctagtgggaaaggcagtcaagtaaatgaatatttagtaattgttatgagcaatatatgcacaagtagggaccttaatccagtccagggcaggaaggactgaaagtgaggatatccagagaaggtaaaacacctgggctgaatattgtaggacaagtaagggttagtcaagtgaggatggaggaggaaggaagccccagcagtgggggagtcacacaaacacaggcacagagcccagaagctggctgttcagcaaagccagagtttaagctgactgggagaggcaagtgagaaaggaaaagtaggtgataaggtggaaaaatgtaggcaggggccttgtaagccaggctcaagactttgtactttgtccttcgggcaatgcagggttctgaaaggacagacatacatttttctaagatgatcctgagagtagcatgaagaatgaactacaagaggtacgaagctgggagaccagttaagaggaccaagccaaaggtaagagcaatggaaatgaaagaacttaggcagactcaaaagtgtgtagagagagagaataaatagggcttagtgatatattggatacagagggtatggtaagctgagtaacggaccccctcaaagatgtccacctactaattcccaaatcctgtgtatatgttactttacatggcagaaggaccttgcagatgtgaatgagttaaggattttaaaatgagaagattatattgtattaactaggtgggcccaatgtaatcataagggttttgataagagggaggcaagagggtcaaagtcacggggcaggaaatatgaccacagaagcaagggtcataaagaaatttgaaaatgtttcagtgttggctggaaaatggaggggggtgccacaagccaaggagtgcagctggcctttagaagctgggaaaggcaagggaatgaattccccctgagagcttccagaaggaatgcaggcctgacaacatcttgatcttagcccagtgaaactgacttcacacttctgatccccaggactgtacaagaatcatgtatttgtattgtctaaaaccactaagtttgtggtaatttgttaccgcagcaataaaaaactaatacagggagtgatggagaaagagaaattgatgaggttcccagtgtctggcttgggttgggaggtacgtggtggtgacagcaagacaaggacacagggggagaatagttgggaagaagacaagttccattctggacaggctaatcccaatatgtttctgcaacccacaggaagtccactagatggttacatgtatggtgctggtgctcaagagagaggtccaggcttgggatggaattttccacaaagttgccactcaccacttggtatatacttaactaggtctaccgagttttcatgttttaatgaaaaggttagcttcaggagtactactgttactattgctatggttatgatatatgctatgaggagtgactatttctacaggcaagactgagtaagggaaagaacaatacttatattctaatagcatggcagctatgttaccctgaggaagttacaaattctctgtgcctcagtttccttatctttaaaaagagaataaatcctgaatgggattaaatttaaaatgagtgcttggcacttagttgagtgcccaacacaaagttaagtgctcaataaaggggagctaagtaagaacagcttatacacaacccattaagaatattttgataaatcataagaagttcttaagttgtccaaaaagctgtaacaaattgtaattccttccccagtcattttctaaatgtatcgaatacttcatttgctataggacattaaaagtatagaggacaggccgggcacggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcaagactccgtctcaaaaaaaaaaaaaaaaaaaaaaaagtatagaggacattatctctgcttacaatttgtgcacaattatgacaggatatatatcaataatgataaagaacagtgtgcaagctgctggtgatactaaagatgagtacaatgtgattcctgccctcagggaatgcacagtcttgagagaagacagattagatatagatacagatatagatatagacatatgtttctacatgtagactaacatttattgtgcacctactaagtgccgagctttacgagtatttaacatgtattacatttaagtttacttattgaagccctgtgaatcagatatttcccatacagtagaattgtctccataacattctgaagcaattacagaatgaaagtgggatgatgaagataaggtttgtcacatctcagaacaaacatcagtaccccaataagtgacatgtaaaatgccaccaggcaaggtttgatcctgaggagagaagtcaatggtttgcaaagggtgcatgaacttgctttacaaggagaccaactgatccgagggcaactcttgcttatcccctcctcatttttcttcaaggaaacataaatgatatttgctgagccaagcctgtgcaaagtgctttgcataggtcatgtcacttgagaccaaagagtaaacccaagcaggtgaatgcaaagattttgtagcaggcagagaaaactgctgattaaaattctattagaccgcaagtctcctgtaaatttcactagcattcccaggtctcttgcaaaagtgcagaacagctactagaaatatgacaacaaaggcaattaacctcataaaacaatgcagatgaaaaaacaatgggaggaaaatgattaaggttaaaataagagagggaaaccaacatattaagagaaagaataagattttaaatgaggtcataatagaaaccagatgagaagcccaaatagaaaaggaaagtttcaaagaaaacaaaccagaaagaaggaaaggaattgggtgggaagaaatgactagaagttattttgactttctacaaaacaatagatggtatgctggttctcatttctgaggtcaagtcccccatgaggtctcaggcaagttacttaactgccctgattaggtaataggacaatgtcagcacctacatctcatagagttgttctgaggaggaactgagtacagcactgagctccatgcttgcagctagaagatcttccatctaacagtggtgctgctgctgctgctgctgctgatttatgctatcaacagcatcccaccaggacctcccaagatgagattccatgacctctattccatgataagcccaacaaccctcaaatgttccagtgccacacagattcctcaggaggcatctgtgatttcaggaaatgtggtcattttagatcattctctctaagtcctctatgcaatacacatttgtatctgcagggcaacaaagcaaagagccaccatgcaaagataaccacagcctagaaaaagaagaaaagataatgagttattcacaaaggtttcctgtcttctggaaaagcctgtgtcattgtgtctcagaagtccccacggtcagcacaaatatcctcaaatgtccactaaatttcatgattgctctacctgtaagggttgcttaaggggcatcccaacaatacccactgaggtttgtgcctggcaggtttttaaggcatctcaagctttcaatgtgcaattggcaaagatttagccatcgtgcaccattctgtcctttaaagcagctaaagcttgaatctttgaaatcatctaaaccttgacatgcatcatgaaagtattgcaacagagaccactgacaggaacaccactgtgtatcatgaaggtacagtggaacacctacattaagagtcatttctcggccgggcatgatggctcatacctgtaatcccagtacttggggaggccaaggcaggaggatcacttaagcccaggagttcaagatcagcctgggcaacatagtaagaccccatctaaaaaataaaaaaataaaaagtcatttctactgtctaaggcacaatcagagtttgcctcttctttgctgtgtggactctgccagaatgacaaaggccccctccaccctttacaaataaatcaccttgcaatgtattctatttgaatatggatgagaaaaggagcattttaaagaagatcatttgtctaaaccaggattactttctagcacactaaaaagtgcacataggtagtgagggagctcttaattccagattcaagtgattaaatcataaaagaagttgttgctttttttaaggaactctttggagaaatatttttaaggctggacaagcggtacaaaaagaaagcggcacagataaacctaaaagaaattaagcttagagtggcagctaatctccttaaataggtttctgagtgcaagatgtgttaagtgttgataagcatttccttggtaaatggccactggccccagtgtgtggcactccaagaacagaacccctgccacaaatctgcaagattctctgcaaaaaaagaactctgcttcattaataactttttaaaacatgcactaactaattcacactggcagttgaaatcttcccatcaaaattcattctacaatcaggctaagttcaaagatatatgcagggtaaagaaaaaactcaagtttagagaagatttggggtgagtggtgtaggtgaacaaaatcatatagtctgaacttaaagttttagagtcaggaaaataggataaaactagatagaggacttggtcaagtgggtcaaaaaataaaggtttcaattgcataaaaagccaaatgtgagttcagatttttaacgtgttatgcataaatacttgctgctattttaatatttgccttgacttgagctgtagtgggactctgcctgaggcaagatttttaatagcaataataaaaatacttaatagtacttagagcaaagcatgtgtggtcacaatgttttaaagggggaaagaaaaggtaattttgaacatctgcactgcatttccacatgataaaaccactacactccaaaattattccgaagtttggtggtgctagaagcaggggaggaggaagaggcagttcatgtagagaaatgtttgtttaaaaaacagaaagggagacacaaaggccatttagggaaaagcagggatgacaacctttactgtaaaataaaactgccaattaatagtgagagtccagtaatcaaaatgtaaggcttatgtgtcttctcagatccataattattacctccataaatactcctgagaatcaaatgtcttttattttcacaaagtcccaatcttcccatgtggtatatcagataaaacaccacccccaacccctcctttagatttcttttgcaggacttgcctcatttccagccctacagtttctgagagagaagagtgcagttggggtgggggagttggaggcagcttctctctcaatctctccctccatctgcctgtctctgtctctatcaatctcaatcactctgtctctctctctctctctctctctcacacacacacacacacacatacacacacacacacacacacacacacacacacacactcttatgtttctttttaggctcaagctcccccccatccctacctccccccagcacatctgctttctagttaaatcccctggagtcagactccgggtgaagaagtctcctgatctgggctgtccttcctcaataaaaccaagtttcaagcagatggggctaggagttactgtccttgccacagccccaggccagccagcagaacggatgggtcactctataccagcagttcaccaccataattattttgcaatgtctggagactgttttgttgctgtcagcacaatctggggaagagtgtaagtgctaattgcatctagtaagcaaaggtccactattcgacatcctgcaatgcacaggacagccccacacaacaatcaccttgcccaatcgtcaaccttgctgagactgaaaatccctgggctacaccaagccagcaacatcctagtaacaggcagtcttcccccaatactaaaaatgctcaaatgtctggcagcccagctcaaacagatgcgagagatctgattgccctgggggcaggaagaagggcagagagtgataagggaactggctgtcctcctgaccaaattctggcttagctgagtaagaccagtgtccatgggcaaacctggcaaggccatggcacactaacaactaccacatgtcaatattttttaacacaacctgcagatatacacagtttctttttcaggtcagttccttcaaagcagccacattttttaaagcactaattgtgtagggctaaaaagtgtcaataaacacaggtatttaaaaagagaaggaggaggaggaataggaggaagcctgtgtttttatcaggtaaggaagtcctaattcttttggagtttgaatggcaatctccacttctctggtgattcttaaagaagtctttgttcacagtccctttggaatctgccggggttccttcccaaaacacaccactcctaaaagaggtgcagactttcgtgataactgacaatacccaatgtgttaggaatcagagatcaaaactacagatctaataactgtgaaagaaaaataggtggccgggcgcggtggcttgcacctgtaatcccagcattttgggaggccgaggcgggtggatcacttaaggtcgggagtttgagaccagcctgaccaacatggagaaacctcgtctctaccaaaaatacaaaattagccggaatgtggtgtcgcatgcctgtaatcccagctacttgggaagctgaggcaggagaatcgcttgaacccaggaggcggaggttgcagtgagccaagattgtgccattgcactccaacctgggcaacaaaagtgaaactccatctcaaaaaaaaaaaaaaaaaaaaaaaaaggcagaaaaaaataccgtttcctgatttaaaaaccaacctcaaaagctatatgtgaaaacagtaagatttgatcctctaaatataactaattgcagacaggcttttaccaaatgtcttgattcaaaaaactacttacttatccttaattcagaaagctacttacttattatctaattcaggggtcagcacatttaaagaggcagatagtaaatactttaggctttgtggaccaagaggcaaaataaagggtactatatacgtacttacgtaatcctttcaaatgtaatcatttaaaaaggtaaaaaacattcttagctcccaggccatttaaaaaaaaaaaaatgctgcaggccacatttggcccataatctatagtttgccaaatctcaatctaaaaacgtagcaagtctttgtaatttttactcatgaagtctcactcacctttctttttcctttttctacaaacaacttatacagaattatatttttcctttagtgagaatttaattcattcttatatgttatagctgctgtaacgatagccactcctaggaatcacccattagcagttcacattgcctttttagcgctctatccgaaacacttaagagacccctcaacctacatgcctaactggaaacccaaataaagtagccctttcacatctgagccaaggtggaagggaaagtagattttaccaaattagaagagcaatgaaatgcacatgtcttaggagttacaaatgcaatttccgtgtctcacaattgacacagaaagaaacacaaaatactcaacaaaaactaggtaaaaagtaaagttggttttgggagacaaagcatttctttttggcagtgagatattcaagaagttaaaaaaattgtaaaataaaactaactttgatgaaatgggagaggtctaagtgccacacatttgtccttattctctgctcacaaaaattcacctatttgtgcagaatttatggagggccaggtgctttcattttcatgagtcaaaaatggaatgggaagacctagccctgacgttgccttctacatggcactgtttaatcttcccgctgctctatgacctcacggatttatagtccccaattcaacaggctctgataagatgtggcaagaaaataaatcagagccttttgcatttcttcctttttcacatttatgagaaaataaccttcagcaagaagctagaagaccagaatcctagtctgtggtctactctggattacactgaaatccctggcagcatcaagaagtggttaggaacaaggtacttcaatcggcaagtccaaatttgaatgccagatccatccatcactatgtgctctgagaacctgggccagtcacatcacctctcaaggcctcaacttccccacctgagaggcagagaaaccattgttccgttcagagtatcgatggaagaattaaatggcactccttgggaagtgactggcacaggctgcccttagtgagtgcccagtaaatgttacatgtcatcactgcttaatttctctgagtctccatgtcctcccagggttgccaaaagtatctgaggaaatagttaaaacggaatgtgttttataatggaatgtgtttataggctttatataccaagccgcctccacatgtaaagtattaatgtttccactcaagacaggtagggccttggtatagctgagcctgtctcaactacccattgctgcagcttatgaaacatgctaacatactcacagagcctgtgcttggggtactttctcactgctgaggttttatttgtggggcatcatcacaaatgatgatgatgataaattatgtcagttacccaaaaaatatttttcagagcgccatcacacctaaggtaaagcaggaggatgagggtgaagaggaagtaatcagagcctctctcagcataacctccggacattctcactcctccctggtgcctccccacacccccaaccctgtcactttcttttctcagcaggtttcaaaatgccttgtgtctaatggctttctggggctccaccagtctctgttaccgtaaaaagcagttgatgatactcattgaaatgaaaatggagtaattagcatgtagcattcaaacttaaaagaatgcatgagaatttaaagataaggcaaatgatgctaaacagaaaggaatttattttccgtgtcatcagaaatgtgaggataaaaattatgaaagcctacttttggatgcactgtcagattacagagagagcgcttttctggaaagatgcttcattgacatccatcctgcatggagtactcggagaaaatggaactcagtgaaaacaaagggaatttgtctcaaactagcatcagtcaatgaaaattccacataatctcaaaagagataccatattcaaaatcagatgcttactcgggaaagaggcacaaaggagaaacattcaattctagtggttaaatactagtaggagtaaatgaaaaggcatgccttagaatgctcacggccttggggcgtggtggttacaaattatcagatgtgtgtgaaaaaaataaataaaactgagcaatagtcagaaatgccttgtgtacttgggcagaacgtcacaatcatttcttcacccacattctcaaccttggctgcacggctccaccaagatttcatcaaactcaacacattcgaagtcttccctcaaccttagctcctcctgctgacaacccttgcctgcccactgctgtaccatatctgcctgcacacaggtctacagcagttgtctcttcctcctcaaatctcccagcactcagttcttaagttgtcaaggtcctgcctacaggtggagatgacctttcccttcaacttccatggccaccacccagattcacactcttggcaacctgaatagccacagtatccatctaacttctctccctgcttttgttctcttcccatccaatccactgtcaactgatcatcttctctggtcatgccattctccaggtcaaatgccttcaaaggctccccagagcccacagagtaaagccacttccctgtgtgtgggcctcagagccctcagtgatctgagaccaaaccatctgctcagctttatttccttcccccactgaaaggcagagtttcagctgctccaaactcaccgtgcctcaaactctccacagttcctacctctgtgatttgactcagtcatctgctctccaatcatgctttcccaccaaccccatgtgctaaaattcctcctgccttgaagactggttctaccgtggatgaagccagttgtcagctctcctacctttaagctgtacagcatttggatgccattcaaggcctctcagtgtaccaccccaagaagcagtagcatgcaatggggacaggtacagagtctagagtcacactgcccagcttccactcttgattgcagcttttgcagtgtgtgactggaggcaattacttacctcactctgcctctgtttccctatctgtgtaatacacatgatgacaacagtatttacttagcacaggacaatacttgataattatgagctgttcctcttattgctcacctgaatctctgaacaagaccacaaaattgccactgatactcccacagcatcctccatagggatgctcaacatatgcccaatgatgtccaacacattttagaaaaaaatgaaagaagactgccagttaaagctacctgcaaagtttcttctctactccaaacatagagcaatgatgcagaaaacattttttaatggagctcataccaaccattatgaattcttctgatactgacaaaataaatcacagagtaattctctagatatttttaacaaatttttcactcattacaatatttattgagcagctactggcaatatctgaggtctgggaatactgatggaatgtactgatcaggtaagaaatttactgtattaaaatagggagcaattgttaagttctgtaatatgtataggaaacagcccttgtaaaagatcgtgtatataaaatgttatgtttatatgtttgggaatagtttctgtaattagctttgttggtagaaatagaatgtattgaatctgtagagacagaattagaaatgcctgcatcagcaaaatcatggcttaggtcagcagaactagggacaagcatgtattaaggaaatcatgtggttttgagaagggggaccggaatggcatttagaagtttgggcagagattatacaggacaagtttgagccatcagtaaaggtctgaaagcttaagaaattccaggtaataccttttgccttggtggatctcccactgtcctgggttcaacctggataaggagaccaggagaccaataattcatgttacctctttctcctgtctgcccacccccagcacagagggaggcccaggtctcctgggggttttgcttgtcctgggttattagcaactgtggcctgtaaagacttgggtgctcttctggccctgctaccaaagaagggcaagatgcccaaaaggattaacacaggacatcaataggattagcagcagaacatatactgcttcccatcaagatcttacagcgagataagtccaaagacccctatctctcttctaaggaccagtcaagaaaatagtaagcagggtaagtataagaggatcttggtctattaatccatttctttttctttaatgagatcagttgtgtttcaaatacttgatcgctaaaacttctagatggaacaatatgttctttgcagaaaaagctagagaacaaggtaaacgtcaaacaatgtcttatcaaatcaacctgcatccaaatacatcagacaatgctagtgagtaatgctgagtttcggccaaccctttggctcacattagcacatcagttggagttcctgcgcaatggttttggtcttccaagtaagttgagatcataacctttttgttgttgtttcctgccagacaaagaagtggtttcacactcagccttttccagaccaccaaaagacaataagacactaaagcaacccaccccatatgcaactcctgccaactccaaatctcctaaaacaataagctgaacaaggccaggagatggggtttatgtgaggtccaccacctctgcctaagaatgaatcataaaaccactagcactccattccccagcttcacactgcctagccccaacctactcgaactgtgcataatgaaaatgaaatcaggaacacactgaacctaaaacctcaagtacattttaaatcttgttttagattcatctatattaacagaggtcaggcaatttctttattcaagctaagttattcttactggtataatgacaaaagtggtcagacacattctttctactaaaaaaaaaaaaaaaataccctgacaaagtacattctaaaactcagtagagaatatggaaatagcttgcaataaactttgccttataaaataactaatgaaggaaataacccagttatttggcaatgggaaacaaccatttgtatattattacgtatttggtaggtcattaattagaagcactttttattttctagcatagcatttttcaaaaatgtcttacaaagaacaccagtgcaacaagagaaaagcaagtcacgtaagtttgagaagctctgccttctctggtccccttcttggaaatgactaatgcatatttgcatattaaagactgagactgtaactctgtggaatccctcatttccccaagttcacttggcactgcaaccctttttctctcataacacatatcaacagcccacaaaatggctgttctgccaagcacaatttggggaaaatttcttctagaaatgggatgtaggccaggcacggtggctcacacctgtaatcccagcactttggaaggctgaggcaggcagatcgcttgagctcaggagcctagcctgggcaacatggtgaaaccccgtctgtaccaaaaatacaaaaaaaaaaaaaaaaaatagccaggcatcgtggcacatgcctgtagtcccaactattcaggaggctgaggtgggaggatcacttgaacctgggaggtagaggttgcagtaagccgagactgtgccactgtactccaacctgggtgacagagtgagaccccgtcccccaccgccccccgcaaaaaaaagaaaagaaaagggacatagtaaaatggtttaagagctgagactccagagtcaggctgattcaaacactagcttcaccatttgttagcagtgtgacattgggtttgtccctctgttcccccaggtaagatgggcaaagtaacagcacctacctcctaggccatgggtctttccatctgagtggaacagtcttctgagatcctcacatggctggtccttttggttatgcaggtctcagttcatactgtcaccccctccaagaggccttccctgacaacccaacataaaattagccccacccacatcaccagtgcttcactctcttcttcatgacacgcctctatttaaaccataaaattgtcatctattttcccccaatagaatgtaagcaccatgaaggtacattttgttaattatcattgctatatcccaaaacagatcttcaataagtattcatccaacgaaggaatgaatggatggattaatgaatgaatgaatggatggatgaatgaataaatgaatgaatgaatgagatgattcagtgtgaatcaacgtaaagcattcttcatgatgcctgacacataagctgacacatacagatgctattttgaaaacttttggggaaccgtgagtggttaatacacacataatcataattctcccaataagtaacattatgactccacagtgtatcctcttgctgtattagaggtaaacatttcacaacattcattcagaggtgtgccagtaaaccagctttcaggaatgggcaagggaatggggaaggtagtccctaagagtagcatcttccaatttccatggtgtaaatacaccaaatatgaccaattccaggctacgtgtggtttaacaccaggatcatgagattcctgagaatttaacaaatggctctcacagggcagtacaacccttctcatgggaatgatcctttcaggccttcaagtcttgtttgctgagttcaagtttaacatgagtcttttatatacagatgtattttccaaattctccccctcttgatgagctaaaataagggctacctactcactttggtctgatgctcagggaaactagttgaatgtattggtctgcactttctgttctcccttctgtgtgctttcaaactggtgtttagggatctaaacatgatctatatccacaccagaccattgtgagaaccagccaatctcagaaaacccaagatgaattgtgtttagattcatttaaatggaggcagccacataaggcaccatctagtaagtgctatcaatgagcagaatctaattgcagaagaagaatgactccaccctgaccacaagatcccaacaaggagtgagaaatggtgctgcagatggagatttctctggcatcacagccttgctgccccttggcatcaaaataaaacagcagctttttccaactatagtgatcctctatcaactgcagttttgagataacacaagaaaaattccaaaatccacagttagtctacatgcaagtaacaacatgccagtaattgttgctcctcttctgtaaactacatgagaggtctatgaagtaagacatggagaaaattactttctgctctactgtatttgttatctattgctgtgtaacaaattaccttaaaattgagcagcttaaaagagtacacatttattatctcacagtttctgtgtgtcaggaatcaaggcacaacttaagtggttcctctgtttcacagtctctcacagcctgcaatcaagatgtcatcccaggacctgtcttcttatctgaagctcgactgggaaaggatccacttccaagctcactaaatggctgttaccaggtttcctttctttgtggctgttgaaatgagtgcctctgttccttactgagtgttggctggaggccaccctcagttccttaccacatgggcctctccacatggcagcttgcttcatcaaagcatgcaagctatgaaggcaatagagtctgctagtaagatggaagtaacagtcttatgtaacctaatcctggaaataacattgacattctgttaattttgccatattctatcatttaggagcaagttatgaggatcaaccaatactcgaagaggattatataatggtgtgaattccaaggagtagggattattggaggccatcttggaagtcttctcaccacattcaccctcttggaagatggatgggaagaccaggcccaaccaaaacatctctttaagcttttcaatatgaaaccaagccatgtggtttcccaagcatgttggtaaagtatcattaaaacgaaacaaggaagaataggagtagaggacattaaatttgcagacacaaaagtcttttcctatgtgctaggcaaatataacccacatcagagcaaattcctgggagcatctgcacttttgcaaatcccaacatggaagccatgtcttccgaccaaccaaacaagtgactcacaagaagcaccaccatctgaacaggtatactgccaagaaatctagtttggtctagaaggaaatatcttctagaatttttatttattgctatagaatagtttgaaaacatatttaatgccattttattgcttgttattttctgtgagatccacgtctccctacagcagttttgcctgcatgatacttttaaggtccatatccaccacagtggcaaggaactgctattaaaatttcaaaccttggcagtcatccacattttttctaagctctacccaaccacatattctcagatacacgagcatcccaacattgaatggtggtaaaaggccagagagactgcctctgaaggacttcaaatgatttaatctactaagggcaaaacacatactcagaaaacctgtaatactctgtcctagacaaatgtaaatgcagacaaaaattatcttaaccctaaacactcaaaattggtctgtgcattttaccattctttcccataggctttactttctgcaaatctcatccccaattcagtaataaaaatatttagggtcattgtgttgctaatcctatttattttttcctttagagagatgatatttgataaacaactaaactgaatagtaccatacctaaaagactctgaaaccacagccacctgtgggaaagcaattgtttataaaccaacttacagttgatatgtcctgtatatgcttggatcgcggatatgtgctgaataataatggaatgcatgtgcagtgagcaaagactaatacaaaattccagtttaatggtcttaagccggcaggaaggtcataaagcagatgacaaagggaattttgttaaggatgtagatatcttccaacctgtgaaaataacttgataacatattttcacttataaattaaggctttggggaaatacagtgaatgctcttacctctctaagatgtatgttttccttctctttctgatctaaaatcacttccaagtggctgacctgagactcagcctctgccatccgccgcgttcgctcattgtcatcctccaggcttttggatggcaagcctttactttgcaacatctcaagaagttttttaattgactcatctcgggcattgagggtttgtttctgcgtttcaattctcagctccatttcctctaatgtcttcctcaaaaggaacagctccttagcctgcctgtcatgctcggcttggagccgcctaaagttctcctcggtcagctcgatggtgaagtgctccgctcctcggttgccactctcttgctggaggaggtggttgaggtctctctgggttcgcagctcatcttgaagggcctggattgtcaactgtaggtgctgcaatgagaaagatggagcgggagaggagaaagaaggaaaaaaagtcaatgaaaatgtcaagtgccgcttgctgccaccacactatgaagatggaatgttaatcatgaggtccggagggccagccatgaattcctccacggtgacttcagaagcatgggacagcacatggagagggggagattaattcagtgatgctttctgaatgtcttgagagaagagaaatgcacacacacacagaaacaatagattagtgtcaatcacaagggaaattatacatctacagagttttaatttaggaaatggaaaaggttagaaggaaactttcacaaacacaccttctttatgcccagaatgctccagactcagtattccttgtttcctaaggtattctttattgtactatccattatttcccacgatcaatatgtggtgatttaaaaatgaaaataatagcatccactacaagtagacacaaacaaagactttattttttacaaataaagctgtgaacaggtttagtaaacaggattactgcatctgcaagcaaaagggaataaatgcaggcacagacaaacacactcaaacacacaaggaggtgaggctgcacagagcagaacaaacaagctgcaaagagtggacaaaccttggttcttctggcatccagtaactgaacagcatggtaaatgaaaaaaaaatgaagcaaaaaatcaacacaaagaaaagtccagtgcaagcaaaggatatttaacagaaagaacttaacacaaagtaccttcacagaagaagaaaaaaaaaaagaaaaaaaaattctaattacagcaaagacccataagctacatggagtttatagcattgacgtttgatagacatggaaaaaaaaaagaaagaccaaacctgaggtttatcccaccttttgttttcctaaatctcactgacccagaaacagaaagtcttgaaagtattactagagagggaagcaactgttattttgggtcaccattttaagcaaagtcagagtgaaagcaccagagaaacaaaatagttatcagatgtgagaaaaggcacccgtgcttgaagatagttgatgaatttggcaacacctttccccataggacaaacccccaggctggtcagagaaggcagccacaagcctgaaggcatttctatccctatggacaagccaagatgcttccaagacagcagctgttcattcgccaaacacatgatcctgcttgtggaatgaacacagtgctaagcacaggaatcaagagggacataagacatagctcctgcccacagggaactcacagtattgtaaggcatggggtaatactataagttatatgaatattggagcagtcaacattttgaaatctttctgaattcctatagctgacactcagaggtattgagatctttctgagtgtggcctacacccagaaactagcactgggtgatgcaccatcttgattatattgtttctgggtatccaattcatattcccatttatgaatgtccattgagaaattattagagcattctcatctgtataccacagtgcctctcagggtattgaatgcagagaaagaaactgatatgtatttaatgatggaggttattcatttttaatacaatgctcccctataaagtgtaacatacaaagttgtacaaccatcaacacaataaattttttaacattacctcagagacacctcatgccctttagcagtcattccccatctccctccctttccccaggccctggtaaccactgatttactttctgtctttatgcctgttatggacctttcatatcaatggtatcatgcaataagtggtttctttcacttagcatgtttccaaggtttatccatgtggtagtgtgcatctgtacttcgttcctttttatggctgaataatattccattgaacgaatataccacattttatgtatccattcatcagttgactcagacacaaatattcatagcagcaacattcatattagtcaaaaagtgttaacaacccatttgtcaatcaactggtgaatggatgaaatctagtatatcaatttaatggaatattattcagccataaaaaggaatgaagtgctgacatacaggataagatggataaatctgaaaacattatgccatgtgaaagaaaccagtcacaaaagaccacatattgtatgattccactaatagaatgtccagaataaacatatccatagatggagaataaattagtgattgctggggggtgtggagtaaatggggggactctaaagggtatggggcatcttctagggtgatgaaaatgttctcaagttagataggggtgtcctttgcaccactttgtgaatatactaaaaccaacgaatttcacactgtaaatgagtgaattgtatggtacataaattatatatcaacaaagttgtcacaaaaatcatgaggtgggaccataaagtaatctaaccttcctctaccaacccgctgtccttaaaccacattagaacagagtccacaggagtatccgcagccttcagcccagagatgcggctgcagccaagactcttgaaagagtgctttggcaactgtctttgaggcattttatatatctatatatatatacatatatagctagataggtagatagtttttttttgttttttttttttgtttttttttttgtttgtttgttttttgagacagagtctcgtcctgtcgcccaggctggagtgcagtggcgcgatcttggctcactgcaagctccgcctcccgggttcacgcctttctgctgcctcagcatcccaagtagctgggactacaggtgcccgccatcacgcccagctaatttttttgtatttttaatagagacagggtttcacagtgttagtcaggatggtctcgatctcctgacctcgtgatccacctgccttggcctcccaaagtgctgggattacaggcgtgagccaccacgcccagctaatagatttttttttttttttgagacagagtctcactcagtccccaggctgaagtgcagtggcatgatcttggctcactgtaacctccaccttctgggttcaagtgatcctcccacctcagcctcccaagtagctgggactataggtgtgcgccaccacactcagctaatttttgtattttttgtagagatgaggtatcaccatgttgcccaggctggtctcaaactcctgagctcaagtgatccacctgcctcagcctcccaaagggctgggactacacttgtgagccactgtgtccggccgtcatttaaatattcttgaccatggcaaatctttgtcctttgaaggtggcttggatttctgagatgatccaggtttatctggagtcaaacatcatgaattgggatgatcacaaaggaaatgatcttttctgagcataaccaaaaataagattggtcttcttaagattcgtaaaccagccagaaggaaattccaaagaaaaactgccaaatgctttgaacagaaacagcaacattggaaagaccactctgtgagggagctgcccctttgaatggacacattccttattgccctgatcctttgtccccacatctacgcagtggggataatcataatgcctactatagggttcctgtgggcaataatgaagataaggtggcaagtgccaggtttgacagcaacgggagggaggaaggatggcagaagtgaaggaagataagaaagaagaaaagcaggaaagaagaaagggagcagaggagaatggagggaaaattggtccatttatccattcaatatacagttactgagtatctccctcatactcatgaaatacaaaaaaaaaaaaaaagaaaaacaaaagaaaaaaaatagcccatattcaaagtctatgtggacaagtaaaccaatagaagcaacactatgtcatgagggttacaatagaagtcataaccaggtggctagaaatgcagagaggagggaacccaggctaggggcatgtaggaaaacatcccaaaccaagaggccaccaataaactatgtcttatttgaagggcaaatgagagtcatccctgtgaagaatgatggaaagagaagagaaactgtaaaagcaaagaggtaaggacagaccagatctattaagaaacagtgaaagcaaaaatctgtatatcatttgtaataccacatgccatgcatggtcctaaggtgtcttaatcctcagaaccaccctaaaaggtagcaactgttatgatctccacttaatgcataagaaaatggggacaaaaagtacttaagtaacctgctcccagtcacccacctacgtaagtggtacagccacaggtgttcatccaaacactttgaccccaatgcccctgttcaaaccacgacatcattggcctctgaattgggacaaatgcttcaagatggcaggagaaaaggatggggaggggagaagtagtaaaagcagacaggtaggcatttataacagaaatagaaattctcaaaaataagaattagccatcttggctgggtgtggtggctcacacctgtaatcccagcacttcgggagatcaagatgggagatcacttgaggccaggagctcaagactagcctgggcaacatagagagaccccatatctatttaaaaagaaagaattagccatcctaaccaggctgttccttattcagaagtggttacgatggatgcttccaggctgtacatttattaagaagcaaaatctatttttcaggtagtcacactattagtcactaaatgacttcagcatgatgaagcaatctcataatcaccataaaatttagtgttcaaaattttctcaaattcatgtttatattttcattttcttttaatttttcattttcttttagttttcattttcttttaattttaagatattcaaaatcaaataggaatcttgttcctacaaaaaagatttttgaggaaaatacataccttgtagatccttgatcatccttttgctttacataattgaagacggggaggggatgtgaagtaatcttatccatcctccctctcccctcttctctccccctcctactctcttctttctcattgttctactttttagcaattcaactcaatcaagtttcaaaactcatttaccaagctgggcacagtggcatatgcctatagtcccagctacttgggaggctgagaggatcacttgagcccaagagttcaagactagcctgggcaacatagggagaccctgtatctaaaaaaaataaaaataaaaaaaaaaattaccagattttcagttatgtatttaacatagacaatttcaattataaaatataataagagaaataatccatagaaattgataaactttctgtgcctcggtctccccatttgtaaaaggaggagagtagtaattccttctaccttggaatcattaaatttaatgaggataaatcatttaatggggattaaatgagttaatacatataaagctctagaaagtaccacatgcagagtaagacatcaatcaggataggcttaggatatgctgcagtgacaatagcaacaaaaaactatattcagaaagacataaaccatctgctgccagggaataggaacattcagaactcaaagaaaccttaaagactgccttattaacctcattttataaacaagaaaattgtatccacacagatgaaatgacaggctcaagagcagatacacactgacaaagccagaatctgggtttctgggatcctggactcagtcctggtatgtatttcaataaccctaagagtagaccaaaagggggtaactgtacactttgactaggaactttgacaactgtacactttgacaatgtaggaaatggccatggtgtctctgacaaggaggatgagagatacctaagtcacttcacttccatgtcaccgggtcctatccagtagttaaatcacatggaatgatccaaggacaatttatttaagacttcttttctaagtactcagaattagactgtgtaaatattggaagacatattcaataaaaactagctctaaaggaccaggatacaatacaagtgaacgctctagcaaagccacagcaccttctctctgagtgaaaggtacgaaaaactgcagttttcaatttcctcctccagagggggttccttcaagccaaatcatctaccctttcccaactatgaaaacacacttcttttaagacagtcacccaaactccactggcattcatttcatcttgttacctacagcaagtacctacaaaccagaatttgcatgactgtattctagggccatctctttggaatctcccaggcatcactgtggtctcaacttctgaaagcttcagtcattctttctgtggcttccattccactgcacatcaggacagagaccttccaatacccacttgcactaggaaaggacattaccaggtgatccaatctcatgcctgggtcccagtcaaactgctgtcaacttagcacttacagcacagcttagcgcttatggcaaaacagctaattctcctcaagtgcaaagtgagtctgtggttgaatgagggctcagaaaggtttttactcgccaccctgtttctgggatcattctccagttgtctgcaaagattcaaaattcaaaaggcaaactccattctccactgtctgccactggaaagataccctggaggaaagtaaagcaactgtgacaatgggaatccaggatgctgtctgcagtcactttgctaggagcacaaatagaattttttacatttatcctgatacttggcttttaacccaatcctgtttagcctttttccaaacttagttgcatactttaaagtctcccctggatagtaaagactagccccatctccagtccacaaaagggaaaaagcttaaaatgactcatctgtgcattaaaaatacgcaaatggaaggggagataaatagcttggtgtgtccaatttattcccagtttcaaacatgcagctctggtataccatcccaggacaatgaaggaggtcataatgacttccatttctaggcttccgggagactgcattttctgataggccctcctctacactacagctagataagagcaaatatgcttttcaaagcatagttgagcttacaaggaagtaagggaaatctccaagggaggggttgtgggagagagcactctctggtctctcttcctcttcttataaggagcaaatgccaatctaagcactgagcttgagagagcgaactgggactcactgaagcgagggaactgagattcttctagcaagcccatatttgcagaagggttgaatgtggtcctaagtgccccctggcgcctaacagatgcaaatgcaaatccttgtaagggggacaggcagtgggtgggcaaggactgggagaggcgattaggcagagaacaaaagccctcaggagtccaaaaaattcagattaatgaaatacaagcttacaataaaaaattaccacagacacaaggaaacttccacgagtgatggccatatgcaaaatataaggtgtttttgaaatgtttaagaaaataaataaatatttcagcagaaatatagaattgaagaatcagcatggaaaagtgactctccaaaattatcaaccagatctgaaaaagaataaaaatatacagcaatgaaaaataaagtatttaaagtgaaacctaacagatggggtaagaaaaaagagaaaactagtgaacaaagacacaatggagataagccacaaacaaaatgatgcttctttgaaatgactaataaaacaagcctcttcagaaatgagtacacataggaaatatttaaaaggtgatatgaaaatactgttaactttgggccaacaaattttgaaatgtcaagaaaatggacaaacgactagtcatatcttacataatctgactctagaagaaacagaaatcctgaagagttctgcagctattaaataaatagaatcagaattttaaaactcttcctgcaaagaaagcccaggtgattccaatttgcaaaaactttcagataaatggaaagtcttcattctgtgagacttgatcatcttgacaccaaagctagtaggcatgaactatacaagaaaggtaccttctagtccaaacttcacacttagacgatgagtattattagcaagtggaatacagggatatattaaaaaggtaatacatcatgcccaagatgtgtttctcataggaattagaggatacttcagcattagacaaagtattctataaataatgttaacagagtaaagatgaaaaataattatgatcagctcaagatataaagtcttagtgttttctaaaaattgttacaaactagaaataaagaggaatttctttaacttatagagtatatctgctgcaaactgacagtatcattcttaatggtaaatgttagaagcatgccccttaaaatgagaaataaaattacgctattataagcaccacttgtagaatgttgcatcagccttctcctggaggcttaagttaggacagtaagaccagaaaataaggagaaaaaaataataattcaaaagaaggaaagttctattatcatcaattgtattatgtggttttctacttagaaaacccaaaagaatctataaattattaaaaataagaaagttatttccttatcagcagggcacaaaaaatgtagccataaaaagaagagtagtaaatttgacaatgttaaaattaggaatttctgttcaacaaaagatactataaacagaatgaaaaaacaatccacagttgagagatgatgcttgcaatacattaaaatgacaaaaaattattatcaagaatatatatagaattcctataattcaataaaaaagtaccaacagttaattgaaaaatgcacaaaagaaatgagcaggcatttcacagaacaggaaatacgatcagccaataaacatatgaaaagatgttcaatcttattagtaatcagaaaaccacatgagccatatggaagccacaacaagaaagcattttataccccactctcttatccacacacacacacacacacacacacacacacacacacacacactataataatcataatagcagcagcaaaaataaataacaatagcaagtactgacaaggatgttgatcaataagaactcctaacacagctgctgcacgtaaactagtgcaacaatgcaagaactcaccatgcatatcctcacccagaaattttacccttaggtacctgaatttgccatacctgaagccgggatggcaaactacggcctaagggccaaatctggccttttgcctgcttttgtaaataaagttttagtggaacacagccatatccattgacatatatattgtcttttttttgtttgtttgtttttttgagacaaagtctcatctgtggcacaggctggagtgtactggtgcaatctcagctcactgcatcctccacctcccgggttcaagtaagtctcatgcctcggcctcccacgtagctgggactacaggcatgcaccaccatgctggctaacttttgtatttttagtagagacggggtttctccgtgttgcccaggctgttctcgaactcctgacctcaagtgatcctcccgcctcggcctccaaaagtgatgggattacaggtgtgagccacggctcccagccttatatattgtctattgctacttttgtagtacaattgcgagtcaagcagcagacaccatatgacccatgaaatctaaaatatttactaactggcactttacagaaaaagtctgctggcccctgccctaaagaaatacttgtacatgagcacaacagacacatacaagaacattcagtacagcactattcctaatagcaaaaactagaaatagtccatcaacaggaaaacagataaattatgacataagcatgtaatgggatgttagattattgtgcaaaagaacaaatgacagctacatgcagcaggaatttatcttaaaagaatattgaacggaagaagtaaaaacagagaatatatacaacatcatctcacttagacaaggttcaagggcatgattatcataacacagaagaagaaatagaaactgagaagcactcatgtgtaacatcaacaggatgggtaattttctcaggtggggcagggaggctctccaggtgttcatgttagtattatataccataatttacatacgtgttcttttgtacctatccaacagcatagaataatctccttggatgaacctgtgggaggagtataatatagtgtgtaacagcccagactctggagccaggctgcctggttccaatcccagccctatcactttcaagctgtgtgatcttgagaaaatgtctcagcatctctgaatctcagattcctcatctgtaaaacagggatgcaagacctaccttacgtcacagagtacacacaaatcataacttcagtggcaagcatgagctcacaatatgctcagcatcactccccacgtatcagcagagcctgtgcctacagccatcctccttcaccctgcatggttgaatcagaggccagagccagggcactgtgatacacactggccctggtgcagaggtgcactgatggattatcacaggatccagacaggaaggtggcctaccaagggcagggggtgtaggatatagtctcataatcatgatgtttggctagaaaatgtctgcacatggctcctaaagtgaattcacaaagaacgagaagccaacttcaacatcagcagcacctgaaatcatcacctaccaggtcaacaagaaaaatgtatatattttttgcctttccaaagtaaagaagcaacctgaatccttgcgtcttatctcaatttatcttttccatgcagtgcacaattacagtgtagggaggaaagtatgggttttgagcaatattggctgagagtctctcaattaccagagctcagttactgaatctcccctaagccatagtttggtcatctgtaaagtggggataacagtgtagacctcacaatgttattcaaaggcttcagtgagacactgtgtgttcctctagacaagccctcaagaaaagcgagtcctcaacttcaaatactggtgacattggagccaaaatgccaagaccattaacctggtgtacttctttaaccaatcaggccactgaaacattaagcatcctcatggcttttaccagactgtgtttcaatagtgtttccccaaatacgttccctgaaacagcattctgcagatgttaatacgtgttctgttgggggagtagtggaaaggaagggttctattgtcatgtatcatataatcatgtattcactatacacacacttgcacacacacacacacacacacacacacacacacagaatgaccctctcaaggacagtttctaattttcataatgaagtatagaagaaaggtgagaggaccagagggaaactgtctcaccagaccgtcggcacaagggaacaatttcagagagaacaggtttccattcctctttgcttagctatagctagattgaggggctgggggtgcagagagtttccttaaccttggattactctgtcctgtcctctccatcaaaactcacatgcctcacatccaccactcactcatctgacaatactgctccaaagctgccaacactatgtccacttcacaagagcataaattgtggtggcttaggggatttgactgcaatcacatcattagcagatacaggccagtgtctaaaattgaggtttcctccagccaattctacagtctcccctgctctaaaaatactacagaatttcatcttgaacaactcatataagctcctatattcattcagttctgaaagaagttacaatgaaaatacaagaaactaagccctacttgagtttatataaaaaagaaggaaaaatacactttgccttagccaacgtttataagagtgacttccaatagctactggagtcagaatctaatccagatctcagaagtctaaaacacagaaaggtaactagaatgaaaatataattatatatgtatgatgtgcatggaacacacaattatttaaatagggaatagccagatgtttagaatctactgtgtcttatctccaaacatggaaaatatgagctcctggcaggtttgaaaaactgtgtgaccttaagctcttttccacactatggggaaaaaacaaaaatgataaagttttgcactgtaaagcagcttagggtttcattgctatgaaaaccgtctccaagctatataaaaatatgaattggcttatatccaaaagtcgtgaagtttttttttttaataaatccatactccttctcaagcaagtacttaccataactctttcaaagaaaacagaatctctttgcagacaacttggcctgctttacttctcctgtgactttattttcttattaatcacttcctagtttgtctgtaattaatgtgaagggcaggttctctgatccctttctctgtaatcctatgtacaggctgtacaacactcttcatgacttcaaatcttccttaggctgtgtcatgtgtgtgaaaagacaaacagcagaccagctgaaaacatgtggccccagtgtgtggtggaagagttggcctgctgagggaggtataaaaaattaatatttagacatatggtctagcctctaggctttctcttttggggtagaataccccaaggagaagcacatataactaaataaagaatatggataggtgatttttaaaagcactgggactctgggttcctcacccacacactgtcattgataactgcataactcactttggttgataatatgtgacgttttgccaagattcatagcactaagaacagtatacatgggaaagccctcttggcagttgcttttgtacacaaagaggagttctggttttcattacagaccaatactctaaggtggcacaatattggaatactgcactgagcttagagttaaggacttaagttctaattctagctttgcaactaaccagttacgtgatctggggaaaaatcactaaacttgtctcagcttccgagaacagtggtgaagagttgagttttgaatcctggatctacccatgacagcctgtgatgccttgaacaaattacttaagtactctgagcatcaggctactcatccgtaaacaggaaataataattgtaactcactacagggttcatacaaacaccacaggagatgcttactgagtgagcaaacaagttcccttaaagcctgaagcacagggcttggcacataatgaatgctccacaaatgttagctattttcattattttgagacactggtggtggctagaggcctggaattaaaatttctgtcctccctcctccgatttgggcagggaaaagaaacgggcataatgaacataaatctttgattatcaaataaatgcaacagtgggaaacaaaatgctaagcgctttggcatttttttaaataagagaaaaagggaaatagatgttttaagaccaattcgaagatggatataatttatttcacattaactgacctgtaaataactctacaagggactctcaggaataccaaccatttctgttttgaaggtcagtgttctttccctgttgttagccagtaatccacaaccaactaaaggataatggcatgccctgttatcaacacttctcaacctgatacaggttacaaaaaaaactacagtttaagaaatactggtattttaaaaatgtgttgagaagctaccccaaacgtgtaatgatagaaacgatagctaaaatagaaacgcttataatattaacagtcacagccatatacagttattataggacggctctttcatttaactgcttagcaaatgtttaatgccaatgatgttttaaaggttttattgaaatttccttccctgtcacttcctcttcaccctccaacatgttcatttagcaaaactgctaaccatctaagtacttttcagaattgtaagatgtcttacctaaattaatatcatttcaaatagctgggtggcaggcattgaactatattaactttcccctactctgagctgcctgggttcatcagccaaactctagtccttgctactttaaagttttaaagaggagagattttccccatgtaccctccctgcttctctctacttcttgagtcactccaaccctgagaagggagaataacagacctccatgctactcagaggatccttggaccaaaagcatcagcatcacctgggatcttgtcagaaaggtgggatctcaggtctcacctcagacctgctgaatcagaatctgcattttaacaagacccacaggtaatctgtagtcacatgaaggtgtgagaaatgcttccctaaacttaaaaaaaaaaagtttcagttttactactgatttaagattatttggtaatggaaagttagggaaggaaagcactctgaacacaatgctgtaggatagtcctgagaaacagactgaaaagccagtgtgtgtgattaataaagtctgagtaaactatgagtggcgcccccaatgcaggacactactagataaagtgggtcattcactcattgatttaaccattgttgaactatgtactattttttttacagatcataatagatgttgatattttcagggcacatgtgataatttaacacattcatataatttgtaaagatgaaatcagtgttcttgggatatccatcatcttctctctctctctctctctctctctatatatatatatatatatatatatatatatatatacacacatatatataatttttttttttaagacagagtctcactctgtcacccaggctggagtgcagtggcgcaatctcggctcgctgcaagctctgcctcccaggttcagccattctcctgcctcagcctcccaagtagctgggactacaggtgcccgccaccacgcccagctaatttttttgtatttttagtagagatggggtttcaccgtgttagccacggtggtctcaatctcctgacctcgtgatccgcccgcctcggccttctaaagtgatgggattacaggcttgagccacagcgcctggccaatatttttttctttatgctagaaacattcaaattattattctctagcaattttgaaatgtataatagattattgtaaactatagtcaccctactgatctatcgaaccctatgtctatttcttctatcaaaccatgtatttttacccgttaatcaactctaccaagatacctttccaagtcaaaaaggaaatcctgccaggttaaattatatacatataaatgtgtgtgtgtgtgtgtgtgtgtgtgtgtgtgtgtgtgtataaaattatatacaattggctctccatatgcacaggtcctacatctgaggtttcaactaaccacgggttaaaaatatttgagggaaaacaaaaaataatacaacaataaaaaaagaaaaaatatagcataagaactatttgcatagcatttacactgtgttaggtagtataagtaatctagagatgatttaaagtatccaggaggatgtgtataggatatatgcaatactacgccattttatgtcagggacttgagcgtccacagattttggtatctgtgggagtcctggaaccagtcccccacagataccaagaaatgagtgtgtatgttgtttactatttctaaagattccataaatactgaattttaattctgtcctgctacttattgttgtcataatttaaagaacaatccaagaagacctttaaaaattatccgatcgatgccagaagctaggaagggtgtgtgggtgaaaaggaagatgaggagaggttggtcaatgggtacaaacatgtagttagaaagtataaattcaaatgtttgaaagcagaatagagtgggtgatcatagttagcaacaatgtattgtatatttcaaagtagctagaaaaaagaatttgaaatcttcccaacatataaaaataaatactcaagatgatgaagtatttaccctaatttgatcattacacattctatgcatgtaacaaaataccacatgtatcccataaatatgttaaatgctatgtatcaatttaaaaataataaaacaattaaaaagtcatcacaatgccagttctaggcattacactaaactgttttgctcatttgtgcttttaagcagcatttctgtagcatgtctgtgctctcggtggaattttaagtgactgggaaaaccatgaggagtctgtgataaatctttttcattaattataacttgaataatgtacagaaaaaaattgaatatgtgaatatactggttcctaattagcctaataattcaaattctctaaggttttccattttattaatgaactagaatcaaaggcctgtatctttttctttctctggtgtgaagataagctacctactgctatatccacacaatgcctatggtccttaatatttagtgaatatgtatattcatatatatatatatatatatatatatatatatatatggggtgggagatgagtgaatgaataaataaatgaaagaatatgccataccccataaacaaaaatgtgtccagcataccataaaaaagtaatatgaatggacaaaaaaaaaagagaggaaaatataccacagtgatcattgctggggagaggaggatggggaaatgactgctaaaggatagggagtttttaggagaggtaattaaattagagtacttaaagttttaaattagacagtcgtgatggtttcactactctgtgaatatactaaaaatcactgaattgtaccatttaaaagggtaaattttatgatacatgaattatatctcaataaagctgttaaaaatgatgggaggcgagagcattacggatgccttcctatttcccattttcattcagcaaatattttttccaagaataacttatttactcatcatcgctaggctagttaatattctttgggttgcaagcaacagaaaacaacttggcctgtcttgagccacagaagggagtgcatgagaaggatatcaagacatctccccgaatcaaagcagcaactgtgaaaacaagacccaagaaaagaaggaagcagtacgcagcatgaatctctgtgagaagcttggttccatgttacttggtttcaaggactccctgctccaaattgaaaatacccaggatggagtatagaattagcctggcttgggccaagtgtcttccaagcatcaataggctgtggcagctgaccctcaccatcagaagctactccaagaggaagaagagttgcttaaaggtccacagcaaccccaagaagaatctactacaattgctattctgattaaagaaaaaagaagcaatataaatgatatgacagtgctatgattatgtttctttggagtaggggattcctaaagtaccctttaggactatatataagactcaggtgaactgcatgataaagatgtagccatgccagttcaaccttctgacatgcagtattcggttttctgttcctgtgttagtttgctaaggataatggaaagttttaaagatttgatttactatcccaaattaagatctctgactatgacatcagacagtctggggccaaaagcctggtcactcactagttatggggtcagataaccttgaatgggcctccaatgtggtcatacactagctttaaggtcatataaccttgcggaggtgggggctgtgggatattggcaggttattttcgctaaacctcagtttccatctcttttaaaagctgctaataacacatcttgcagaagcatgataaagttagatgataacacatgcccaatacttacttatgcctgaaacttagtaagtaccctagccaacaggaagccatcattttcaagctcctactattattaatatacaaatacagattgcaaactgttccagaatgcagtgcaaacaggtgaaactgcaattccagtgggtgggggggtggggtcagtgaaataatgtttggctgtgtctatacaaagaaaatctttcaaccagagaaactttttagtttggccacttcaagtgctaacttgaagcaaataaagcaatagcacataaaatagcacataaaaaaaaagaataaccctagattttgccacaagctggtacatgcattttaaagagacagcaaatatttaacatcactgaacactagtgatggcacagatcacaaagataatctttgtttctttttgcaggaggataaactaaggcccaaagaggttgaccactggttgtctgaagtcacaacagaaatgacagcactgctagttgtgaagtccaggcaccaaactctcagcacaaaactctttcctgctctttcccttctagctccatgtaccagtcttatttggtcactgcactgcagagggcatgttaccacataattagtttcagggtatgtgcaacagctgccacgagccagagttccacactggagtcaaatgtctttggtctagacgcatcccttccaccacatgccactgatgggacagccgccataaccacattccttactccagcggctccaagcctttaggagttggagcacatgacacattccaaccaagatgaagtaactcctctctctgaatgacttactaaagaacacctttaaggattttttcagatttgacattcttctacccgggagcttaaggactttaaaaagggtttagagaaattttttttcctaaaaatctatgtgagataaatgttaagaattaaggggccacttaggaacctggaaatgataagtcacaggagatccatgttatcattgagtaagtcaaagcaaaaaccagaaaaaaggaaatggttgttttgcagataccatcaccgaaagaatatgtcatatcactgagaaataagatctcttgataccaatcttgagtaatatctgtttgagattattttattgtatctggataattttgggcctattagcaacaacaaaaattttccttaaaacgaagactcagaaacccatgtatgcattcctaagcacatagatatatttcatatgctttaagattatttttcaaatcttcaaaccagtgaaatagaaatttctccaaaagtacagtaaaaactatatttaaacaaggaattgcaaagtgcttatttcatcccttgatgtttattttgttttacaattcatttgagacttttaaagtcagaaagagaaaaaaaaaatagctttcaaatttgagtctggaacagagctcacctatcaagtccaacagggatataaagaaagtatccctgttgggatagtttcccaacaggaaagtatagaaaaaaagaaagtatctaacagtacagatactgctggtgcccagaacaaaagcattattgaatgaaagaagaatttaaatcgaagtaagcccttactaactccaggtcttgctggcatttttcctaataagatgaactattagtcctgggttacataaacttcaacacactagatccctcaccaagtcagagggaggccacaggcctcttgaacccatgcatctgtactctatttaagatgcatgactgtccctctcttctttgtttgggtccttagctgtggactaggagaagagtgaggcacaaaaccagcagaaacaaaggcctgcaaaatgagtggaattttttgctgttatctttgaacattttatttctttatttcagaaatccaaagggaaataaaagtggaaagaattgcaggctttatggtttaaaaaagaaaaaagaaacataggatgagtttacagtttatagtatctgcgaagcaactcttcactcattcctttaaataaacttttaaatcaccttttaagtggacagaaaatgctgttattatgagttactgagatctaatgtgggagactagttaagaacctgagtcctgaattcaagcaagaaattattctaccactgttaatctctgtcctgtttaatctctggaaagttgtttgccctcagtttcttccactgtaaaatggagatgatacagttgtagtgatgaataaatttacacacacaaacagatacacacacacacacatatatacagtaaataacctctcttaatattataactagtattaagagtaaaaataactattatgctggggaaatctctttaaagattatttcacaacttattcagtgaattccaggtagtacagttacttatctccttagatagaaggcttttccttttttcaaaaagaaacatttttaaggctataacacaatctcttattatactccctatctatcagccattatgctacaaagaattcttccttcgttagagtctatacagagaggtatagtatataagctggtcattcatttctgccacaaccattcacaggtgacattcactcaactcactttcactgactgtttattcagtgtgctaagcactatgctaaggcatggggattcaacaacaaagaggcatgagacatcgtccttggccttgagaagctcttagtcaaaagaagcaacaaatgaggagacgcaatcacaacagaaaaggatgggagcaaaagggaatgtgtacaaagtgctgaggcagcacagaggagggaggcatcaatctggtttgagcacaagggaagattctgcagaggatgtgaaccttaagtgaggcctagaacaaggaagaaagatattccaggcagagtgaagggcacgggcaaaggcacatatatatatacatactttttaaatgcatggcatcttgggtggaaaaagaagacagcttgatggctaaacatgaaccccaagagtagaaggaggcagctacgaaggtagcgatactcatcaataaaggatccagaagaacatagaaagggcacttcattcagcaggggggcgacgtaaatggagtgtttagcaccacatgttgcaaactgggcttgtgaatgcattctcagaagtctgtgagttttatgaaaatttgaaagttctttaattttaatgataatctaaaaactaaaattgcctgcaaattaagacatcacttttttgtactgatcatttatatttcaatcgtccactcaaaaaatatttattgaacacccctatgtgccaggcactggggatataacaatgagcgagacacagtacctgacctcatagaagttagactaataagaggaggtaaccaagaaataaaagtatagcatagcaagagacagtaagtgctgcacagacaaataaaatattaacgtggcaagaggtagaaagtcaaatggggggtgttcatttcatacagggtagtcaagcagtcagtgcacttcttcattaacatggtatctgagcaaagacctgaaggaaataagatatttgagagatattttcagagaagaagattttacttccccacatttgtcacaaacattcctaagggtctataagaatgctctttgtctctctttctctgtttctcattgttatagctccagtgcctagtattgtgcctggcacataggagtgtttaataaatgttttttgagtggatgatttaaatataaatgatcagtacaaaaatagttgtcttaatttccagataattttatgttttagattatcattaaaatgtatgtctgtctctctccttcttttgagacaatgtcttattctgtcacccagggtgaagtgcagtggcatgatcatggctcactacagcctcaacctcctgggctcacacctcagcctcccaagtggctgggactacaggcatgtgccaccatgccgagctaatttttgtatttttttgtagagatggggtttcaccatgttgcccaaactagtctcaaactcctgggctcaagtgacccggccaccttgtcctcccaaagtgctgagattgcagacatgagccactgcaaccagcctgtttttatttttaaaaggtaatctgaaaaaatggagaaaacatttgcaaaccatgtatctgataaggggttaatatcaaaaatatatataaggaacttctacaactcaaaagcaaaaaaaaaaagacaacctgattttaaaatgggcacatagactttttttgaagaaatgtctatttcttcaaaagaaaacatacaaatagccaacatgtatatgaaacagatgctcaaaatcactagtcatcaaggcaatgcaattcaaactcacaatgagatatcatttcacgtctattaggatggctgttataaaaaaaaaaagctaaagagggtctggatgcagtggttcgtgcctatatcatgcctataatcccagcactttggaaggccaaggtgggaggtttgcttgagcctaggagtcaaggcttcagtgagttgtgattgtgccactgtactccagcctgggtgacacagtaagaccctgtctcaaaaaaaaaaaaaaaaaaaaagataacaagtcttggtaaggatacggagaaattggaacccttgtacactgttggtgagaatgcaaaatagtgtttcactaagaaaaacacaacagaagtttccaaaactaaattaaatatagaatcgccatatgatccaacaatcctactctgggtatttatccaaaagaattgaaatcaggatctcaaagacaaattcacactcctgtgttcactgcagcattattaacaatagccaaggtctggaaatgaaactaagtgttcataaatggatgaacggataaagaaaatgtggtatatacacacaacagaatattattcagccttaaaaaaaaaaaagaaaattctgccatatgccacaacaaagatgaactttgaggacattacgctaaataaaataagccagttacagaagaacaaacattacgtgattccactgatatgaggaatctaaaatagtaaaactcatagtggttgtcaagggctagggggaggaggcaacagggtgttgctatgcaactggtatagagtttcaattaagcaagatgggtaaattctagagctctgctgcacaactttacacctatagctaaccatattgtattgtacactcaaaaatttatgaagggggtagatttcatgttaaatgttcttatcacaataagaaaaaaagattccaaggcaatacctgacaaaaacaaacacaagccaggtgccgtagctcacacctggaatcccagctactcaagaggcccaggaaagaggaacactcgaggtcaggagttcaagaccagcctgggccacatagcgagaccccatctctataaaaaacaaaccaacaacagcaacaaaaatgctctacagggacagtccctcaatccagaccacacagaatcccagagatcaaacaatatttgaagagatcatgactaaaaaatttccaaaactcactaaagatacagggagcaaatgtgttacagcagggtaagcaaatgtaaactcacactcaaacatctacaagtaaaattacagaataccaaaaaagcttatctgagcaaacgacaattcattaatcaggaacctccaaaccaggagtggttcaggagttcctccaagggaatacaacggggaggcttttataggataaacacagaagtagagcaaagaaaatatttgattgattacagatacacagtatctgtactgtgttttgaagagatttcaaaaacaaccatagagaagaaacaggttaactacaaaagaacaaggactaagatgacagccgacttttcaaggaaacaaaaatattatttcaacaacatagcttgaaagggctaagaaaaaataactctcaacctagaactttactccaagttcatctgccattcaagaatgaggataaaataaagatacattcagacaaaaacagcttaccactgacataatccacctgaaattgcagcatgcttctactagcttgtaagagccaaatgtgaggtttacaggaattttgctagtctgtagaaaacatgctgataaattgaaatcagccatagtgggagtattaaaccatgggaattggcaaacactaaaaaacaggatttttttgcccctgggggaccagttcctaaatatttaccatcacgccactgacttcaaagaactagaatgtgtacatcaagaaaaaaaataaatctagaaggaaggattgatatgaaggaaagaaaaatgagaaaataaatacagtaaatgtaattctaaataagtacttatgcataaaacaataataatgatgacaattcctgaggtggggagagtgggagcatatcagtcaggtaacctccttatactgtggcaacaaacaatcccaaatctctatggcttaaaacaacaaatgtttatttctcattcatgttaaatatccttcagggtttagctagggaagtctgcccattgtagcccctcaatgactccggccaagtagaagcatcatctcaaagtcttcttcaacaattgccacaggtcgcatggtgaaccatacgctgtcttgctaagctttttcacacttcactggccaaagaaagtcagatggccacatctcatttcaaagacacaaaagcgtaatcccaccatgtccccaggagagtataaaaataaaaacatgtaagacaggaggcaggtggttggtgttaagcatgttccaagttcctcatattttcgtgtgaaaagagaagacaaatagggtaactttaaactttaagtatgcaaatttaaaggataatattaaaattttaaggataacagctgaaagaatagagaatagaattataacttccatatctgtagggaaaaagaatacagaaaatgcaatttaaaaagaggagatagacatggaaaaggcaaggtaaataagtaacaaaataaaatggtagtgttaaagagaaaactgaggcactgtaaaagtttaaagagcttatctgagcaaatgacaattcaggaatctggcacctctaaaccagaagtagttcaggagctcctccaagggaacacaagggggaggcttttataggataaacactgaagtagagcaaagaaaatatttgattggttacagatacacagttgccttatttggtctatcctgttggactgtctctgattatataagtttgttggctgcttctgatcagttgagcctacgttctgtttttctttaatataggcatttacaagaaataactcaagttaagtttttcctgtttgtaaatcaagcaagtttagatcacccataaggcctaactggttttgtttgctaagggatacttcaggcctggtccccattttaatttactttaacaatagaaataaatgcaaatataacaacagttacaacagatgtaaatgcaataaactcaccacctaacaagagataaatcatgtatttgcattttttaaatgctgctataatctgttaacaagaaatataccaaaaacttaagaacacagcaaagctgaaagcaaaaggactaattcagagcgcaggcctggaatcacacaagcatggaaatcatataattctaggtacatcctcaggtaaatcacctaaccacagagcgtggcagtttcctcatttgtaaaatgagctaacaactacacttcacaatgttagtaggattagatgagctatgtataaactgtttcagacagagcctggttcatagcagttgtttatcaaataatagctatcctattgtcattaaccctacctgcaaatccacaaacagtgggctttttgtttgcaaagaagagtgtttgcaaagaaggctgcaaatttcctcccatcctatccagataaccttttgcaatatgattttgccaccacttgcatcaagagttttagtctgtttctccaccccttgaattgggatggccctggaatggctttaattaatagaactcagaggtgaggtttatgagttccaagtctacgcctcaagagaccacgccactgccacttttgtactcttgagacttctacttccagccaagatggagttggagagatagactaaccttcttgcctgaaatgactaaaaaactggacaacatgtatgaaataatggtttcaagaacagtgattcctgagatgtagaacgaggtgagcattataactgtcccagcctactgcctggagacagtgtccaggctgcagcacaaggaggggaagcccaggcgaagaccagtggtctccctcatttaagaagaccaaattgggaatctggaaagatgatgtcaggtagagttcacaggaaggaagggtgcagagagtctctgctatgatttggatgtggtttgtccccatcaaaactcatggtgaaatttgattcccaacgtgacagtgttgggacatggggcctagtgggaagtgtttgggttggtgggggcagatccctcattaatagattaatgccatctcacaggagtgagttcccactctcgcaggactatattagttaccttgagagtaggttgttccttcttgtgtttggtctgtctgtacacactgtgcttccccttctgttttctgctgtgagttgaagcagcatgagactctcaccaggtaggctgaccaatcttggaatttccagccaccagaatcatgggtcaaataaacttctttataaatttcccagcctcaggtattctgttacacaaacactaaaaggagtaagaaagtccccctagaatattcagctattggtcatcacatgtgtgtgatgaaaatgcctgaggccaaaggaaaaaccacccaaaacgatagaggaaataatgcttggagctcacactttgctctcttggaacacagtatcatgatatgaagaaattcaagctaccgtctttgacaatgagatatcatgagggaagaggcccagacaaatgccagcaacaaccaccagacatgtgacagaggccgtcttaaacctactaggccctgtcaaatcaccagataactgcagcctcatgaaggaccttagaagatatgagcaaaactgcctaactgagcccagccaaagccagccctaagaatcatgaaaacaaataaaacaggtgttgttttaagtcaccaagtttggggctgattattacactgcaatagataactgataaacaagatgtcaaaaacaatgttatatacacacagcaataaacatccagtaaatggcccatctctaccacccatcagcttaaacgaatatctaagggcagccagcctcaactgcagcaagagtcacagccttcctcattcgcaggaggttaaaaccactgtggaaaaaacatgttttccatcatagaatcctgaaataccagggttcacatgtcacctccactgtgaagcactcgcaagattctgctgacagaaataaccatttcttaatctgtcatgagattagagtagaaaaaaaaagaaaccacttcttcctcttatttccatggaagattgaggacagccctgttctggcacctacaaccgtgtgttctgtggtcttcttatcctcagcagcagcacatcacaggcacagctaagcagttcacccttattggtagtgagtcacacagcacagttcctatccctaaacaataactacactggaagtagcatgctgggctattttaatcctgaagaaagaggtcagaaaactgaaacaagattaaaggatgactaaggaagcagctctgtgttagttgtgacagagggagctggctttaaatttatcaggatccctcccttcccatgactcacccagccttggtggggagaaataccaagtgcagtctcagggcccaacaggccacaatatacagatgctccttgacttagcacaaggttatgtcctgataaacccatcgtaagttgaaaatattaagtaaaaaatgcatctaatacacaatctactgaacatcatagcttagcatagcctatctcaaacgtgctcagaacactgacattagcctacagtcgggcaatgcatacttgcaccatcataaagtcaaaaatcaaagccaaaccatcatgagttatggacccactgtaggtaagggtctaacgggccttcatgcatcttcaaggtcaggctgcttcaaaacgggcatctgtctgctgcctttggtcacaatggaaactgacaaaccatgagttcatgctgagctgaaaggcccagatgagccacagaaacaagatgtaactgaacctgcaggaagggtaaaattaaaatcaccccagccctgactacctctgagacctcatttcctctggctctcaccttcattcacttggttccaagcactgcagcctccttgctgttcttccatcatgccaaggacactcttgcttccaggatgttgcctttgcccttccctctgcttggaatgctctttccctagttgtttcccctccctcagttttcagttctttgttcaaatgttacttctccagggcagtcttcctggaccactctatctacattaagacccccacatatgtcctgccattccctagtccattagcctgcttttttttcctcatgatctatctacctttaatttgtgtgtctatcttccaactctaacatgggctctatgagggcagggatttgactatttgtttaaaactatatacccggctgggtgcggtggctcacgtctgtaatcccagcactttgggaggccgagatgggtggattacgaggtcaggagactgagaccatcctggctaactcagtgaaaccccatctctactaaaaatacaaaaaaatttagctgggtgtggtggtgggcacctgcagtcccagctacttgggaggctgagacaggagaatggcatgaacccaggaggcagagcttgcagtgagccaagatcgtgccactgcactccagcctgggcgacagagcgagactccatctcaaaaaaataaaaaaaaaacactatatacccaatgctggtgacaatgctgcacaacacaaccaggagatagtcaataaatatttcttctattagtgaatttactagatgtcttctatacattgtaaatgtatcaccaatagtgttctacatcagtggttcatgaaaattatgaagttgtaacctctataaagacagatgctgtatggatcttgtcattatgaactatatgtaaaaataactgacatttgtaaagtacttaccctgcactgagccctatgctaggatcttttatgcatttttccaagttttcttcccaaccactttatgaagtgggtatgattaccatcccctttctacagatgagaaaactgaggctcaaagagaaaagtcacttgctcaaggtcacagcaaagatttcagtctggctccggaacccaagcttttaaccccaatgctatacttccaggtaggaaacagaatgaatgaatgactggataatgaactagagatgcccatcagacacactctggttgcatgctcttcttgcagactctgtacaaccaccgccaagctccatgtcacgtggccctactcctcactctccttcttctagcggctaaatgatcaagggatgggactctcacccctggcctggctgggccatcagatgcctcacttagaaaattagaattggaaactgagaggctgagccaggcaatggaggaggcaaaattgcaaagaactgctcaggaagagctggggccttgcaagccaaagcctgaggaaagtccaagttctgaggaagcacagtggacacacaggaagagtgcggaaagcagatagtgaagacaggagcacagagtagggaagtcatagaaatgccctaaaggagcagtgaacttggatcctgatagtgctccactttctgctccagcaaaccccagcttttttttctcaagatagtttgaacagtctcaacccacccacccaaacatattgcaataaattggtcagactagaacaaataaaaaataagagaaatggtgttcatgtccaacagaaccctctctaaagctgttctccagaaccaccttgaattacttattaatcctgtacatgcaggtgtgagagttgggatagttccagattccagatttttctttctctaccactgctgaccttatcaaggtcaccaacttctgctgcctttggccatttctggccagaagaaaagctcctgctgtcccacatgacccaatatttcagaatgaggttccctcagcagagttggtgggctgctagtgaccacagccctctcattcccagggagcagcaggctagaggctgtgccaggccatggttaggcacctgctccatcattcctctgctctctgtgaactctcctcacttgtgatgatttctcttctcaagggtcccatgccctctttctctgaaactggatttctctggggatccctggcccatcaaactagggctacgtatgtctggattccacttatattaagagctcaagtactttcccacagatgttccatgatgcctgcctgggaggccaagaagcctacaaagaggatgctgctgtcccagctccacctgctgaccagttacaacatggtcccagccaaaatatcccctttgaagaccaatgtgtattagtccattttcagactgctgtaaagaactgcccaagactgggtaatttataaaggaaagaggtttgattgactcacagtttagcatggcaggagaagcctcaggaaacttacaatcatggcagagggcaaagagaaagccaggtaccttcttcacaaggcagcaggaaggagaattaatgcagaaggaactaccaaacacttacaaaagcatcatatctcgtgagaactcactcagcatcatgagaacagcacgggggaaactgctcccatgattcaattacctccatctggtctctcccttgatacgtggggattacaattcaagattagacacaaagtggtatggacacaaagcctaaccatatcacactgaaagataatgaacccatatttaaatatcactacttagctgggcatggtagcccacacctgtagtcccagctactcaggaggctgaggcagaagaatcgcttgaaccagggaggcgtaggttgcaatgagctgagatcataccactgcactccggtctggataacagagcaagactccatctcaatcaatcaatcaatcaatatcacaccataagcacccattcatgctgccatccacacaacagagacctcccttctgaatcgagggaatcagagaaaccctaaccagcaggaccctaacacaatccttccagtttatatgatgaaactgagtcatcccaaggcaaggaggaacctcaggtccaagagagccaaacattagtaaggaagattcctttataggattcacacttcacaaactacatgtggttgagttcagaaaacaccaaatgaaggctggtttgaactgtgtgatgcaggaagctgtgaccatacaaagtgaataaggtctagccttcatcttcaaggcatttgtaactcagtggaggagagttagacccacctatttaaatgacaagaaaggcatgtgcagatgctatacctggggcagaaataaagtgctatagtaacctaagtcaggggtgaagaagagtaagtatgaccagggagggctccatgcagaagaccgaaatttggttaatcctcaaagttcctacttatgcttccagtctcagctggaatgtcccctccccaagaaggcttccaagacctcataggctgggtttgtaccctggatgtacaactccacagcaccctgaactttcttccactttcaaacctgactcatcaccttccacaattttctcactagatgcaaaatctacaaaattgggaatctcatcctcagtagtgctttgtacactacagctgttcagtaaagaaatgtgtatatatgtgtgagtactaaacaaaactgagctgaaaatgcatgtgatatcttacacccatactagaggaagataaggtacaaacgggtatttttaaaatagtctgtgcaaaggtacaaaagtgaaaaagaaatagaagagagaagtggtgaaaggggaaggtagcataataataccctcaagtaacctttaccaagccccatacatgaattctcccatttaatcctaactactttgagagggagatattattatataattattgttctacagacaaggaaactgggatagagagaggtcaagaaacacccaaggtcacacacaagaataagagccagattggacctcagcaagtccaatctcagaagctgcacacttcatcaacacctgacattgaattgaaaaacggcaagagactttgagagaagagagagaaaaaagcctaaatttggtgtttggaaaagtacaggagcatctgctctgagagctagcttcttgaaggatgcagccacagtcactggcattctgaaagtaactcaagtaaaagtagtagaacagtagagcaagggacaagtccatggatagtgaagcttagatatttctctatttatttccactatagtccacctccacccttggtcaccttctttattttccaataaaaggatacttatagatgctgaaataattaaaagcaaaatcttttgcaaattacaacatgggatgtatacttcagatgtttaaaagattttgttataaatggcctaaattataaatttgttttggaggagggttaagaaatgcctttattgttaactcccttcttctgtccaatctataggctgttgagaacagtgcacgaaaagtactattttgtttctcaatttttaaagaaataacattataaaaactccaggggagcctggagagccttcataatatcatgagttctacctccaggagccctatcaggttctcacagtgaggttcagagaaagctctcctggttcctcctgcagggaattgtgagaaagtcaccattttgaaatatgcccagagtattctgttcataaaaaggtctgccctcaaaggaaactacttcaccagagcctacctgcctggaggaagggaaacatccaactccagccccttctagctttcctgtctctcctaaaaagaaaaacaaaacaaaacaagactgagaagcacttgtgaaggtcacagcccaggggcacaggcttactacagatggagacctaatcacaggaacaactttagacacattttgattaagtactaattatagtcctctgtagttttccaagtattctcatatatatgtatttccactatatatatatatatatttccactatatgtatttccaccatatatatatttccactatatgtatttccaccatatatatatttccactatatatatttccactatatatatttcaaatattcatgtgtttccaatatacatatatatttcaaatatacatatatatttccaatacacatatatatatttcaaatatacatatatatttccaataaacatatatatatttccaatatatatttccacagctaccttaagagagagagagggtgtctctctgtcacccaggctaaagtgcaagtggcaagctctcagctcactgcagcctcaacctcccaggctcaattgattgtcacacctcagcctcgtgagtagctgggactacaggcacatgccaccacagctggctaatttttgaatttatttttacttagagacaaggtttcgctatgttgcccacactggtctcgaattcctgggctcaagtgatccacctgcctcagcctcccaaagtgctgagattataggcatgagccaccatacagggcctcatttatattaatattttctcatttcatgccaacgtgtgggaaaagcagagaagacagtggcctattttgcagataagtaactaaagatctaggaggatgctaaacattggtggagctagtttttaaacacaccaattcaaactcagtccagagcaattttcactaacccacatcttgtcctatattacctatagattagaaagagtttgctaaaataaatttactggatttcaacttaattacagtccccaacttacacaggctagggataccaaatttgaaaatccaaaatccaaaatgctccaaaatccaacactttttgagtgctgacatgactcgcaacaaaaatgcacaatggagcattttggatttcgaatttgggataatgcaaatattccaaaatccaaaaaaaattaaaatctgaaacacttctggtcccaggcatcttggataagggatactccacctttaatacaaataacatttattgagcccttactttaggcaggcactctgacaaacccttcctgtgcatgacctccttttatgctcattgcaggacttatgagggaggtactgttcggtccgttttccagcaagagattcaggatcacagaggcaaaataacttgcccaatgtctcaacatccagcaattgtgattccaaaggtgagccctaattaaccacttgatatttgtgcttcattctattcatggcaagcatcaaagacactccttggccaaactttagttaggctcctgtagaccctcttcttaaccttgatcttctgtgttcacctgtccttgccaggtctgcacagctcagtcttagcaagaatctcacaaagtcagtttagagagaatcccctacccttgatacctgctaaagttcttcatccctgccctttattgtctaagtctttgatctgcctttagcaagaatctcattggatccatttagtaagaaccccctactcttgaagtctcctcatagtaattttccacccattgacctcctcactctactcactggctatatatccccagctgtctttgctgtattcagagttgaacccaatctctctcccccattacaatacccttattgcaatagtcttgaataaaatcttcctgaccattttaacaagtgtcagaatatttttttttctttaacacagtaatgatactccagcaaattagcagttcttgggctcaggagcttctggaaccaagtttctaccacccagaaagccctgaggcttgtatgcactaggacgttcaaacacattttaattcagtatttgatctgatggaagaagtacaggagagcacaagaacactgagacctaaaaatgggaaatataactggtgggtgcgtgtggcatcggccacactgcagtaaccacctcactgccttccctacccaagtcagtgtttggtaggcatgtggctttgagagccactgaagtttggtccatgacctcctcactctcccccgtcaccaaggcttgccttttggatcccaaaagctaggcagatggataagaaaaagcctcacttctaaatttttgaggacaagtatcccacttctagcgactataccacaaaacccagattatgtaaggcctgattcctgctgaagattcactggtgaactcactcccatgtgcctccactctgagctctcagggttcagggagcagagcagggagagtggggacctaacagctgccttaaggatcctcttgatacacactctgggcctaattccaggggaaagacttcctatttttcacacacacacacacatgtgcacacacacacacacaagagatttcaaacacatacatgcacacacatatgcacgcatgcacataaatgcacagaattgcttttgctccatgaggcaaaatgcttagggaggcattaggagctactgccaaagcatccaagctcatacaatctcagagtcatctccataataatcatcatcataacaacaataatagcagctatttgttactgaacacctgctgatgccatcatttaaaccattgcatttactcctatcagttctatgagttggctagatttaccaataaggaaactaagactcagagaggtaaagtaatacgcccaacaacacccagcagagccatgatttctacccagctctttctggttccaaggccactgttctctccactccatccctgatttcacatcaggaattgtttccatcaaatatgggagtgggacacaatactcagtgtctcagagtcgaacccttcatgggccagtttcacactagagccacacagtaagtgctcaataaatatttgctgaatgagcgaatctgtttaggttcttaaattatatttccagtttactgaaggctataaccttcacttcagggtccttctaatcagatttttctgcttttgttggtgacaacaatggaaactgtgtgtccctttgatcccattacactcctaggaatcagatccaaggagataatctgagagacacttttcaatggggttatggagggaaaaagaagccagagaagaaaaggggggaaaaacaatgcatatactgcattttctatttacttggccttaaaagaaagaacagagaatttctcaacaaagaaatgaattcttaggagaaataagttaaacttttttagttcatgctgccagagctttttccaatatgcaacacgtggttacactgggatgtcacgtagtagcccctcacagtcagttaactggacactacggctaactgtcagagacggtccattaatgtcttacatttcttatgctctctctcctatacagctggtaagaatgtaaactgaaacaagctcccaagggcagggtggccatgtggatgaagaaccttaaatatgtgtcttccttttgatctcacaagtccactcctagaacccaaggaaatcatttgaaaggcagataaagatttaggtgccacaacattctttgtgtttctcatgttggcaaaatttagcaaacaacttcaatgtgctataagagaagaatggctaactttgtggactatgaagcagggaataacaataatcgtatctaacatatatttcttggtcagggaaaatgttcacaatagaacaataaatttaaaagtagaattcaaaactaaacaaatactatcaaaataatttgtctaaaaataattgttagttcatatttacctatgtctatgtaaaagatcacaaagacactccaaaatgctaagtagcaaaccaagatgctacctctggctactagaattatttttcattttcttctttatatattcttatctcttccaaatgaacattttttttttcattttcaggaaaaaggtaatttttcaatgaaagatttttaaaatctatcttcacccttcaggaaattgacttgcaatatctataatagtcaaatcatcccagagatgtgagaattttttaaaacacaacaaaacagaaaattctaaagaataactaaaggaaacatattttgaagtctaactccagccactcttgggaggctctttcttatatataacccactctctcccactgtattttatgcctattaaacttggtttgtaatcttattaatctttgaatctctatggtttaccacagtgcctgacacaaaggaaccccttaatgaatgcttgtttaatcccaaaagcaaccatctagtggactatgggatccatggtgtcatctttccctcaaatggtcttatacccttctagcaacagtctccctttcctttggagacagagaaactcttcccccaaatcccttggatgccaaggtacaagaaggtgcctggagcatctgggggccacctcctcagccaaatctgcagtaggactaaaggaggccgactggcggagggcaggagggcttcaggatggagagagatcaggcaagggctggagaagtaggccataggccaagagaatcggagaccagtgaaggcagaaagaggtttctgaacccttgagccctcagttccatccctgatgacctgattcctgcaacttagcctcatttctgtccttcccagctatggcgagaccatacatcctcattttgcttgggctgatttgatttggttgtctatatttgtaactaaaactatccttacagatgctctctttttgtctctaataactataaacatataatattaaattagaatcattaagaaatattgcatagggaaaacaaaacaaaacactgctttgtttccaacagactagggcaagaccatgcctgataaacttacttatcagaagagcagaaaacatttaaaacgttgccaaggtgattgatactgatggtgaagttgatgataaaaacttcatataaaaatttgaatgtgaggcaaagcttataggatttgaatgtaaaaatctatttatttgtttgtttgtttgtttgtttgaaacagagtctcactctgtcacccaggctggagtgcagtggcgcaatctcggctcactgcagcctctgcctcctgggttcaggtgatcctcgtgcctcagtctcccaagtagctgggactacaggcacgtgccaccatgcccagctaatttttgcatatttagtagagacagggtttcactacgctggtcaggctggtcttaaactcctgacctcaggtgatctgcccaccttggcctcccaaagtgctgggattataggtgtgagccactgcacccagcctaaaatgctatttctaatgggcatagggcatctaagcccaaaatctatgtatttcttgaagggtggcatttacactagcatgtcaggttaagatgtgacttctcaaaggctggtggatattctattcaactatatgacgtaagacactatttaacatgctcacaattaaagaagcaactgaaaactcacttcctctcagggtcctacctttcctcaagttagtacataaatggcaaatacaggacacacagatgtcagcagaatttctccatgattttaccaaaaagacgtgatgattttcaaagatacttgactaaaagaatttttttgagtcaacaaaaaagcgatgattttttaaaactggggtgaggggtgagttctgataagtagcaactccagtgtgcactgtctatacattggaacattttgcctaagcattattaatgatctataacccataagacaaaatgcaatatcgtgggcaggacaactcttgataatggagcttgtaaattttaaggtagggcctgaagaaaagtagactaagaactaaaaatacgtattaaaattccaaatcaatctagcatcagaccaaaaaagccatttaaacaataattagaaggtgagtttaagttagcagcacttgaaaaatgtatctagggacagaaaaataacactgtgtctctactctgctgtgagtcgtccttccattcactcatcggctgaatgaaaaaagtgtgaagctgtgtgccaagtgtgcgggacttggggagaaacagggtgggtgggctccagccttcaggaagcttatggtctacaaggaaaagcaaaatagtccacaagtaataataatagcagaatattaaaaaataaataagtaaataacaagaagtatctaccctaccttgtaggcagttcaacctagtgcactgaatctagagggaaagaacaccccagaccaaagaaacaccatacgcaaaagccctgaggcaaagagcagggtgtagtaaatgtacttagggaagtctaggaagtagaggcaacacagtgaacctggatttgaataccagctctgcctgacatttattagctgtgtggccccgggcaagttacttaacctctctgtgcttcatatataagataggaagcatcatttctatgcacgggattattagaatggtgtctgacacatggaaaagtgtttatcaagtgttgtggttggaacatagaaaaggagagactagcataagggcagcaggggcctaatcacacaggaccttgctgggaagacattcgagcagtctaagtctttttaaacaatgcctataggctgctatcatgacgatgaatgggggtgtggtgatgaatgcagatggaccagctggccagtaggaaatctcctgttgtggccaggtgcagtggctcatgtctgtaaccccagcactttgggaggctgaggcaggtggatcacctgaggtcaggagttcaagaccagcctggccaacatggtgaaaccccatctctactagaaatacaaaaattagctgagcatggtggcaggcgcctgtaatcccagctactcgggaggctgaggcaggagaatcgcttgaacctgggaggcggtggaagttgcagtgagccaagatcacgccactgcactctagcctgggggatagagcgagactctgtgttatgtggctgaaaaggaagaaaagctcaatgtggattgtgcagaggccttggaaaatgtttctaagacattatttctctacacatttaagagttcaactttatcactaataccaaaacttaataaaaaagctaaatactacctcaaatcaattgtaacctaactcctgttagaaaaacatatgaatattttataacctcagaattttaatagaggtttgagaggtatagttgagacatggtcttctgatgcttcaaaaaaaccacctctgggtggacaaatacttgaggcaaactctcagtaccagtatcagctaagtctgggccctagtgatgtacttaccaaaggaaacttaataaacgcttcaagctcccagatatcccatttttcctatgtttcttccttctggaaaaccggatcttctttaaaggaatgactgccaacaggctgaacccacaagtataagcagaaaggcaaataacaggtccactgtgccaaaccacagtttcccacactgattaccaggtaaaaccctgaactttcagtatagaggttaagaactcaggttttggagtcaaagagattggacccaggcttaggacctggctccatcacatatggggtatgtaaccgtaagtactcaacctcaacctaatcctcagggtcctcatttgcaaaatgaggggaacaatttcacctggctctaagggttgctgtgatgatgacctgatagaatatgcataaagcacttagctagtaagcactaaataaatgacagttatgattattatccatctgtggttcccacaatgccaccaaaattggggattagatgaggtacagaaaaaaaaacactgctggcaaattggccaccttttttggaaaattttgtggcatattgacttaatagtgaagatacacctacccactgccccagtacttccactccaagatgtgtactcagcaggcgtgcaagccacatgcaccaagagacaagagctggaaagctcacaggagcatcattcagaatagccaaaaactggagacaacccaaatatccatcaacagtagaatggaaaaataaatgatgaaatgatggtatatttatatgatagaataccaaccacatggtgcaaaaaattaatagatcatggctacattcaacaaaagggacaaatctcacaaatccaatgctaaatgaaggaagccagacacaaatgaatatgactagatggttacatttgtataaagttgaaaaacaagcaaattaactctagcatttaagaatgcatacttaggtggtaaaagaataaagaaaaacaaggaagattaccatgaagtcagagtaacagttagctttgaggggaggtagggggttgtgacaggaaaggagaacacagaagacttttaggttgtttccttacttcgtgatggttacatgtgtattgtattgattcattatgctgtacatttatgttttgtatacttcctatatctgtgtgatatctcacaataacaaagcaactcttaaatcactcctgcctgcctcatctaatccaggccctcttttcaggaacgtcagagaactgtggtctatgcagttagctctgcctttctgtaccgcctgtctacttgagccaaaatcctggtgggggatgagagacaggaaggatacagaagaggtgagaagatgggcctgccacctgcaattgccttcatagaactgtctaacctttccatcccagtctcaagggatactcccagggtcagcccctgtcttttatcatgtcacttttgagacatgaaaacaaagaagagtgagtgaagacgcctataattagcacaagcaagaaatgaaggacacaaggagaaatgccacattaaccactcattcaacatatacaaagtgccaggatacagtgactgttctgaggggggaatatgacccaatcagggccaaagtccttccttaaaatccacactgggacatttagggagagaagcactttctccctaaggctgtcaggccacaaaaatgagtctggacttcaggaggccacttttaccagccatgtggaggaagcatgtctgcaaatgaacaaaataaagctgacagaagagggcaaaagggctgagagttggacagagataagacaagtgcctgagaatggtgccttgcatcaagagtagcaaaggccagcaaaggtagggagagggtttcaatagcctcgagtccccagttccacctctgatgtcttgatttctacaacttagcctcagttctgtccctcccagctatgggagacaacatgggtcatatctcgtgctcaattctaataagagaaaagttaataacatgcaagtctttctcttaagggagccgcaattgaatcaggaaaatagaagtaacaacagatcatcacacagcatatgggagtgcgccatcatacagaagtggcgcaccttaaccagactagaggatgagagggaagtgttagggaagagtttctgaggaggtgaactatggaatgctttggtttcatcaggggaaagagaagtgtaagggtagtcaaggcaacaggggcagcttgtgttaaggtggggaggtatgaagggaactgggaggaaggacactcagaatactttggcactgctgaagtgcggtgtggctggcaggagaagccagggagactggtcataaaggagctgagaggcacttaaaggcctctgacttcacataggcaaagggagcctttgaaaagctttaatcaagagaaagatttaatcaggggtccaatttcccttttaaaaagatcaaggagatgtttcctaagtccaatgtctggcaacaggaagacatgtctctctctctccctctccctcttcccacccctgtccttactccaccctctctccagcaccctgaatctctgaaactcccttctgccccgcaactttcatttcctgaatttcccaccctatggtataaacaatagggacaacaccagctaatgacaagagcaacagaccagtggtcttgaaagctggatctaatcctgctctcccactaccaggccttggacccaggccaagccaccacagcctccgggctcatctgcacggacaaaacgaggataacaagattagtctacatacctcagaggtgctatgagaagtgtgtgaaagtgagtcaaaatcacaaccccaagatattgataaaagtgacatcctgatgcaaatagcatcacaaagcatactttatttgttctcttattaattataagtaattaaatcctatgatttggtaaatatatacacagtatccatgttttgtttaaaataagttaacatggatttctcatatctgaacatgcccaatattattttgggagtaatctgttttgactttattatattatctctgataaggacagcattaaatactatcattaaaatgatatatcctgatagatacctagtatttagcttaaaattaaataaagataacaatgttaaaatgtgtttaaaacacaggcttaaaaaatgaatgcagacacccagacaagtttcccaccagtgataaagcacttgtacctcagcagggtatcaaaatcccttaagataaaggcaggtgtttcctgaaattaggtagcaatattgcttctaagatgaagctgtgcaaacctagtgggagagaatcattgagggtgtgtgtgtgtttgtgtgtgagagagagagagagagtgaatgtgtgtgtgtgtgtgtgtgtgtgtgtgtgtgtgtgtttaatctcactaatttacagagcatatttttaagcattattagcagccttggggcaagttttcttttaacagcatgcataatcgtctgacaattgcccacaaggtggcaccaaactcgtgccctgaggacaaccaaggaaactttttaatagtaaaacagatgctccaaatactcaacagacatcttcctttatagcttatcctcaacaatgagccagatttatagttataagtatctccttctctctatatggtgcaaaaattaaaacctattgctgcctacaagaaaacagtaaaaggagaaagacctcctcccaagatagacctgtgctacttctgagcagttttcaaaagaaaaaaaaagtatctaagtcctaaaaataaatgttccacttctttgggggggaaaaaatcctgaaactaatttagctcactgaatggtacccagaagttgatccttcttcctctgttttaaattttatcttattgagcttagatgagtcggtgtaaatctttaaagaactgactgttatttaaaaattaaaacagatttgcaattaatacttaatgtgacaggtcatggttattttaaagggatgagatctattattggagactgtctccttcctgccccctccaccttcctccatcttacaaaggctattctaaggtgaactggttggggctggagtagagctctggaaacctataataaaagtcattctgggaacagacacaatgtatcactgttggcttaggagatattctgccaattaaaaacagggcactgggacctgagcccctgggagccaagccttccattttgaagaagcagaagttatgcagagcaatagagaatcctcaaagggtccagcttcctgttagcatgagagacagaactacctgttgggatgaaaggtttatttgtccccatttgcaacacccaccacagataagaatgaccctctgtgaatggcttgagtcatgagcttgccaatcttttaggggcaaaaaaaaaaaactaaaagaaaagaaccagatatatcagtccattctgagacccccaagctctctatcaccagatatcatcccactgtgcccagaagccccagtaatcctgttagcaattcctgagtcattcattcagcctccagaacattgctttcccaaggaaagacccctcattgcaactacttggcttctaattattggtgatccctgaaaacacagggtaaaccttttatttctgtttcctaagcagggcatcacctacctctggaccacatgcaggattcgagatctcagggaagggcatcctgggaggcttatgaaggtattttctgtagcccatgctgcccaccaagccagacactcctgcaggctggctggagaggcagggtgccaaagggaagcaagcatgtggtcctattaccaatgatcttagaacctgctcatttatcactctgcattctgcaaacctgcagtggcaaccctcccaccctgcctctcccttcatgtgaggaacatagaatccagcttttcaggcaactctctttccagcagtctgaggctgggagtaacccagcagaaattttagctcaaatgtcccagaccattttataaatgctgcacaagccccttcttactctggtttcaaaccaagaatactacttattgccatcacagaactcagaataaattcatacaatgaaatactgtgatcacaaaaacacgtaacacttcattcactaagttatgccagtaaattcactaagtaatttcagtgttagattccataataacaaatatccctagtgatacagcttttgatttaaataggtaggaaattaccattcatcagacatttgccatatgccagctattcggctaagcacttcaatttccatttgaaaattgaccataaccacagacttctgaagaacccatgtcaaatccttgagtgtgctcctatatagcattcaacacacatttttatcaccagagtgtaccaggatggacacagaaatgaaacagtctagccctgctctcagaggactaacacttcagtagggaaggagaactgtcacatgattctgccaggtgtgtgtcaggcactgccgaggagagagtgattactcattcatatattctagacctcaccctttttggaacaatttttaattgaagaaagaggaatacaatggaatataaaaccgaatagagtggagtagagagaagtcattaagaatctgagaaatgatggtctgtgggatgagaaaatgatccctcctacaaggcttgtcttttagctcatggaagataaatgagttctccaggaaaggggcatttattctgatgaagttcaagcccctcagcctgtctctgcctgatcttctctctcaccccattcaagccagggctaatcacatcccttccttttgatcttcatcacatctaaagacttgacagacccataccaacctttcccaccatcaggttgaatattccttctctctcaaccaggttcatttggatttgtccttaaagaaccacctcctttgggcagccttttaggatctctctctctttctctctctctctctctctctctctcacacacacacacacacaaacacacacaggcaatacacacatacacaaacacacacacacacaccaggctgtgtaagaagctccacacccaacatttccccattagaatgaaactccacaagtcctgcttaccattgtgtccccaatgcctacaccaaaataagcacttaatcgataattatcaaattttaggctaggcacaatgggttatgcctgtaatctctatgctttcggaggcaaaagtaggaggattgcttcaaaattaaaaaaaaaaaattagccaggtgtggtgccatagatctgtaattccagctactcagaaggctgaagcaggaggatctcttgagcccaagagtttaaggctgcagtgagctatgatcaccttactgcattccagcctcggcaaaaagtgagacttcatctctaaaataaataattatccaattatcaaattttaatttttagttaatatgacttgctcccctaaaagactgtaagctcatagaggaccaaacgtgtctggcttctagtaagtgcaccagaatgttcactgaacaaacagcaaaggacaggacacaaagcagacttgtctaaattaaattaccattccttattgtaaagttcagttttttaaatcataaatttcctttcttcacaaagtcttgcccttgttaccttcacaaattctgttgttttcagaagccacaatataacgctagactaaagaattcaataacaacaaagaaaggattacttatttgaataatcctttctgttgaaatttaacattcttttcccccagagaatatactgcacgacccctggctcctcacccacctatgcctatgttactaggatttatcagagtaaacaggcagagagaggcagacggatgtttcaaatgccatattaaacaaaatatctttttacatttgtaaaataaataggatttcatttgctcacatctcctggaaaaagtggcaagaaggaaagcaaagaaaacaaacgtgagaaaagggccaaggcaggcctggcagaatgtataataacctaggttaagctggctacttgagccctttagccctggagcacaaccagccctccattgccctggcaaacaccttccctcctcctcctcctcattctccaccgtccccaattagcacactgagagaacctaacagcgacatgtcttcagatggtctgttgagcacaaagctcacaattactgtaacgaagtgccctcaggtctgtctttaatcagtgtctgcaccattgctcagggtgaagagccaggagccaggagttcctcacccgccacaccaaaaccccgaggagtgacaaggaaaaaacatcatcctctaagaaagggtggacctgacacccatatactatgcatttaccaggtaaatttatttatttctttgatagcttcttttccgttagcaagccacccccaacattccatcaaccccaatcaaataaggaatcagaattggagcatttccactaatggaacatcagttgatggcctcatgctctggtaatggtggatcattcaccgaacaatgactgagtgcctactatatgccacagatcacaatagtttatcttctattcaccattaggtgtctcaggacaaggctatgttttccaattctaagcacagcatctgctacaggaaaaaacgggagatatacaacacatcctcgttggatgtgtcaatgaaaaccaatgtaccagttcctaatctacatgttcttcctcagcaagaccacttacagcaccaagcttggggaatacccaaggctggctaacttataaagaaaagaggtatttatggcactgaaatcagaactaaagaaaaactaatatttacactagaaaagaagtccccaagtctcttctggtaaatgaatgggcatggctatattccaataaaactttatttacagaaataggcagcaggcccatagctgacccagaccagacactgtaaggatctggtttaccctccctgaaaacaacaaagtctgaatataggcttgcctttaatgtgttttgttcaatcattcgttcaacagcttttattgaccatctactctccgccaggccctggagacacaacactaaaaaagacaggcatagccctactctgatggggcttacagtctggttgaaagggcaagcattgggccaaacactacccagagaagttgcaggggatatgaaagtaaaactcaggtgcttatagttcactctgtctgttcctgggacaactgaggaaaatggttagtttatgaagaccaccatttgtatggtgaaagagaaaacgtcactggggggactgcagaggtgaggctagattgcctacttcaaaaataatgaaacatttatacaaagaggaagactacagagctggggagtgaaagacaacaatgataccagtaaagaaaagtgcgcagaaactagtggcagggctcagctgtaaggttctgtagtgatcacatatgagggtggtagaaagggcatcagagcagtattgaggtttccgctgtcttggataacctaatccccacatgcatgcccacacttaggaatattgtgggatggttgagcaaacacatgcatgcaatctgtaagcatatgtcatggagtgtgcagggtttatcaggcatgaggccctgagaagactgtgttacttcataccccacctgttggctgtgccagaccaaggggagaagaaagtaatctagcacaactttcaaagtctcactgtatttacatttcagagatctaccccttaactaacctggggaagccaaaaccacccaaagggacatcatcccaggagatgaatccctgggtcataggatatgaatatttttgaggcttttgatacacttcatccattccattttggcttcttatgttacaggaatctctatggaaaggaattcagtgtaacactttgaataaaaaggacacgctatatatatattaaaagagctgccctttatgaatttgctaacacatttttagagactaaaatgactaaaatatggtctccatggctgtgtcacatttttttaaatttctacttgccaactggaacattttaaaaactgatgttggccaacttaatgtgattattaaaataatatttatcatatcacaccatatataaaaatcaactcaaaatggattaaaaacttaaacataagaccttgtattagtccatttttatgttgctatgaaggaatacccaaggctgggtaatttacaaagaaaaaaagtttatgtggctctgaaatcagaactaaaaagaaactaaaatttacactagagaaggggtctgcaaatcttttctggtgaatgaataggcatggatgtattctaataaaactttatttacataaatatgcatcaagccaaacctgaccaatgggctatacagtttgtcaactcttgcagcaaaggcaaaaatcagttcataacaatactgtcttagtctatttgctgttgttataacagaacaccacagaatgggtaatttataaagagaagaaatttatttctcaccgttctggagactgggacgtccaatatgtagaggccagtatctagaaagggcattcttgctgcatcctccaatggagaaagggcaaggagagagcaggggagagcacgagatggagttcacagccacaaacccttttataatcggcattaatccattcataagggaggagcctgcatgacctaaacatcttccattaggccctacctctcaacactgttgcactggggattaagtttccaaaacatgaattttggaggggcacattcaaaccacagcaaatactaacttgcagtgtattacaaagaaatcagcaatttaatcccaaactgggaattggtgttagacaagatgaaaacctggagaccacaagaaccaaactctgctaaattatgtttgcaaaactggaaccacgtatgtttgtgtagtgcttgtaaagccctccacagttgagactcaaaataccatggtagtcgaaacaacactgagctggtaattaagctactgtctcccagctccaaacccactttttcatgccatctttgtgatgctagggctggtgctctgtgaaccacatctctgctttgtcagctgcttcctgttaggttctgcctatagggggcgctggaggaaagctgggaggctggaggaggaaggcttggcccgttcctccctgtctgattcctattggcttcctgcccctgtgagcgtgacccagccacgcttcctcactctagcaaccccacttcctttctgtggcagctgctgaatccagtttgcagttctttctggaaccagcctcattgtgttgccttaaagacccccaatcccagcctgcctcttaccagacttcagagattccaacaccacctggacagtaccaactctcagaggtctgggtaccaggccctcaactaccctcctcttgagctcagaggccctagcactagctatcaccttggagatataagttcagccccacttggcccttcctacaagcttctaaattttaataatcctaaccccaggaatggcaaatgcctcctgcagttgctactttccatgattccttagtgttgtcttactgccttctcagttctctaatatctggttaataattttaaatattaaatgctctctgttgaagtaattggtgtagcttctgtctctaactcagccctgactgatacatagtccagcaatttcaaaaataagccaaatccgtgtttgtatttcttgaacactatggagtggacacataattctcaattttgcttaaaatcccatctgttgttctcaaatactacagctgttcccaggccagacacctaaaaagctccatccccctaaattccttctacccttagcttctccttcccttctgtcttgcttccctcttcctttccttctaattctccatcacaaaagcccaagaaccaatctgccaaaaaggctgtgcatcaggagagctttgggtccttttttcaggccagagattatggactgaaatgtccaccaggaaaaaaactctgggccaggcacaagaattctggaattccaacaccatcatatcttgattgcatactgcaactacattcagcctcaaagtcagagagaaatgttgggtggtggggccagtggggactacagagtgtgcgtgctgtctagatgctagatcttcaatttttcaagggaggcaaatatatatatttttatttataaatatatataaattaattttatatatactacaatatttaatatttaataattatgtatttataaattaaatatatacaactttatgtcaagatttctatgtgaaatctgcaggttcttaaacattggttatattttattgaacactctgtgcaggttaaatgaaacttgcctcatcctgcctgcatgccctctttgctaccactctctataccagccccaaatggacccaatatagtccattttcttgacaaagatttgacgattgaaactatttattagtagccacctacagagctccaataaataatagcaaacccaaggtaaacaggattctttaccctaccacttttctaagataccaccaaaatgaaagaaaggaaggaaggaaggaaggaaggaaggaaggaaggaaagaaggaaggaaggaaggaaggaaggaaggaaggaaggaaggaaggaaggaaagaaagaaagaaggaaagaaagaaggaaagaaagaaagaaagaatttagtaacagaagatgctacctgatttaaaccctcaaaaaatctgtgattcaacttaaaaaaattaacagaagaaaatagctctctaaagcaaagcttttagagtttattttagaagaaggtggtagtgctacattattttttaagtaatatttacagaacagtttgttctggagttctaaatgacacaaatagagcaggcctggtgtacacacaccaaaatggtgacaacgaaattagggcttgatccggtgataaattaccctctgctcatctcacgaacacctaaggctccaaaatggagaaggcatcatttgaataagtgaaccattggctacaaataagggcacacacccacttacccccaccaaccctccacatacaattacccaatctctaagagaaagacacgctggctctataattaccagatgtgaactaagaaactatgcccttttaaaagcttagctatatttcccaatcacactttactcagcctcagagcaaactccaaagcagtatgatgcctgctcctgaaaagtctaaagggaacaatagacagcagggcctacttgagggttgagggtgggaggaggatgaggatcgaaaaactacctatcaggggccaggcgcgtggctcacgcctgtaatcccagcattttgggaggccgagacaggcagatcacaaggtcagcagttcgagaccaacctggccaacatggtgaaaccccatctctactaaaaatacaaaaacacaaaaattagccaggcttggtggcaggcacctgtaatcccagctactcaggaagctgaggcaggagaatcgcttgaacccaggaggtggaggttgcagtgagcagagaccacgccattgcactccagcctgggcgagacagcaagactccgtctcaaaaaaaaaaaaagaaaaaaagaaaaactacctatcaggtactatgcttattacctggatgatgaaataatatgtacacccctgtgacatgcaatatgcctatagaacaaacaggcacatatacccctgaaactaaaataaaacttaaaaagaagaaatgtctagcccagaacaacgtccaaatctacctgctgggggacaaagcaatatcactgatgctagaatttgggggacaggaggtggatataatttcatattccttatcccaacatgtcactgtgtgttattagtgcagaaggaaaaaaataaaatttttcacagccaactgttttgtttagcttcaacaggggcttattgtcaactacaatagaagctggcctatctaaaatctgcaacctcactttccaagagccaaaaaggaatttgtaaatggcctctgcagagttcacacggttggcatatgagccttattcatatagtaggccatgcctaaagactccatggagacctattgtatcttcagtctgttgactcttacttgacacaaaattctaaccaacctggttgattttaaagtttacagctcaaactcaggaaattccagtatgaagacaaatcaaaggcacttggaaaagaagaggatatatatatatatatacagtgaaatgctcatggtagagacaccaaatgctgaagagagagatgcattaaagaaatgaagaagagtccatgagcccattgctcaaagaaggccttcaagggacagtgcaacttgtcaaaagccagaacagactggagccaagtaaaaaaggagagcatggaaacaggcagtacactaggatcaatagaaaaggaaccaactggaacaatccagagtggcaaaaaggccatgattctcatgctgttggagtggcagctgatgtttatcatggacttacacattcagtcttggtgcaaagtgctttatctgctttctcttattcaatactctcagcaaccctatgaagcaggctttatgtaaattttacaggtgagactacaaaagcttagagagttcaagcccaaggtcaccttgctaggaagagggatagccagaattgaacttcaggtccgcctagttccaaagcctgccctggggtggaggagagggagaggcagacagaggaaagaaaaaggatgatactattaatggtatttaataatattttgttacagcagcctaggtaaactaacaaccccatttaacagatgaagaaacagagcaattctttaaaacattcattctaaaaaagaagaaaaaaaactttcccagtggaagataaaactaggggtatttgacaggcaaaatgactccccttgtaacagaacactgcgaaggaaaattaagcagaactactagatgacataaaataactgaccatttgtacgcatcctttttctttcttttcatatttgaaataacataacttgcagtaagatcagcaaagggaaaatctctgtaacaaaatttcatttatagaccatacccatgaaaagtttaagcttgacactgatacagggcagggcatcatcacctgaaagaaagggaaagagagacagaaagaaaaaaagaaaaagaaagaaagaaaactaacaacccagaaaactaagcagctcattacatgttctcttccaaattctgtagaaccacacttgaagtgacagatgtgaagaggaaggaggttcacactcagaaaggcaggagaactattttggggaggtttgttggaggaggtggcagagtgcctagagaactagtgcacagatgtagctctggcatgtgtatccatccattcattcattcatgcatacatgcatgcatgcagccaacatttactgagaccctactatgactcatcaacagaagatggagatactgtagggaaccagacatagtctctgcccttaagaaactcacaatctgctgggcaattacagacacgtaataagtcaatgaatagtcctcataatggggactttaggaactaagcatgagatacagggagtagaggaaggcttcttggatgtgacatgtgagtcttgaagtggagaataaccaaggaaagaagtggaaggaaggctggagagattaccagggacagggttttgcatgccacaatgagatctttacattttatcctgaaaggaatggaaagccattcaagattcattatccggataattacatgtccagattaacattaaaaaataaaaatctagagacaatgtagataacagcgtggaaagatatttagactggaggcaggtcaagagactactgtattatctaggctagaaatattaaaacctaaactaaggtggggatgggggaaagtgaaaaagaggaaaccaagttaagagacacttaggagacagcatcagtaggcatttggcactgatttgtacaggggttacaaagaagacaaaagaagaatggcctcaaagtgtgtgatttgattgtggtacagctaggatgctggagacattccctaagaacagaggacacaggacaagattgcggggaggtggcaagctcagacttgaacatgttgaatttaaagtgtctttgtctggaggtcctagtcattggtgtctctgtgttgcacccactgtattagttatatattgctacataaggatattaccacaaatctagcagttaaaacaacacacaaatatttatttcagtttctgtggatcaggagtctaaatatgacttagccagttcctctgcaagggtgtaatcaaggtgtcaggcagggttgggttttcgtctgaagttcaactggggaaggctccatttcctaggtcacatggttgttggcaccattcagtactttgcagactgccagactgagggccctagtttcttgcttgcttttgattggagattaccctaccctctttgccacatagccctctccataggcagctaacaatgtggcagctttcttcttcaaatctggcaaaaaaaagaaactccttccaagccagacattacaatcttacgtaacatgatcatgtgcatactatcacatttgccatattctactggttagaagcaagtcacagagcctgcctcagggcagaggatcacaaaaaggcatgagtctaggaggcaagggtcatggggtctgttagagtctgttagaagggtccttagagcctgtttcaccacatccattttcatttagtctccaaaagttagaaacccttagacctgctttcttacctcctatggtcccatggcctaagcaactagatactgaattgtatgcaaatatagatctacaacccatccatccctctcagttcaatctctttcatgaagctgtcccaaggaggctctcctctctctctctccattctgatctcatagcacttaaaatctaaagtaatggcttcgagaatttgagtgtcagaaaactaaatatcccccaaaaggaaccaacccaaatgtccatcagtgatacactggattaagaaaatgtggcacatatacaccatggaatactatgcagccataaaaaatgatgagttcatgtcctttatagggacatggatgaagctggaaaccatcattctaagcaaactatcgcaaggacaaaaaaccaaacaccacatgttctcactcataggtgggaattgaacaatgagaacacttggacacagggaggggaacatcacacaccagggcctgttgtggggtggggggaggggggagggatagcattaggaggtatacctaatgtaaatgatgagttaatgggtgcagcacgccaacatggcacatgtatacatatgtaacaaaccctcacgttgtgcacatgtaccctagaacttaacgtataataaaatatatatatatatataaagaaataataatagctgtcatgtattaaatgcttactatattttactcactatactggaaaccaaatatgcaatatctcatttaatccttataatgataataaattaagggtacatattattccaattttaccaatgggaaaactgaggcatagagaggctaagacactcacccaaagtcagatagctaataagtggcaggaatcaggcagcctgactccagagcccacactcaaagctagcccaggcacttagatatcaccagttacatttttacgatcttctgaatgagaaaatacaaaatagctaaaagctactttgaatccagtaacagttttaaatacaattttccaacacactagtatctacaaacatttgcaaaaagctgtatgtacatgtgcaagcatttattctctccacagacaatggggattggcgaccattcgcagagcctcacagcccttcctacatggctcttcgctgggcaccagttgccactgccacattcttttggtacctggattgtaatgtacatcagcaattctcaaacaggggcaattttgctcccaggagacatctggcactgtctggatacattttttattgtcatggttagggagggggtgctaatggcatctagtaggtagaggccagggatgccgctagacctcttacaatgcacagggcagtcccccataacaagggattatccagcccaaagtatcaatggtactgatcttgagaaatcctaatatgtatcactgtaaaatgctctacttctctcatacatatttgtcctaactctccaagataaacctctatgccatcagagcaggaactacatgatacccatgtcactccacctttcccagcctatgcctaagttcccaaacacgggaagtgtccaagagatactttttgaattgaaatttatttcaaagaaattctaggctttacttctacaagacctagttattcaatgattaacacattccctccaaattaagaacttctagtttgaatttactgaaggctaatttacttctggagttaacacagccctccccagcagcctccggcacctgtatgtttgaattagcaaataaatctctggtttagaaaaatcagataaatgaaacaatatgcagaattgagacaaatagggagatacagaaacatcatcaaatgccaaggactggaaggtgcctatttcctaatgcaaccactctccccttaaacaaaggcaagggcatgcaaatgaactagggtccaaaaatgatccttttcttttttaatcacaaatcattgtgagtgaagagaacattgttctgaagcacatcagatatatttgctgaatgatgaatgagcccctgttgtttgttagcacaagtgggagttatgtgtatattaagatgagaacacactataattctaagaaggaaaaggagctattatttcacctttttttttcttgttttctttttctttttcttttttctttcttttttttttttaacacattctcactctgtcacccaggctggagtgcagtgacgtgatcacagctcactgcaacctcgacctcccaggcccaagtgatcttcccacctcagcctcctgagtagctgagaccacaggcatgcacatcatgctcggataattttttttgtaaagacaggatcttcccatgttgcccacactggtcttgaatttctgcactcaagcgatcctcctgtctcagcctcccacagtgctgggattacagcgtgcgccacgacacccagcctatttcacttttcaacatacagaaatttaaactcatattccagacgatgagtcagatgactcctccatccaatgaattttgtacaatgtaggcaaatattgcattgtgtatttccacacctctatgactcaatcttagggtaaagtctggttcctctttccctctcagataaacaaaaaacaagtccattgaatcccagaataacttgaaacctttgggacctgcctacactgctgagaaggctctgaaattgttctgtctgctccagcaccgtactttccatggagaggtgatgaatcagactggacaggaccacagggtctctgaaattcctcaggagaatcttgattacacccaattagtgagaccatatacagaagcccggtgaatcagacggcctcacaacccagcaggtcagcagggctagaaaaccaaggccattagctcctgctgtgtcctacctctcaaagaatcaaatccaagctggttgtgaaaaacaatggccattttatacaatcagtcccagattatttttaagggggatgtgagagattcaaagcagtggagaacaccaaagtcactaatagtcacatttagaatccaccagaggttgttttttgaaatgaaaaatctgacttctcaaatacaattttcctaggctgatttaaacatttctcccaagctctctgggccaaatagcatcagaaaacagtaatacaggtatgtacgagggcctggggtaaagtggcctgggctgaagttcatctgagcattggcctggttctataaggttggtaagctcatgtaggtggacggagcccctggctaaggcctggttcaaagtttgagttggcatgtagttggcatctgactataccctgtcgttcattcattcacatccgactcctgagctcagacctcaatacctcccaggagttagccctctcttgattcattccacctacactggtcaagcatctactctcacatgtaaggcctttattctggcctttccttcctttcctggtgcctacatacccagattttacgcattctccacaattctgtggtccaaatccaagtgaacctcctctaagaagctaaccctgaccaactccagctaacacagtctcacaatattctctggataccagacatcagagcagctgtttgttgagctcagatgatactccaggtaccatgcccaacatttcacataactgatctggtttaattttcctatgctgggtaaatatcactacccccactttattgatgagcaaactgagactctaaggaaaagcatcttgcccagatttcacagctaataaataatggagctggaacacaaacccacaactgtctgacagtagagtttaggcatgaaatcaggggtcagccaactcttctgtaaacaagcagatagtaaatattttttgcaggcctcacattctctactgcaacctctcaactctgcctgtcattgtagtgcaaaagcagccatgcttctatatttcaaaatgaaaaatctatgtttctgtatgaaacatcctcctgcatagagtcaaagggctctaagccccttagcagttctcctctcaccccagtgcacacagctctggacttacccacagtaacagcaacctttactgggggcctgttagaagccagactcttcccaaagacctcacaacaatccttacacaaggcagaggccattaatttctattctcacgtgagccaatgagctttgagaagtgaaggaacttcacaagcttgccccagcagtgaggtgtggcctggaacttgatcccaggcagtctgacttaacaaccacaacttccacctctacagcctgcataggcccaggctgactacagctggagctggcacctcttcagcttgagctcccagcacagggtcctggtctcctggatgctctgctgcccatgtgtgtccacaggagaaagttacagggttgctgcagcctctggcttctgacgtgggtctcacagactggcagtcagacctacagagtgtaccgctaatggctttaaacaagcagaaatcatattcagctaactaaagatcaagggccattgcaaaacgcctgatttcatattccattgttaaactttaatgagccattacatccactggaatgaatgatctagtatgtcatatcccataacataatttttaaaagtctaaataaatactgcaagcctcaaggaaatcacttcacagagcctcttccatttatggcccccactccaggtgtgcctgaatctattctgaggcaccaacctgccacatcaaacgacatcatccttataatgtttccttttccaccagactccttctgccctaattgtgcaaataatggataaagacaagccccataccggctaagcagagaaagggggaatgggtcctgataacaaagtaatcaatccttgctctccctgtgggttgatatgttttccagtggcgcatacatgagtttcagagtcagaaaatgagtttattgttggaatgaacttgaaccttagtaatcctcaggttcctcatctagaacatgagaacagaaatgactatggcataggtttctgattacaccgaacaatatttctaaagtgactgacccaagcactagtccccatcctcctctctttcctcttatatattttatttttaaaccacatgaaatggaataattatcatagtgtctgttgttttactttccatacatattcttttaaacttccaaatagttcctagcatgaagtagaagaggcactatgacataattatgttggaaatgcctacagaggtggtcttctgagttttttttaggtctgcaattaagtgtatgaaatagttaataggtcaaaagcctacttcaatctagcttacatagtcagtgtggtacgtaatgcaactatcacctaactgaccacacatagcttggtttctaaaaggcaataacatccaaaaatgtgcaacagatacacactcaggctggtggcttaggccagggggcctaaagccagattcctcagttcaaatctcaactctgccacttagtaactgtggatgtgggcaaatctgtagtctctccaagccttggtatcctcatctgcaatatgggataatggtgcttgcctcatgagcttgttgtgaggatgaagtgagataatccatgtaagacgtttaatatactacttgactccttgtaaggattcaatacctgtaggttattattcttagtgtcactattaatgctgacttgtcatcactgaggtgatcctaaagaatatgcaattctggaagaagagctgaaagagaatgaaaagcaataaaattgcagagcaataaaatcactgggtagggtagatggcctaaggtgacacttaaggggctaactcagttgacagaaatgtattttaacatgtgtgtacgtgtgcatgaatttgcaaaagtgtacacatgtgcaaaatctggcatatctgctaaaagccccatcacaatatcatcatgcctcatgtatctaaccagagtggggagtctatcacagaacaactgtcaagttaaaactggatcatcactgtccaaatgaaggcaacttctcaatttcctttttcctttctctacttcttgtcaccctcccacaaatgaatatgattacccatgccaagaatatacagcttagaaataagatcaggaagaaaagcaaaaatgaaaaagaaaggcctaggagaacaggaaagcagagaaagtgattaaaaagcagaaccacttgactgacaatcattcatacaataaacaaactctgtcagctgctctacaacaaatattctattaactgctcaatgttgttgtctctaattcttagaaccagtgtacaaaatagacattattattcccattagacagaacaggaaaccaagacaaagtgacttgcccaaggccacatggccagtgtcttagtccatttgtgttgctataaagtaatacctgagactgggtgatttataaagaaaagaggtttattcgactcatggttctgtactctgtaaaagaagcatggtgccagcatctgcatctgatgagagcctctagaagattccacccatgggggaaggcaacggggagctgcatatgcagatcacgtggcaagaaaggaagcaagagagagaggatggaggtgccaggcttttttaaacaaccagctctcatgaaaactaacagagtgagaacttactcattactgtgaggacagcaccaagctattcatgacagatttgcctccacaatctaaacacctccccttaggccccaccttcaaataaatttcaacatgaaatttggatgggtcaaatatccaaaccatagcagccaattaatggtaagttaggacttgaatcctaccctcaatagtaacaaaaatctttttttttttttttttttttgagacggagtctcgttctgtcacccaggctggagtgcagtgaggtgatcttggctcactgcaagctccgcctcctgggtttacgccattcttgagtagctgggactacaggcacccaccaccacacctggctaactttttgcatttttagtagagatggggtttcaccgtcttgatctcctgaccttgtgatccgcctgcctcagcctcccaaagtgctgggattacaagcatgagccaccatgcccggccaacaaaagtcttcttaatagtcccttctacttctctagactctggcaggtgtggggccctgtatatagaaaccgaggttggctcttgccctcaaggagcatattgtctaatgggaaggaaagacaaaagcaagtaatgatgatacaatgtgaaaacatgctctccaaggctaaaacaatgtgttttgggagctccaaggaggaaaggtctcaacccagcagcagagaaagcttcacagaagcagcaatataagagttgtgtactgaaggatgagtaagtttaccaaccagaaggccagccacagtggctcacgcctgtaatcccaacatcttgggaggccaaggcaggcagatcatttgaggtcaggagttcaagaccagcttggccaacatggtgaaaccccatatgtactaaaaatacaaaaattagccaagcatggtggcataggcatgtaatcccagctactcaggaggctgagataggagaatcacttgaaaccaggaggcagaggttgcagtgagctgagattgcaccactacactccaacctgggtgacagagtgagactccatctcaaaaataaataaacaagtaaataaaaataaaaagagttcatcagccagaaaagagggaaatgggcatccactattggggtagtcatgcaaacagaagcacagaggtaggaaagatcctcgcatgttgaaggtggtaaggtgggagatacgtaactgaactgtgagagaactagaaccgggctgaagagaaagaccaggggctgattgtgaaaatttttgtctgacgtgctatggagagtggggaagcttctgtagacaaatttcaggcaaaaagaggtgggtgaggcagctgctgcaccaggacggattaaagaagatgaggaataaaaacaatgggatgagctgaaggcacactcatggggtggggacatcctgggagacaaggacgtccaagtctgacatgaaacatgaagaaaagatgatgtctgttcaagagttccaatgaggcaaaacagcctactagagaaagcaattaaggatcctcaatatttaggattctgaagtgaaaacagaggaatccaaaaacatacataaagtaagaaaaagcgagagaaaatttcaaaagtgaaaatgatggagattagcacaagacctccagcagagatcaacagaacccaaaatataaatggtcaagactcaatattctatgttttaaggggagctgcactaagaggggtaagaaattgaaagcaaccaaaaaataaaaacaaacacactaagtctgttttagagataaggccattggaccatggaatacacccaaggacatcagaagggccatcaggcaccatcagtaagagcagatgatggcagccaagccaacttgagtagtagagatggttcatattactgcagggacaggggttaggcccacaaggtggttttctgcattttcccctgggagatgcatcgtaaatcatacacaggcatgggtgccagggtacaacccaggaaacactgagacctgcagtaacagcacaacttccttgtaatcttcactattgctcccatgatgctggctccaagtcatgactcatacttaggaatcaaatgttctcccagaaacactgttttaattacacatgccacttaaacagaaaggaaggccataccttcccattgatggaggcagaggcttaaagctcagccaatcctctgtctgaaggattcaggaaatttcccggtaagacaaggtagagaatgaacactatatctcctgctaaatgaaaggaaggacattggttgaccaaagccagagagacggaggaagggagggaggaagggaaagaaggctgatccacagatcaagctactaggaaatcaaggaggaattttaagtgttagagcttcaaggttcctcagagatcattttatccaacttcctgttttatagataaggaaaacgggccaaaataaggaaaacacctttagattcacataacacattggtaggagagagagggaagtggtggaacaagggtacatcacaccttcccattccaagatgctgcttttgccagggtctactatccaagtcctcagataaaccagccccttctttcaccagtggattcaaacccatgttggggaaggaaagagataaggagaagtaaatgggagataaagcagccacactctagttctggaatactccgaattattgattttggtggtggatggatggcccctttcagctgcactctcagcgcctgctcctgttttatgggtgtttccagtgtgcctcaaattatcttgcctcttatgaaaatacaggaacaattacatacaagcctattcagaagggacaattagctatttacatcagcaaagaaatgacagtgggctcttcctgacagatgccatcctcacactgtgttagagcagagagggaccttgttctggaaactgtccaatagctggaaggagacacctcctctgttattgtagtgtctttcttgcatttctgagcctgagctttctagacttctcaaaatgctatccagcaattggcagacccatcaattgaggatattggctcctcatcacctggtctcctttgggaggggtacacaggatagttgcaattggtttttaggacagccacatgcagaaacaaatggtagtcagactatgcagcagtataatgagcatcatttcctcatgatacttttatgatatagaaggaaataaagaagtgaatctgtggatggtaataaagtaaagaatagagaaacaatggatcaagatggaaaggaatgcaatgagaaatagattaaatgcataatcaaagcttaggaataaactcctgatgaatcaaaatgaccataatttaaaaacaaaaatagatctgctgaatttcaatttgaacaagccattcaccacataaaaaataaacatacagtatttcaatcttagaatttaagccctattttcaaatcaattaatcaaatactcatgcctgccaactctggcactagacatggtaggacataggagggaaagataaaataaaccagtatccttatccaaagtagctcgaaatccaatttgtacaaacaaggtgtacatgactgaattagtgaaaaggagaatttatacagtgagaagcagaagcaaatagggcagtgacacagcaacaccacatgtttcttctagtgaccagagtaactacctgagtgtcaattttctttgtattgaaaaaagggtgaatacagagtgacttgtgcttcactttaaatagaaaagtatttaatctatcaatgtaactttaaaagtcaaattgggcaaaactacaaattagtcttccatgctttagtctatatacctgtgctagagtgctctttccaaaacaaaaatctcatctcatactcttgttgaaagaaggaaagagggaagaagggagggagggagaaagggagggagggagggagagagggagggaggaagggaaaaagaaagggaaagggaaagggaaagggggaggggaagggaaggaagggaaggagggtaggaagggaaggaaagcaagggaatggagaataaaaaactttaatattccctcattgcttacaaaacaaaatccaaattctttagcatggtttataaaactcagtccagctccgtggcctagcctctgcctaaccaagttcattctcataatatgctgctaaatttaaaagtagactacagagcaacatgtacattcacactaagtgaataagcctgtcagagaaggggcaaatagtatatgcttccacttgtatgaaatacctggaacaggaaattcatagactcaaaaaagtaaattgaaagttactaggggctgggggattgggaaatggagagctattgctaagtggttagagagctcccgtatgcggtgataacaaagcttgaaaaatagtgtcgagctgtcaatagctgtacaacactgtgaatgtaattaataccattagattgcacacttaaaatggttaaaaattttatgtcaaatgttatgttacacatatataaacacaattttaaaaaattaataatgtaacataccaaaaaccattgaattgttcactttaaatgggtgaactgtattaactctatttaaataagctgttacaaatgtacaatatgtacatacaatactaatgtaggagaaaggcagaggaagattctcctaactgctaacagagattacctctggatggcaagatgcaggggatcctgttttctgagctttcctacatttcccaaatttttattagaactttgctttgtgctacttttgtatccataagagaagaataattgccatttttaaaatgttaaaactttaagcaagataaaaataagatataagccttaatcttctcccgttggggctcataacacatggtggtggaatgccagaagggaccctgggcactcagtactgcctgcattcttcttcgctgggtgagcctctggccacatgaatgtctgtgcttatgatgctggtggcccaaagagcttaatgatgcaaccagggactctgcaggaagactgctggagttccaccactcaccaagtacctctcatagcctatgtttcctcatcggaacaatgggataataatgttatttacttcataaggttatcaaaaaagtaaatgagataatttacatgaagtgtttaaaacaatgtctgatacccagtattctgacctaagtgtttcatcaatgattggcggctattatttttactgctgctgttgctctattacactgatgtgagtacagtcatgtgctgcataatgacattttaatcagtgactgtatataagacaatggtctcatcagattatagactgtatttttcctatatcttatctatattttgatatgttcagacacttaaatactaatcactacgttacaattgcctacagtattcagtacagtaacctgctatacaggtttgtagcctaggagcaataggttatctcatatagcctaggtgtgtagaaggctctaccaactaggtttgtgtaagtacactcgacaacgtttgcacaatgacaaaatcagctaacaacacgtttctcagaatatatccagtcattaagtgatgcatggctgcatttgttatctatcctctaccagagcagggattggcaaaccatggccaaagggccaaatccaacccatcacctgttttgtatggtccacaagctaagaatgtttttaaatttttaaatgcttggaaaaaacacaatagtatgttatttcatgacacacagaaattatataaaattcaaattccagtgttaataataaagtttaattggaacacagacactcctatttatttatgtattacctatgtctgctttcatgcacttgggacaaagcctgtctagcctgcaaagcctaaaatgttcattatccgccccttgacagaacttacttgctggggaataaattctgaaagtaaagaccagctcttgttcatttagagttaattcatggttagattagattggagttcatatttactgagagactaaatatacaaatggacatggccagaccatgtataacagaactctgacctacaacctctgcagcaaccagcctgggaagccaggccacaacctctgcagcaatctgcccagaatgatcagggtttagtcagtgactgccagcttccttactttttgtcccttcctccaaccaaatattctccccaaaccaatcatgtaagatactctgcttctagttagcccgcctccagcttcctcatgccagcaacctctgatcacagcacatgtatccgaaaccttctctttttcactgtaagaagtccaaaaagctttcccattccactgcctgcctttgagtctctgccaaacactaaggatggcagcagcctctcttgcaatagcaaactctgaataaatagcatctgtttggtctcctttgggtggtctttgtttatttccagttaacccggacaccccccaaagatacaatctacactgcctatcaccatggactctagtcttaaccaggagtggcacccatgaggccccttgtgccttgctgtttgcaggctctcacaggctgtcaggtctgtgacaacgtggtaagttagcactgtgtctgattccattctctgggcattgagttctttggctgtttattttcctcttggtaataccaggttttgttattggctcccatttgtttggaggaatcaagccattccttttcatccatgtttgctcccttttgtccttctattttgcattgtgctgtctccgtgttgtttgccatgaagacaatcacagggtagaacacaggcacaggccctataagcctgttgtctaagccggctttacagactgataattctgtggttctcaccagatcagcatccacttggacaaacgtttctgtgactcaccaataaaactggataggattctccttccatctctattttctgtcctgagagcttggctctaatccagagagaacattctctggttttcttgttgggagggcgcagattgccaggtcagcatttgaaggcatccacttgtgaggtgggggctctgagacactaagcaaacaagcatcactttcaccaactgctgggacctctcatgggattatatgtaagtctaattcttctccagaaaaaaactcttgcttcttatatgtactgtcactacaatcctaattattgtgcctatcatacctcatttcatcaatgtcatcttcagtggatactctaagcaacatgagccttaaacaaaactgcttatttgaaaggggcttaggggaaaaagggaataagattgctcaggcccaatgggcagcatttttttttttttattagcatgcagaagcctccaaacagcattctgattcaaaatggttcacaaaagattatttgaacaatcttaaataacacaaactagattcatttccctagtaaattctcccccgccttgtcttttagttgcctctctatacccagtgccctcttcccccttatcctgatctatctccttctgcacctctctcaactcttctctttgtcaaaactcccttccttttcccaacaactctcctaaggccccaagatgccacttgcatttaaagatccatcccacccatgggccaggcattcagaccactgtggaatttaaaccttggtcttgagctgaatgaagagctagcaactatttatagaagaatcctagacaagaccagccactatttatagaagaatctataattcttttgagtgcatttgactcagggttaccaaactttatcaagctgcaaacattgattggaatctaaatcctgaatagcaaaagctaattggactatcccagaaaaagatctatggaatttctcttttcacaattaaaaaaaatcaagagctgagatgggaggactgtttgagcccaggagttaaaaacaaaaacaaaaacaaaaaaagaggttgaggtaggagtattgcttgagcccaggagagactccatctctctttaaaaaaaaaaaaaaaaaaaaagtgtaaaaggtaggacaaatttttctaaaagtcatacccaaaacatttccaataaaagtagacttgaccaaaaactatctactgggtactatgctcagtacctgggtgacgggatcaatcatactccaaacctgtgtatcactcaatatacccatgtaacaaacctgcacatgtaccccttgaatctacaataaaagttgaaattattcttttttttttaaaaaaaaaaaaaaagcaaatgtagaccagctaagatcggtcatacatcatgggatattaattatcaatttctattgggtaaaagttcaggaatattcactcagactatttgccacctcttttcatggtttttcagagatcattggtagctcttaattgggaaaacatttagccccatttattggaaggatataaaataaagccaccccagatgttttttaaaatagacttgaccataatacagtcataccaacagacaaaagattaaactgtaggagatttcaggctagacgagaagataaccttcaacaacatgcaagagttaaaggtgctgatctaacagcagctctttcatcttggccaaaagtactaccattagtccttatggccatgcaatccactccctcaaggacacattggctatcctcctatgaatgggtaattggaaggcccatgtgttcagggatttcatctcgaattctagtagttctgtcctgctgcacacagatgtggcaaaatattacaacggaatcatgtactatgcccagcttgtcaaaaacaggttaaggcccccttcccacaacatcgtcctaaatagcatctttataatcttcttgtctattgagaaaaaaaaaatcagaaaaaaaaaacctgtttttgaatcttgttggaagagaccttatccggtactgttagcaataaatatagcagtgaaattctaaggagtcaattcctgggttcacaactacagaagcaatgcagaattccacagaactggaaggctactccataataggacctcaagggaggattctcagagatcctctagaagtcgccagctttcagaagcacacagctgatgacctcacataggggacagcttctacccaaggcagcgggccaagaaccctgtctaattctggttttgtttttcatccacctccacgtgatcattcttctcatcttctgtagagtcctagttgttgtccactcataatggaactttttctctgttctttcctcttctttataatttttggttcagaaaatactcattcttagattatcccaaacagtacccactcctttgatcttactgatttctgaacacactgtctatcactggatccccatgataaaatcctccaggcaattccagtctcatgcaataagaccataggaaaatacagtcaatggcatctccatttacacctataggaacaaatgaccttaaacaaatcaacctatgactttgctactctccctctctgccacaaaaaaggactaattattacaatctattattcagactctagtcccacatttgaattcaacacatttcctacagtgatagtacagatacttgctacctagaggagactcttagagattcgaagatgtaacccagctaaccagatgctccggttgtaactttgtgtcataaataaataaatctttttgtcctgtatctccatgagcacctactggatactactttttttttttttttgagacggagtctcgctcttttgccaggctggagtgcagtggcacaatctcagctcactgcaacctctgcctcccggattcaagcaattctcctgcctcagcctcctgagtatctgggactacaggtgcacgccatcacgcccggctaatttttgtatttttagtagagacggggtttcaccattttggccaggatggtctcgatctcttgacctcatgatccacctgccttggcctcccaaagagctgggattataggcatgagccaccacgcccggcctggatactacttcttttatggccaagaagcctaatcccgcttgcctcagactaatacctcatgcactttaggaatcatattccaagacttgtccaggcacagggactgtaagtctataaattgctaaggctgtatgtcaactccaaaataaggccacccttgattattcaggcactccacctggggaaattaatgactcattctttatgcaaacaatcagagcagtgttcccaatgatggaaatcttagaaacatcaggaagaaacctattgctaactctggcaaaagttattaataatactacctctgccctggatggaatacagatcattcccaattcattggcacagatagtgatggacaattgcattgctccggatttcttgttggctggtcgtggtggcatgtgtgtcattgctaatactgccttttggactgggatcaaggaagtaggaaagacagaacagactaaacactgcctgaaggaaacagttacttggctttctaaggttgatcctcatggcctatgggatttgttctcttggccttggttaaacaatttgtgttcctgatttgtttgtttgtttgtttgttttttgggttttggtgggggtttttttgtttttttttttttttttgagacagagtcttgctttgtcacccaggctgtagtgcagtggcgtgatcttggctcactgcaacctccgcctcccaggttcaagcaattctcctgccttagcctcctgagtagctgggattacaggcatgcaccaccacacccagctaatttttgtatgtttagtagagaaggggtttcaccatgttggcaggctggtctcaaactcctgacgtcaggtgatctgcctgccttggcctcccaaagtgttgggattgcaggcatgaggcactgcgcccagccttgcttccctggttctaaagcagcttacagagactattaattgttctcatttttgccacagtggtcataatgttacttattgtgttctatatggagccttaaatgcttctgcacaaccagtctcttatcaaatgactgccatgattgaaatatagtttactacggagacatctggataatttctgagaagtgaagattcagattctggcttttccagaattggtcagccactcacaagccagagaacgaagaaaagaaaggactgaaagaccaaataggcaaaagaacatagccagactatacaagacaatagaacactgtctcaaaacctctgcagcaaccagcagcaagagccaggatttagtcaatgactgccagtttctctattctgtgcccctacttccaactcagggcctagaaaaggaagccaaatactgcacttttaattagcccatctgcagcttccccaagccagcaacctccaatcaaaaggatatatatacctgaaggctcccctttttggattgtaaagctttctcactctaccacctgcctgtgtcaaacacgacaagtaatgtaagcttcctctcttgttatggcaagctctgaatcaataacctctgttctcatttgggtaatcttcatgtatttccacactacacccaaccacatgcatgcacacacagttaaaaatggcagggccttgtgcaagatactagaaatcccagcagccatataaagagggccacttttcagtgaggcagtacattctcacctctctaccccacctcccaagggctcaggttcagctgctaccacctattaatatcccctcccttggctagcctgtcatcccaccactgtacccaggctttgctcagacctatgtcagggcatagccacaaatgggttaccagtatgactcccatgccatcaccctcagcaagcatctctagccaggctcatcctcatatgctcaccccagactgacatacaaatattaccatcttctgtatacgctattgtttgagaagcctaggaaagcactaaggagcctctgtgccacccagccctgggatctctcatgctgtgttttagcctctgccctgggaaggaatttgtatgagtctatagggcttcaacaaaatgcccaaatgagaggcatatgttgcttgatgggaaagagagttgccccacaagaaaatgagctaaagagtctgtggttagaaggtatttcatgctttcaaattctgagaactgtacaagctgcaatgtgagtccaaacagggagagcccttatattctcacattcccactgatggtaaattatattgattaacattagcaacattaaatcatattgctaaggctaattattataacaatacatcacctaacattaaatgaactctcactatattccaggcacaatttctaaatacttcacatttttttaatcacttaatcctcacaacagcctgagaatgcagacactattaatgaacgctttgtaaagattaggaaactgaagctaagaaaattataacaaggtggccaggtgtggtggctcacacctataattccaacactttgggaggctgaggcaggcagatcgcttgagcccaggagtacaagaccagcttgggcaacatggcaaaaccccatctctacaaaaactacaaaataagccaggtgtggtatcgcgtgcctgttgtcccccgctactcaggaggctgaggtgggaggatcacttgaatccaggaggtggaggttgcagtaagctgagatcacaccactgcacaccagcctgggtgacagagagacactctgccttgaaaaaaaagaaagaaaagaaaagaaaattagagcaaggtcatacagcagaacaggagctagaactgagctctaatctgttagacttcatactctgagctataaccgctaattcacaatgctacttaaaacccatatttgactgaccacctaactaagcaactcaggcaggatggcgtaatatgaataataacaaatacatacaagaaagaagaaatgtatcattattcagcaactaaaaagtaaattctaatttatatcaagtcagctgttaatactgtatcaattctaattagatacttgtgttgtactttgacaaatacagaatgtaaattcttttagtgcttcaatttactgtggcttttgaattaactttgcatcagcaattgtcttccaaattatttgagataaccactaatttcatataagtctattttacacaccaagacagcattttatcagcatttttcagtctcatattaatgagaatttaactaatatatgtaaatcacaatgatcctataaaatcacatgaaagccaggccgatattcaccaaaaaaatctagaaatcacactaccatttgtgtgttatttcagaagaagtaggttcagtaacttgctacttttatacatagtcaatttctataagctaaaaagaaggaggaatttgaaagtcagttgtctattcaatcttaggatgtgttacttcctaaatttgaatacaggatatgaacaacctgggacatcactgtatcacaaaagcatacttaaggctcaacaggggattagttggagagcttcttggctttcccatctcaccatcctcacccctcccaatttcatgctggaaacagacagcagcacattggtgtaaagcaagagtcagcaaatttttctgcaaagggccaaacagtaaatattttagtctttgctagccaagaccgtctctgttgtaactactcaactctgccattgtagcacaaaagcagccagagacaataaaatgaatgagtatgactactgtatgaactttaattattttttatttcctaaatgttatgtattcatgtgtttattttataaattttatttatggacatggacatgcgtatttcatgtaattcttgtgtgctctgaaatgcattcttttgtgggtttttttaaaccccatttaaaaaagtcaaattcattcttgctcgtgggctatacaaaaacaaaaggtgggactaacttggacctttgatcctcgttggctgactgctggtctaaagaggagttgtcccagttttcctttataatatcatcttcaatcaagttcacaccttgcatgcccacccctatgcacagaggccatccagtgtttttgtttgtttgtttgtttgtttttgagactgagtctcgctctgtcgccgaggctggagtgcagaggcgagatctcagctcactgtaacctccaccttccaggttcacgccattctcctgcctcagcctcctgaatagctgggactacaggcgcctgccaccacgcccagctaatttttttgtatttttagtagagacggggtttcagcgtgttagccaggatggtctcgatctcctgacctcgtgatctgcccacctcagcctcccaaagtgctgtaattacaggcaagagccacagcgcctggcccagtgtttgtttttaaacaataaatatagccaacactttttacatatgtattacttattacacttagtacttgtgatgtacttactctatgccaggctatgtgtgaaatgctttgagtataccatttaatttattcctcccctagaccttaaagatgggttccatcattatctccatttacagatgagaaaactgagcctaagagaggttaagtaacttcctgaaggtcatgaaaccagtaagtggtagggctaagaagtttgactccacagcccctgttatcagtacccactattatgtcatcctcaaagcgcttctgtgggacagaaggcaggaaagaagagtaaaaatcaaccaggatgcttgttatttgaagaatagccagcaggagacatcaacagagcaaaggctacaaccaccaacacaatacagaaagctcatatttttacatttcttttgaaaaatgactaatcctgattatctcagtcttttatttaatggtgaatactgccagtttcaatgcaataatatttcaattcaataataaactactaagcatgagggactaaaatctaactgaacatctattcagtgtcttcctagtttatacttctttgagatggatgagagcagccatccctgtattcttcctcagtgcttgcatcaagggaggggacccaggatgctcccaaaattaccaggttgcatttgtccaccacaagggagaatttacatagtaatctctccccaaaatccttccctctaggaaaaagtctccaaacttctcttcctagaatcaggaggccagaatcctggagccagggctaagcatgggagagcgggaaagggatgaagatgccaagggaaattagatacagtgaaccctagcccaaaggggctcccaaaacatcagttctgaataggtgggaagagagtcaagaaccaaatctaaagtcaagggtccccagtttgggtcaggcaaacagggtaggcccagtaggaggaagacactggtggctagagaagagagaatttttgttgaggttgagcctattgcctcattcattccttcaacaaatttgtacgaatatcactttgtgccacaactctaggccttggggatacagcagtcaacaagacaggcatggttcctgccctcattgggtttataggctgttgatggaaggcaatccaatagtaataataaaggtagaggaacatacaacgatgaaacactaaatcttatagaaatactagagggagagaatcattaagggtgctgtgttaggcagcttcgtaaattgttcctaatactctccacctcctggtatgcatgctcttgtgtaattccctctacttgattgtggcctcgatctagcaacttgcatccattgaacagaaagtaggaagttattaaaaaccatgatttctgccagcttacatcctctctttcttgctctctcttgctcaatcactctgagggaagtcagctgttgcactgtaaactgccctatggagaggctgaagtggcaaggaactaaggaagacctccaggtaacagcccatgagaaactgatgccctcagtccaatagcccacaaggaactgaatccttccaacaaccgcatggatgagcttagaagcagattcttccccagtcaagctttcagatgagactgcagccccaggtggcacattgattgcaacttgtgtgaaaccctgagctagaggatgcagctaagctgtcctcagattgctggcccacagaaactgtgagataataaatattgttgtttaaagtcagtaagttttgaggggatttgttataaagcaataaactaatacagattccaatccaggttgcccagaaaatatctaccaaactctctcagacttaccctgtttctcacaagagaaacagattatagagcatttactaacaaggcccagaatctctgataacattggtaacattgagattgatgttgcaaatggaaaccatccctctcaatgggtgaggctgagctggctccagctgtgagacaaagaatcttaattgctcccaaaaaaaaaaaaagaggtgagttggccgggcacagtggctcatgcctgtaatcctagcactttgggaggccgaggtgggcagatcagaaagtcaagagtttgagaccagcctgaccaacatggtgaaaccctgtttctactaaaaatacaaaaattagccaggcatggtagcacaaacctgtaatcccagctactcaggaggctgaggcaggagaaccgcttgaatccgggaggcggaggttgcagtgagccaagattgcaccactgcactccagcctggacaacagagcaagactctgtctcaaaaaaaaaaaaaaatgaggtgaaagaagaaagtccctcttttggcaatgagctaagagtggggcagattaagaggagtctagtagaaccagaacagagaaaagtacagtaattaaagaagtcgcaatacatgggaggctatttctaaaatatcatttgggaggcaacagatgaactgacttacccagattcggtttttcaagggtaagaagcacatgtaattataatggtccttcagtgctcccacagtatcctgatgcacctccccccatcacgatcccttaacatgcttaactcaatgaactgtttactgtcctgtttctccgattagaggcccaatgttaatatcaattaccactgtatcctagtgtctagtacagtgcctgccacacagtaagaattcagtatatacttgtcaagtgagtaaaatataccagttttgtgacaaaaaatatgcataggaaaaagaccagaaaggaacacatgaaaacataaacaatcttctactagatggaagagtatgatccttttccttgatatacgtgtctccattttgtctgcacatagacttgtctgtgcaatgtctataatgcagagaaagaaatgcctgaggatgccataagacagatcttttgggtcctacagagtttactttcataattttataatattaagattgttgccataaatttccaaactcaaagacatttatagtagattatcatctcacttgtcaatttgtcaacctgaaaactgagttcttaagcaccatgtagaaactttcaaatataagttaagatatcaacacctgcagagcaatattatgcataaagatgtaaaattaatcatttcacacattaggccccccaaaaaagataacaaatgggagatcatatcgtattaaaaataaccatgtgagattctttggattgtgcggtagcacagctctcaccaaacttcaaaatactctggaattcgggtgcagtgattcatacctatactctcagctactcgggaagctgtggcaggagaaccacttgagcccagtagttccaattcagcctaggcaacatagagaaaccctatctccaaaaaaaaaaacaaaaaacaaaaacaaaacaaaaaaagtatcggagcatccaacctagcaagcaatattgccccaaaatgcaatcaattaagtggaagattttgcatgcatgtatgtgaatttcacatttttatcctgagtcaccagatcacaaaaccagcaagctcaatcttcttgaagggagcagatcgcccgcccagaagctcaataccttccatttgggaacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcttttgtagggacatggatgaaattggaaatcatcattctcagtaaactattgcaagaataaaaaaccaaacactgcatattctcactcataggtgggaattgaacaatgagatcacatggacacaggaaggggaatatcacactctggggactgttgtggggtggggggaggggggagggatatcatcgggagatatacctaatgctacatgacgagttggtgggtgcagcgcaccagcatggcacatgtatacatatgtaactaacctgcacaatgtgcacatgtaccctaaaacttaaagtataataaaaaaaaaaaaaaacaaaggcagcaatctgaaactggttctcaagattgtgctctagatttatacagatagaaaacattttttccatataattccaagttcccaaaagagcccaaaatcattcatatgtcccaagtttagaatgtcaccaaataagccagatgaattgagttcagagacaggctcccattcctgccttgtcatgactataccagcagtgtgccagaaacagttaagggacacctccactgcaacagaggcactgtgatttggcagatgtacctccattcgagaaccctggcctcttaagttagccctgcacagtccaatggaagtgtaatgcaagccacatgtgcaattttatattttctagtagccacattttaaaaatataaaaacaaataggtgaaatccatttcaataacgtattttatttaacccaatataccaaaaacagtgttttcgcaacatgtaatgaatattaaaaatcactgatactttacattcttttttgttgtattaaatcttttaaatcccatgtgtatgtcatacttaaagcggtcaattcagatagcccacagttcaaatactcaatagctacaggtggctactgagtattgagtataccatattggctattaagtataccatactggacagttcagggtaaatgcacttatcctatctgactactcaggagagaccttcttgtgttattacttatgaagatagctcatctctcatgaatttaagtcaaagccaaccatatagagatgaaaaaaaaccaaaataacctggtgtagcttctattcactggtgaaataatatatactgaacaccttctctgtgccaggcactgagccaagggctttacatagctcactccatttaatgctcacagcaaccctaagagaaggtacaactgtaatccccatttacttatgatgaaactgaggcatagaaagttaatttccctaaggtcacacttcaagcaggtggtgatgcttggatttcaactcgagcagtctgactctacactgcacactctacccactgcacatactcaacaagagggagtaaaagaaggatatgaaatgcacggttaagaaatcttagtctgacatgagtgtgcatatcagaaaagaatcaagaaagtatttgaaagcctgcgacagaaatctaggcttgagatacagagataaattcacctacaaggtaaggaagggaagggaatgaaatatgttcaacaggaaaaatagaattaagaactaactaaaattttgtgtcaacaactgatgacgacaatgatgatgatgataagaactaacatatttggagcctttgctctgggtcacgcattgttctaaagtcagtttctcagcctcagcattatgaacgttagggctgagtaatgattgtaggagctgtcctgtgcattgcaggatgttgaacagcaccccgggccccctcactaaatataaggaacagcactctactctcaattagcaaacaatcaaaaatgtctctggccattgtcaaatattcccctgggaagcaaaattgccccctgttgaaaaccctcaatctgagtgtttcatatacattatctcacttattcttgacagcagacgtctggggagacatgattgctttatagatcagaaaactgaaggtgtggttgggcagctgacctgaggtcctgtcgctaataagtgaaagagctagacaaatccaaatttgtctgattctaaagtatatttttactgctagcccccagtacaagttctcgtctcatctccaattcatacagggatttgtgtgctttcccactccctgggctgatgctagagatgaacagaaacaaaacactgctggacactcctcaccgagaagttctcctgccacaatcaccttttgtgtctcctttccaccttgtgtctcttcgctctatttggacccacgttttcttggctaatagcctttcaggaaataggcatggtatgaatgaacagataaatctttaaagcctgaatacatacttatggagaacgagtcctcaaactcaatacaaacatccaaccaactgcaattaaaagccacaaatatgtttttataagaaaattaagctatcaccatatcatctttgatataaagtgagatatgactaaaaatggaggtaaagttcaaattgctacaagttgtaaatttgttcttgaaatatcaaacacatgggaaacagaagctaattattttgtcctatttttgtatgtgaaaattacttataatctgcctgttaaacaattcaaaattattttaaatgataattgaccatcaaactaggccaatttacacctacaatccctctgaaattgcctagaaactgggacaactgcagaagaaaagaaaaacacttccatttgcgtcaatgtctttgtttttcatccatcagtctccaaggctgcaaaatcagaaaagcttaagcacaactgattaataaggaagcactttaggactttgcattatttgattatgccaagaaaaaccttataattctcataaattcattattccgatattggtcatgaggaagtctactttttaaagaaaaaaatggggaatttcttcttataacttcattgtcaatatttttaaagtattatatgatttgtttaatgcctttaagcccatcccaatgaaggaaaagggcatttgttttcgtattacaatcattcctgggtatacttaggggattggttccaagaccccctatgcataacaaaattcacgcacactcaggtcctgcagtgagctgtatagaatctgcacgtacaaaaagttaaccctccgtattggcaggttttgcatcctgtgaatactgtattctcaatctgcattcagctgaaaaaaaaatccacgtgtaagtggatcctcacagttcaaacccatgtagttcaagggtcagttgtaatttacttttaaaaaaaaatatgttagccagttgcagagaatagattcaatagcagattcttcttagtgtctcaaagatcaacttaaggagaaagaccaaaaggagggaaagcaaagcagagagggaggggaacagaaacaaagagacaaagaaggaaggaaggaaagagagagaaaggaaaagaaaaaaaatagaaaaaaagtaaggtggaaaaagaaaaaaaggggggggtggaaaaaaaccaggcaaagtgatctctgatggctcatgagagactctgatctccctatagctctgtatatcccagaatctgaaattctcaaaatcccttcactgtgcattctggaactcagggtcctcaagaacaaagatctcctataccctcaacctcttcgaaaatgatagcttccctttcctgacttaatccattcacctttccacccttgttggcaagtacttcataccttctccttcaaagcttcagcacctctttccccatactcacttttaactattggccttccttcccttttcacccagaaatggaaaccacagaagagaatttcctttacctgcagcaccccatcaactcacggacttgcatctctgcccagatcctctgccatccctcctgtaactctgggtgccccaacacgtgtgcctacccatagtagcccctcctcttgtgtactagatcccatcccacccccctgctcatggataccactgcagcagtgcattttctaccaggtcagatcctatcagcagacaaatatatcatcatgtctctcatctcaaaaaggccttctcttgacctctacttctttctccacctaccatcctatttctctccattctttatagcaaaacttttagaaaaaggtgtccaggtttatggcctccaatcagaatcaaactttccccccaccatttccccaaaatagctcttagcaatattgatgtcattagtgacctgaataaatccaatggtcaattttcagttttcatatttcctgatctatctaaagtatttgaaacaaatgatcatgccctcccttgttgaaacacttttcttcatttgaccttaaggataccacactctcttgtttcattccaactcatctactcaacctcttaatgttgcaatatcgcagtgttcattctctggccacctttttttctctatatatgattatattctatattatactcacctttttcatgactggatgcaatctttctgctaatcagtcccaaatttataccgttaggcttgctatctcatccctggactcgaaactgcaaagccaactaattaatcatcttcacttggatgtctaatagataccccaaggttcagatgcccaaaaccaaatccctgggtttaccctccaaatctgcttccttgtactttcccatcagtaaatgacaactgcatcctaccagttgcccaggccccacaccttaaaatcattcttaattatgttttttttcccatcccacaatcaatccatcagtaaatctacccagctttatcatcaaatactgccataatctgaccacttctcaccacctgcactgctcctatcctggtgcaagtcaccaacctccttcacctgtactgagcatttgtctccagtcttcctgcttctaccattaccttcccatgcttattctcaacacaacagccagaggaatcctgttaaaacatcccatcgcccttctattcaaaaaaccccccactggaatttcacaaagagcaaaacccaggtcgctaaaatggacaacaaatccttccatgatccggtgcctttccttctaatcctgtttcagacttctgatactactaatcaccatctcacatcccacatactacactttgttgctgtcactgctataattattgtctgtatgctccactagcatataagctccaggatgagagaatttttgtttgtttcattcatttatatattcccaacatctatcacagtgcctggcacatagtggatactcaacaaaatgtgctgaatgaatgaatgaatggaactctgagagtcagaaaagcatcaaatcacatctaagaactagggatttaatctcatccctgtcattatggccttactctttttttaattgtgataagatacacataacctgaaatttaccattttaaccatctcaagtgtacagttcagtggcatcaagtacattcgcattatgacacaatcatcaccaccatccatctccagaacatttttcatcttcccaaactgaagctccacacccattgaacattgaacaatatctccccattcctttctccctccagcccctggcaaccaccattctgctttgtgtctctatgaatttgactactctaggtgtcacatttaagtgcaatcaagcaatatttgccttcttgtgactggtttatttcatttagcataatgtcctcaaggttcatccatgtcatagtatgtgtcagagtttcctttttataagactttatatatataaacacacaatagaatattattttatttatccattcatccactgagggacatatatttggattgcttctatcttttggccatggtgaataatgctgctatgaacatgggtgtacaaatatctgtttgagtccctgcattaaattattttgggtatatatccagaagtggaattgctggatcatatagtaattccatttctaatttcttgaggaactgccatactgttttctgtagcagctgaatcattttctattccctccatcaatgcacaaaagtttccatttctctatttactcaccaacacttgctattttgttttttgtaatagccatcttaatgggtataaagtagtatcttactatggttttgattcgcatttttctaatgactagtatgttcagtattttttcatatgcttgttggccatctgtatgtcttctttgtagaaatatctattcaagtccttttgcccatttttccatcaggttgtttggttttctttgatgttgtcaagttatagaagttctttaattattctagatattaatcccttaacagatatatgatttgcaaatattttctcccattctgtggactgctttttcaccttgatagtgtttttgatgtatgattttaaattttgatgtagttcaatttaactattttttcttttgtcacctgtgcttttggtgtcctacctaagatatcacttccaaatctaatgtcataaattttcttgtaaatgttttatggtttcaactcttgtgtttaggactttgatctattttaattttcatatatgatataaggtaagggtccaacctcattattttacatgtcccagtatccagtttttccaacaacagttgttgaaatgatggtcctttccctaatgaatggtcttagcacctctgtcaaaaattactggatcatatatgtgacagtttatttctgggcccttgtttctttgagtaagtcttctaagctctccaacctccattcccaaaaatgtgaaatgaatagattccaccagtaaggatgtatcttattttgtcttggttactgtaacaaaataccataaactaggtagattattagcaatagaaaatttatttcttatagttctggaagctgggaagtccaagatcaaggtgccagcagatttgatgtctgctgaggggttaccttttggttcatacatggtgacttcttactgtgtcctcatattgtagaagaggccaagcagcaatctggtgcctcttctataggggcactaattccattcatgagggctctgctgtcataatccaatcacttcccaaaggccccatctcctgacaccaccacattggtggtgagtggatggaaaatacagccaaagtcctttctccaccaccctaagtatggccagcattaatgatttccccaaccaacacatggacaccatacaccatataccagatttgagcaactagtgggtgaaaacggaacatgatatgtgtttcttaaatgccttaatgttctagtagcacaatcatttatgtaatattgaaatctctacataaaaatatccacatggccatttgatctatgttaaggcacctcctccactaatggggaactcactaattttagaggaaactaattccatttatttaaaactttggctattaagacaatccataaacatacatattctttttaaatggtttgctttcttcagctatgttattagctcatttgggtccctttaagaagactctctaaagacaccaaggctggagaactaccatgaatgggacagctataaaatgagtaagaacagtatttgcagctaaatggcctgaattgcagagtagagtatgagatgtaatttggttcttagggcatccactgtaaacttggatctttgccaaaaggaaagcattatgaactactgatagacatatggcttcaaagtcatctcagttttgaacaagtaaagacagaatggaaagggttggttcagtatgaataaaacagatgaccccaaattacctctcaagagtaaattcagctctataaaaattagagatccagtggcaaggattaggaaaacacttaagcaaagctttgtacctacactgcaaagccacagatcacttggtaggacaaagtcaagaaagactcaaaactcagtgacagcaaaaaacaagatgtcaacttcagtgtattctacattaaaataaatattaacagtaataattaagtcacagtgaaacactccaagcatcccagatttctttgactttcgttcctatgatggttatggagatcagttctgattacacttttcttttagtttattttgatggaaagaactggatcatggaattatccccaaagcttcccaacctgggcgatcctccaaaccctctggagaacttttgaaaatatgggctccacactagacactctaaatcagtatctctgcagttggattttgttgtcttatggggttgtttttgtttttcttttgtatttttgtttctgttttttaaaatttccccaagtcattctgattataagcagggcttgggacctgctggtccagaccccatacctctactggttttcctcgctggaaagaccttagtaattggctctgcaaatgaagagagcaccagtgacattgggagacactactgctactgaaaatgataaactgctaggtcacatagaaacatggagaactgtatccaatataatgctaattatacagcaaatgccagatataacaccatatgtaagacttttgggcaggtaaaataataggtacagcagaaactctttcattccatatgaacagcatataaaagtggttgcaacagggcctgaagccttttgttggcaacaaggagttgcctagaactacctgtgagagggacctgcgtggttttcacctgggtggtgccattactttcaatggcaaaaactgtgattattttggcaccaacctaatattttaaaatgtgctatagtgaaatagcatctatgtgaagtgcactaatctataagaatttaatatgtgtattaaactatgttcaaattttggctatataataaataaatataggcattagagaatgtcacatcaactttaaaaacacaaaaatgctatgagctgaaattatttataattactatgaaagtgtttaaccaatttgttattattgttatagagccccaaaacctctgttacaaaattcatcagtttggtctctgtctaattctgcataatcctcaaggattctcatcacattgtgggtgttcttggcttctctttaacctgtacaatgcaaagtgatttttttaattttctaaaatgaacacactaataaaatgggcagtggaccatactaaatattaactccctgctgtttgttctctcttgtttatttgactattcagattctctgccatttgtgtctataaaacccgggattaggtcaggcagatgcaggacaatattcgttcaccatgacaacactgtcgcctttgctaatgcatccaagcccttggactgccttcgaaaatgacaaggagattttataacctctctagttgagctcttctcaccacctgaacagagacaagggtaatcaaattccatttcaaagaagaatatcattgcccttctttcacctctttcttttccaagagtgtccttgcaagatgcgtatgacccagccatcaatgctaaagagacatgattggataaggagacagagcaagtccccctttaccatctctaactctcattttcaacaatgactccctgcctgtgactagaataatgtggtgtgttagggaaagttaaaattaacagataaatatcttcttattacacatttgtagagagagataattctcaaagataattcctgttttcatcttccattctatttctccccatgatcattccattccctttaagacctttccaatatcatatttacatatacaaatcctaactcatcattttcataataaatatttatgcagcaccaacatgggctaaggactatgttcagcactgagcatacaatggtgatacagtttggatgtttgacccctccaaagctcacatcaaaatgtattcctcagtgttggacgtaggccctggtgggaggtgcttggatcatggggacagatccctcatgaatgtcttggtgccattctccgggtaatgaatgagttctcactctgtgagttcgtgctagatctggttgtttaaaataacctggaacttcctcctctcccccttcctcctgctcttgctatgtgacatgctggctccccttcactttcagccatggttgcaagcttcctgaggccctcaccagaagcagatgccagcatcacacttcttgtacaacccgtggaacaatgagccaaaataaatgtattttctttataaattacccagtctcaggtgtttctttacagcaatgcagactaacacaaatggcatccaagagagtccacagaccttgccctcatgaggcttgaagtctagacttccaatggttacttcaaattacacctcttctcagaggccttccatgattcctttccttactctacgttgtcacaatactctacccacactgtacttttggtctgtatcattttctactttgtacggcaatcacatatatatctaatctcctctgtcgatccacaaaaagtgtaggccctcattcatttttgaaccctaacagcaactcagcattcaataccttgcttataggtggcacgccccaaaaaattatcaactcaataaaacacacaagggagcaggaatgtatcaacctttaaaatcaacattaattatattttcaattctaaagagaaattacagacagaaagagaaatttatgaaaattatggagcaaagcattcagagtattaggagtaccaaaaaaaaagagtacaaaaattgtaatgcatattttatagaactcttcctgaaatgatgaacaaagaatagctcactttcccatctaaatacattgtagataaatgggaaaaagcaaaaaatataagccagttaagcaatagctgttaggttgaaagtattgatcattgggggactctattgcatgggaggagggaaatatatcaaggagtttaattaacaaatgctggagaaatcgtgctagtcaaccagaccttgaggcatgagtcagacttcacagagaaatagtgtaaaatgcagagaaaagccagactcactatggaatgatctgcagtcttttaaccacaagagtcagtgtcacagaaagaacatgacaaagcagtgcctacgatttccagagttacatgcgaaatactgtttccctgccagggaaaccccagctcatgacagtggcatgagaatgagaaaggccacctgcaaatgaaatgagaccatcccacctgcaacagcaggagagggccacacatggtcttgttagtgccatttcaggagttgtgctgcagaaccagggaggagaccagacattaggtcaagcctgtgatctcaagggagctggcctgctgcttccccagaggacttcagctagagtcagtggagttaataaatcatgtaactgtctggtcccattatctcaacccatctaccctttgattctgctgcttggaaggaattcccagaaatcaagaaacccaggctgagaacccatagatgtcattctctgagtaaacagatgttcaaaccttgaagaacccggcaggaatctgccctgcctttaactaggaagggtaggcccatctagatggagtccaagaacaggcaacagctatataaatctaacttcacaaaggttgctaaattttggtagttaaatctacagctgactgtgaaagggagccttaaatagggctgaaattttaacaatgaaaaatcatttagttaataattcctttttccattctaaaccagtgacggccaacaaaataaatgaccatgttgaactcaggaatggaataatatgttcttacaatgaaaaaaaaatccttttctgaaaacctctctcaacagcacaaaatgccctattagaaaccattctttaattagcttttccatcagcttttccatccactatattttacactgcataaaatacccatcactcaacttcttagaaatccccccactgagtttcaatggaaaaaattacaaccaactcaacactgggtttccaataatgctcttatttctataccaaaaatagaatttcacgactttcttctcctagcttgcttttcaaactaaactaacactaggtcattctcccctgccccttacctaaatggttgagtgatgagaatgttataagcgatctaacagtgaaaagcaaaaaagggcggcaaaggagagtgattggctaccttgtacactgggtttaggaggattctaaagccaaaactaggtttagaggggaagtctcacgattagtgatgtctgccatcagaaccaaaatggagaatggcagtacaatatttgtcattggggctatctataaatacaatagctggatatacagaaaataattgaggtgcattttcagtagcaagaagattcttaagttatctttggttttgtttttaagagttagctggttcatatgcaacataaacaagagttcactacctggcctaatgaaggggttggattatcatgccacagaatattacccaatgctttgagctgaggtcacatccaagattaacaggaagcactactcataaggacccctcccagggtggaagagaccatccacttaagggtggactgtgacagcctaatagagctgtgagcaaatgtgttgtgaagaaaatgcactaactgaagcacctgcttcaatttctaaatgtgactcataccatgtcagactgatccctgagctttagtttcttcgtcagtttaatgggaacaacagctcttgcactcatctcaaaggatgtgttggggattaaaatgagaacttaagtgaagcaatcagaccacaacataccttcaacaacttcagtctcactcatgggagatgttccaaaaataaatgctgaacgaggttccccataccaacacttcaaattattctccactgaaagactgtcataagaaggaggaggctgaatttcctgctgtgccctggaatgagatcactgtgtcactccatctaagttgcctggtcacaacttccaatgtgcaccattgactacatcctcctcatcagggaagggataagaacaaaatgatacctgtgattaacttctgcctagaactttatagtttatcaatcattcactctgagaagactctcacatcaactatgaggtattaccaccatttccattttaggaataagaagagtgagaaagagaaatggttaaggggttaaggaatgggaggcaggaagaaggctccagccttattctaaataccatgtcatgtctacgtttaagatgagtattagcaactcaaataagtaggtgaactgtgacaatcaaatgacaatcctgggttcactgctaccacttaggaagggatcagagaaaaatgagttttaattatagaggtagaaattaaggatattcaaagatgggagagtatactgataaggcaatcgtgcacaggaatgggttactaatgcgattatggggaacatctctcttggggggagaaaaatgtgcctgtaatcagataatttttatttgccaaattaattacaaaatacctatgggctttagggaaaacattaaaaataaccttctctgtccccgaggcatcataatatcccagatcatatctgacgggagattaatttttccatgctattcaattttaagtcaaatcaaatacttaccatacacctaatgtgtacaaagcatggtatagcagatgacacactatgcaatgtattcaagtaaacatattagaatcctgtagtgtaaataatagcaaagatgctatcctttgctgaaaggtgaagaggcacttcagagagacaagctatttcaaagaaatgattttaaagaaatgtttcaaatatcaaaattattgagatgcatgtagatttatccaggcaaacatttctatgtgtttgtacgtgaatgctcatataacatttaatgccaccacaacagtttcattttctttaaaatggttttctggtccttagtaacagaagtctgtcacatatatctttggttctccattctgaaccaagtcaacttcatggactgtttatttcattatggtatttgctaccaccaaaagtatcctctatctttcttgttggggctttatataggacaatttagaaaggaagaggtgggcatgtgcacggtgactcaaatatatctgtttctatagggagataaaaaagattcacattgactcccacactgagatgcattttgtctaaaggtactggaactcattaactctatctactccctcctttgaccattatactagaatgtgccccagcaaaatgtcctcttccagggcaaattctcagattggggaaaagtcaactagctctatatagggttaaaataaataaaaagtccttgaatatttattttaaattgttacctcgagacatgacttttatacaaagttaaaaataaaatggcttctagtaaagacaatggtggttgtggtaaaggatctcaggaaacaaggacctcatagttctaaccctcttcttcatcctcctcactggacactcaaaagctacagcaggcaaataaagtccacactgggtgccacaggcaggaagttccacctgatacggccacgaccaccctccatgatctcacctgaaactgcctcccttcagctccttcttgcccacaagtcctttctggtgcctcccactcaacacctcctccctagggtcttcacatctgctattcccttagcctagaatgttttgtactcccacccttccccatctcatcagctccagtcatcctttatatcacagctaaaatgccattcctggccaggcacagtggctcatgcctataatcccagcactttgggaggccaaggcaggtggatcacctgaggtcaggagtttgagacctgcctggccaacatgccaaaaccccatctctactaaaaatacaaaaattagccaggcatggtggtgcatgcctgtaatcctagctactcaggaggatgaagtaggagaatcacttgaacctgggaggcagaagttgtagttagccgagatcatacctctatactccacctgggcaacagagagagactccttctcaaaaaataaaataaaatgaaatgtcattaccttagggaagccttcactgtatcctacacaggtaaggttcctagttatggccccattacatgttctgatagattcccaaacacctccttccaaaccatgtaacacaattgtaattcattgtttgtgtagctgtctatttaggaactatcatgctagacaattagctcttgaaaccaaagattaaatctgtcattgtcacttctgtatttatattaggacagtttctggcacatactgagatcctaataaatttatggaatgaatgaatgaataaactgaattgaagaactcaaaaattctcaaaccaagaaattttctcctttaattctttttcccaaatcaaacatgagccagctgactgaaagccaggattagcaaaccatcagctacactgccataagcctcagtgaagatcaaagaagcttcatagcacaaagctaagggagccatctcttgaccccctgatcacctggacactacttttatgtctcctacaaggcctgggataagctacagccaaaaaaaaaaaaggaattctcttttgctcccctgcaattttactccatccagtggcctctgacctggtctccagctcactgcctttgataagtagagaattttctctactagctaaaaggcataagggaggcattctcatgagatgaacttgcttgtccaaggtcagccaacatgcccatggcaaggtttcttatttaccaaagcagaagtgaaaactatcatgttgtgagaaagaaccttactgtaggcaaaataagcatgtttaactctaaattatccagaataaaactttaatgagaatctcaaactatggagatgaaattaattaattttcttgttgaaaattcaacataaactccaaatattattaatatttcaaataaaacttttagtgaaactgttttataggtaactccagtaacataaaagctactttacaactacaggatgatgaaatcactgcacaatatattcttagctaattctgacctgtctgactttttaactttctccaagctataaaaatcaatataatctagaatatataaagaactcttcatacaaatgaacaattaaaagacaaataatccaatttaaaaatgggcaaaagatctgaataagcatttctccaaggaagacatacaaagggccaataaccacataaaaagatgttcaacatcatcagctataagggaaatgcaaactaaaatcacaatgagataccacttaataccccctagtacggctataatcaaaaagtcagataatagcaggtgatggcaaggatgctgaaaaactagaacccttttacactgctggtggaaatgtaaaagggtgcagcccctttggaaaacagtctaatagtcctaaaaaggttaaacataaatttatatgacccagcaattccaaatctagtatattaacagcagcattattcatattagccaaaaagtggaaacaacacaaatgtccatcaactgataaatggatacacaaaatgtggtatatccatacaacggaatattatctggcaacaaaaggaataaagaacagatacatgctctaacatggatgaatcttaaaaacatcacactaagtaaaaaaaaaaaagttgcaaaaaaatttatattatatactcctatttatatgaaattaaataggagtgattgcctaggccagggggatctgggagaaatagagaatgactgctaatgggtgagtttcttttttaggtgataatatgtctcaaactaattatagtgatagttggttatctctttaattatactttaaaaatcactgaattgtacactgtaaatgattgaattccttgatatgtgaattacatttcataaagctattttaaaatttcagactctaagctgttaaaaccaaagtgccagggtctttaggtaccttatctccaatcttaaatactttaacattgtctttgaatttggtcttcgattgtaatgtagtttggaaatttgtccccatccaattctcatgttgaatttgtaaaccccaatgctggaggtggggtctgatggaaggtgtttggatccctcaaagcatggtgctgtcttcgcaatagtgagttcttgcaagatctggtcatttaaaagtgtgtggcacctcctccccattctctcactccattgctcctgctttcgccatgtgatgtgccccttttcctgttggccctctgcaatgattgaaagttccctgaggcttcaccagaatctgagcagatgccagcaccatgtttcctgtgaagcctgcagaaactcttttctttataaattacccagtctcaggtatttctttatagcaatgcaagaacggcctcagacaaaatgttaaaagggaaactggagtttcttgtggcttaagaaattatgcaattgaagactgctataccttgaatgagatgtccaggaaaacacttccaccagtgggttagtatctccctttttacgtgaacagacggttcaccagagaggaactccaagtggatgctaagctaaaaagcttgcaaaaaattaaagaaatgcaagttaaaatgaaattcaatctttttggcttacaatactgataaaaagaccaggattggaaaatttgtggttaatgagggaattcacatgcactgctccaggaaacagaaatttgtacaaccatttggaaggcaatttggcaatagctattaaaaattttcatgttcatatccttttacttagaaattctcttctaggagtttattcttcagacattcttgctcaattgggtatttgtaatactaaaaaactggaaacaaaccagatgtaataataaaagattggttaaataaaaatacagtttgtccactcaatagaatatctgatggttgttaaaataatgaatggagccaggcatggtggagtggcttggaaggctgaggcacaagaatcacttgagcccaggagttcaagttcagcctgggcaacaaagcaagattctgtctttaaaaacaaaaacaaacaaacaatgaggtggtttgacatgtgctcacatagaaaggtggccaagatgtattgttcaacaaaaaaggcaagttaggatttagtagtatgtgctcacaatgttaatacattcataggaaaaataccaaggaatgtattctcagtttaatgacatatcttagagtgatgggatttccattttctaaattacacatatctttcaagttttagggtttttttgttttgttttgtttttgtttttgtttttacaaacaatatgcattagtttcacaagcacagaaaggaaagattttttttcaaaggagaacggtcccttccctttgtgtggttcactgaagcatggggaggagggtggacaggagatagaaattacaactgtttccaataactaggaatagtggctgcttcctaccttccaccataaaaagtctctgccccacttttctcatctcccacagcccttcctttctctactctcaaacttaacgactccctacctcaagccactgaagagtaatcagttcccctgcctttaccctgttagggcacaagctcctagaagacaaaggactctgcctaggttatctccacagcccaaaggacaatgtctgtacacaatgttctagagagtttcagcagcatgtcggggcttttaagaaacagtttttgttttaaaagtttttaaatggtttttgttttaaaattcaaagagtacaaaaagatacagttaaaaaatgggccgggcacagtggcatgcacctgtagtcccagctacttgggaggctgaggcaagagaatcagttgagcccagtaggctaaggctgcagtgggccatgattgcaccactgcactccagcctgggcaacagagcacatatctgtcttaaaaaaaaaaaaaaaaagaagaagaagaattctcagttcccagtagcccatcaatgaccagtgtcttggctattctttcagacaggtctacacaaatgcatgcattcctgtggccccttttccttatgtaaattgtagcatgcactctgttctgtagcttgcttttttccacttacataatgatgcaactgtttcatattggtacatacaaacatagttaacaacaccttattattttcttaaatgctttccaatgttgcatcttatggatacaccataacttagccagtctcaccccacagatatcaagtttgtgtattatttaggataaggtccagctgtactcaagataacagcggcttaaacaaaattgtctttctctatcacaaaaatctgtggaaatagatagtacttttttacaatttgatattataaagttgctctggtactttacagtatcaaatgcccatgtcttgttactccgccatgcatggcctcattcccaagttcacccatggtcccagacagctgctccaactccctcccagtgtccacattccaggcagcagaagaaggggggacaaaagagaagacatgcctttccctttaactgtaattcccagaaggtgtatactacgcatacttacatcccattggccctatctgagttatatgggcatactttgtcacaaagaaggctgggaaatgtagtctttactccagacagctatgtgcccaccataaattgagtttatatatgttgctagagtatgtgggggaaaatagaattggaaataatacagtctctcataagttacttccaatgctgtgaaatttaatcaaagcaacaaagaacattcctatgtatctgcttttgtacacttatgtgagagtatttttggacaactttctacaagaggaatataagcagctttagaaaacctattccaattatttcattttacaaatgaggtttaagaccgaaaggggtaaagtaacttgccaaagtcaaacaatagctcccagaaaagtagggttgccagataaaatacagaacacccaacgatattagaatttcagataaacaacaaataatttttaatgtaagtatgtcacaggtaacatttgagacatacttatactagaaaagtatcccttgtttttctgaaattcaaatttactgagtatcatataaatgtgtgtatatatacatatatatgtcatatatacacatacatatacatatatatacatatatgtgtttgtgtatatatatagtttgtttgtttttttagagacaggctctcattctgttggccaggctgtagtgcagtagcggtatgatcatagttcactgtaactcctgtgctcaagcaatcccctcacctcagcctcctaaacagctaggactgcaggcatataccaccacactcgaataattttgtaatttatttgagacaggatcttgctatgctgcccaggctagccttgaactcttagcctcaggcaatcctcccatttcagcctcccaaagagctgggattataggcatgagccaccatgcatggctgcatcctgtatttttatttgctagatctgccaactttacagcagaaccaggtttagaacttaaatctgctgatgtttagtcccagttcttcctctgtacaagatggccatgtcaagtgggcacaggtaataaatgaggtggagccaacaaagcatactacaaatccccaggcaaacaaaataccttcctaccgcagggctcaaacatcatgctattcatgccatatgcttaatgaattgaatttttctgtcatagatacatgggtaacaaaccagccactctacagaggttacagtaaatgcttcaatccaaaaccattagagcctgcgtacttctattcaaaataacattagccttacattaatgcagactcacagaggctgaaagtaggcaagtccttccagagttctggcttattacacatgcagggaaggatgcaagcatggactatagatatgctaagcactcaaaacacctttgaaattcacagtcacttcatagtagttgataatgtcaatgtcggcatggggaaccaagctgaaaatctcaattacatcaataaattatttcattacattctctatatatagcttaaaaaattaaaacttcactaataaattagaaccttcccatatcccttcttcatgattataaatataccaagactagataaagagtactgcagaatgtttcatataacaagattttacaggtacattttacaacaaagaaatcaagaaccttagttctaagcacattttttattccaaataatgtatattatttccctaaaagagaactaccctgaagaaataactttccaaaatttagcacaaacctctcccatgaaaaaaaaaggaacttggtttttattcagcctctagattcaaccagaaatttccaggaaacacaaagaacagagtaacaatttaaactctctgcagggatgcaatcaacaaaatccaggctggagggaaactataggacaaacaatctggtctcttcaataactaaataacaaatggaaaaaagtaagtgagccttttaaaatattaaccaacacaatgtgtggtccttatttgaattctgatttaagcaaatttcaaaaaaaaaaaactatagcacttatgagacaactggaaattgaacactgcctgaatatttggtggtattaaagaaatattgctaattttccagggcatgtgataacagtattatatttagaacttttttaaaggtccttatcttttatagatagagactaaaacatttatggaggaactgataggatatctgaaatctgcttcaaaatattagatgaggagctggtagttggggtttggatggtgtagaagtgaccacaggttgatggattaaggaaaggtgatggttatgggggctgagggggtcacagaaatagaaacactattctgtttatatttctccatgtccaaaattttccataaaatttttctagtacatgccaaaaaattaaactaaaatctgagcagtatagttataaatatctgaaatatagtaatactatatcagaagaaaataatttaagcaatttcactatttcatatcctactgtgaacaatgcattaatccaaaaccctgtgtgctgaatatttttcagaaggaagggtctgacttgactgtaatgaattaaaaggaggaaaagtattacatgctaaggttacttcaagcacatttaattttcctacaaatctgcaatatcaagaccttttttctaaaaaccaattactattttccaccaataaactgtaaacaaaactctaatgaatgactttgctaatacctgtttttactatgttcattactctgtggcccagattttagtctgatacgtaagtggaacatcaatcaaatatcaaaagagaagaaaaatttagtctgacgtatgctaagaaatctatgttccaaacttctttttaaaaagggatgccaatgagagaaaccccaacacccatactgtgaaacaatttgtatcagctttattaaccacgatcttgcaaaaaaagctactttattcttgtaacaccctctctggtttgttttttcccactagcaattgcatgaaaagggaaaagcaggaaagtcccaagactgtacaatctaaacaatgcctagggaaacagtctgtgaacttttctagctctacttgaacctatgtatcacaaaagctcgaataattttcaattaggccagtgctaccactacctggaggtataaaatgcatactgcctttttaccaataaacattgtttggtctaggcatcttgtgaagtaagtagactacacaggagttagttactcttactttacaaattaatcaactgagattctgaattaacagatttttcaagaaagagtaaaagagtggttgacttaaacccaaattccctaaaaactagtcccaatattaatccatctccccacatgtaaacatatggtcatgtataaatctttttgtatgtaaattatgctctgtaacccaatcaatatttatttctatcatcaacatccttccatacatcaaagcctactttatcatgcagatagctgcagaatattccacagcagaaatgtgccaatctttgaagttgcatagtttcattccaaatttcaatgatgttatcataaatttgcaggtatatatatctacatgaatctgtaccatttattctgcagaatttattctccagaataaattcttagaagtagaatagctgctgggcaaaggtgatgcaaaactggagcttagcccaggagggttcttgccttcacccaggaaagatttcaagggcaacctagtggtgttagactgcaacttttattgaagcagcagtgtacagcagcagcagaagcagggccaccccataggcagtgtatttttctgttctcacactgctaatacatacatacccgagactgggtaatttataaaggaaagaggtttaattgacccacagttccacatggctgggaagcctcacaatcatggcagaaggcaaaggggaagcaagacatgtcttacatggcagcaagcaagagagcttgtgcaggggaactcccatttataaaaccatcagatctcataagacttattcactaattcactaccacaagaacagtataggggaaccacccccatgattcaattatcttcacctggaccagcccttgatacgtagggattattaaaattcaaggtgagatttgggtggggacagagccaaaccatatcaggcagtgtgcccagagtggcagctcaggggcagttctgcagctatatttataatgcacttttaattacatgcaaattaaggggcagattatgcagaaatttctagaaaatgggtagtaacttctaggtcttcaggtcattgccatggaaaggagtggtaacctccctttgttgccatggtaatggaaaactgacatggcacagatgggcatgtcttatggagagatgctttcatctcttccctgtttcagctagtcttctatctggtcctgagttcaaatccccatctccaaagtcaagtcccgcctcctatctcaaagggtgtgtgcacttaagtattgattataacagcaacctgccccctaggagggctagtgcaacttacaaccccactaacagtgattagggtccatctcacttctcctcccaccactgtgtattaagctttgcatatgatagctgaaacttcggcaatatgatagctaaatataatctcattgttttaacctacacatattttattagcagtaaggttgagcatcattccctaaattttgtttggttggttgtattttttttctgggaattgtctatgcttgttttcactaatttttctactctatttttaatcttttattattgatttataaaagctctgtataagttaaggcagggttcctctacctcagcactattgacattttgggctggataattctttgttgcaagggactcttctcagcactgtgggatatttagcagcatccctggcctcgacccgttaaatgccagtggcgctcctcccaactgtggtaaccaaaaatgtctccagacattgccacttgtccttggggaagcaaaactgtccctagctaagaaccactgtgttaagtagattaaccctccgttccaattacatgctacctcctcttggatccacctccccactcagtagaagtgcccttcttctgtattccttatagatggtcattgacttaaatactattctaattttctagatgccttctcagtaccaaacagctataactgtttcaaaactcatacaatgaaagtgaagtctaaactcttttaagttccaatagtttcagttgtatcctctagaattgcattgtccaatacagtagacactagccacatgtaactatttaaatttaaatgaaattaaataaaatcaaaaacttggtttatcagtcacactagacacctttccagtgctcaatagccagaagcggcaggtggttaccacatgggacaatgcagatatagaatattcccatccctgcagtgttccattggacagagctcctctggagccttgccactcacagtgtggtccacggaccggcagtatcggcatcatctaaaaacttcttagaaataaagaatcccaggcctcaacagacctattaaatccgaatctttattttaacgagatccccaggtaattagtgtgcatcctaaagtttgagaagcacagtaccgaaagacccaaacatctgaggtcacttatcaaatgttcactcattctagaagtccatatttctccagactaaacatcctcagcctgtcatcatatgatctggattccaaatccccatcaacccaattcttcactgttctctatcatcttccagtctataaaaggacagaagggaaggctgtgcttcaggaaaggtctgaaagtgagaccatcactttctttaagctggataccatgctgctttcaatacagcctcagtgtgcattagttttgtctacatttgataatttcccatcggccacatcgcaccagaggtgcataataaacttgtgatcagcaggttccttgggccttcttcatggaacttcatggtcacaagtaccacagacttttgcacccaatgactgggggtctttaagttttacaatgttctcaaatatattccatgtaaatgactgaatcacgtaaacagtgaagaaaagtattagacctatgacaacatctgtaagattctctcttgttttgtaaatcaattaatattatttttattcttctaaattaattctaatgatattaaatttttgcagtcattcttatccttttctcattttgctttatcttttctgtctcatccctagaaattccctattcgtattgccctcatcatgcatattaattattcagtgtggataaatgtacaaatgcactaggaaaatatatgtcgaatgactcctacaaaaaaggcaacttgggtaaatcgaagatatgcagggcattagtgggtacaaaaaatagaaaaaaatgaataagacccagtatatgataacacaacagggtgattatagtcaataataattgtacattttaaaatagctaagagtataattagattgtaacacaaaggataaatacttgagggaatgaataccccattttacacgtgattattatgcattgcatgcctgtagcaaaacatgccatgtatcccataaacatatacacctactatgtacccataaaaattttttttaatttaaaaaaaaaaagatatgcaagacaagatctcctttttaagggtctaataatccagtggaaaaaagaagttttcacacaaataattataacaacaatatacagcacgtgctatataagtgatacaatcaacatgctgtaaaaaattcagatgaagaagcacccaatttctggctgggataattagaaggggaaaaaacttctcagaggaagtagcatttgtactggtttgatggatggataggacttcaacatgtgggtgggaaggtttgggagaatagtcctggcagaccaagcgaacgtacaagcaagggagatgcaaatacaaataggttgactttggccaaagtaaaggatgtgtggggagaaactaggcagaaagggccaaagcacaaaggttggatacatttgatgatgaaaagaaaaaagaatggatggaggccaggcacgttggctcatgcctgtaatcccagcaccttgggaggctgagacaggcagatcacttgaggtcaggagtttgagaccagcctggtcaacatagtgcaaccttatctctactaaaaatacaaaaattagccgggcatggcggtgggtgcctataatcccagctactcgggaggcttgagcctgggaggcagaggttgcggtgagccaaaattgtgccactgcattccagcctgagtgacagagcaagaatccatctcaaaaaaggaaaaaaaaaaagaagggatggacccagactgggcagtagccctgatcaaagtcaatgttcacacagtatctaagcctgtctattattagggttgactgaaaggaaaggaaaagaatcaatgaatgttcattcataatatataccataagacacatagatacatagcatagatagatggatagatggatggagatagatagatacatagacagatagatagatagacagatagatagatagatgaagaaatagattaaatgtgttttaaatttaaatgtctggatgctatctcataatatgataatacagatctcctccactattggatatttaggttagttcccatcttttatcaatatttaacatagaacaattgtgatgaacatccttttactctgtgaacatgtaattgctagaagaggaactgggtcaaaggatatgaacttttttttctttttttttttttttttttttttgagatagagtctcactctgtcacccaggctggagtacagtggcacaatctcggctcactgcaacctccacctcccaggttcaagcgagtctcgtgtctcagccaccctagtggctgagactacaagcgcgtgccaccatgctcagctaatttttgtattttcagtagagacgtggttgtgccatgtcggccaggcttgtcgtgaactcctggcctcaagtgatctgcccacatcagcttcccaaagtactgggattacaggcgtaagccactatgcccagccacgatatgaacatttttaagacttttgatatacatttgccaatttcattccgggtagtaagtacccatttatacctccaacatcagtatgtgggtttgtttatcctacgtggctgtgtccatctcaccgaaagaaggtgggattctgaacactatacctccttctccagtggtgtgaggagtcagaccagagtagggaggggctacagtccccagggatgtacacaaaggggtcgaggtagaataaatttcacccccttgttgtaattgtggtgactcctcacactcattaggctggcttcatgggcatggcctgtggagcacacagggcccagacttagaagagctctgtgtttgctttaataaggctctgctatcaccatcttgtaattcctaataatttttgaacaagggccctgtattttcattttacactgagtcttgcaaataatgtagccagtcctgctcacaccctacagtgcctaggagagcatgatgcacataagagacattcaaaactttctctaacttgaacagtattattgtgtttataggaaagagagagggaaaaaaatcaaactcaatctcaataaatgcaaaaactcttaattttgttatacagaccaagagaaaagttagattaattagaagtcagaaagttgcagaggaggcatggaaagaacaaactaaaaaaagttttaaaaatccagacagacaataattcagaaaaacactaagttcaaagtcaatgagaatcaggcttttctatatcatcttcccagtggattcttgaacttaataaatgtaatttctgcttggaaattttcctggaggccatctggaaaattaagacagacaggataagtgtctttttattattctgagccacataaaacaactcgtctcaagagctggtaaagactattccagaggaacccaaaccgctaatctcgctactcccaacaactttcacccacccccaaatttaatagactattagtattcctattgtgaacactgtcctttttccaagttttatttaaagcttagaagatcaaaaagtattagaattctgcagatggattcacaggagggaggccccagacttcatcaggtcagaagcattctgaggtttaagtccaagtccacttccttctcacgtcctctctaatttccattctgacattcttgagaacatgctcttaagtctggtctcaatcaaccacttcagaaccacagagggtatttcttatgaatgctgatttctagaccccacactggaccttctgcatcagcatttctgggacaagaatcagaaacctattcttttgaccaactttgggtgagtctatccacaaaccagaacttctcacacttattgtacacacacacatcacctggggatgttgtgaaaatgcaggtctgattcactaagtctaggtggaggggtgagagtctgcatttctaacaagccaagagcagtaatttccaccctgactgcacattagagtcacatggggagcttgtaaaaatcctgatgcccagaacaggtcctagcaattgaatcagaatctctgatgatgggcccagggacccccctggaacacgacagcaggtagatacaccctaaacctgtttccctgtactcccatcatactgcccgtcacttcagatgcacacactattcccccaccaccagctactcccttggccttgctaagtcctactctgtcttcatgctgcagctcaaatgtcacctccacagggaagccttctcaaccagtgtccctagcacaaagccaaaggaggtccctgcatgtatatggcttatagcaccttgaacatccttcaaagcgtcacacattttataatgatgtatttttgtgtcagtgaagaaataatgtccacctcaccccaccagcccttgtgagactcgggataccttcagtcagaggatagccctcaactcagcactgtaaccccagcagcttcccagcacttcataatagtaaagacaaacgtgtggagttgccttcctccgtgctgggctcttctctcagcactttacaaagtaatcctcacataatcctgaggtaggcacaattgttatccctattttatggatgagaaactgaagcacagacagttgcttgcccaaggacacagagctgaaggttgccagtggaggaagcaggatttgaacccaagcaatctgggttaagtaagggagataggcataatgtgggactacagagattccctggggactccctcccccaaacacacacacacacaccccatatacgctcacatcccccttccctgacacacacaattacgcttcgtaatggtcacaatgcctggagagccatcactcatccattcaaaataaatgtactgaacagtccctggtataagagggacattctagaaatatatgagtaatagatatttacttatctattattagacagacaacagacgaataagcaaagacattgcaataagtgtggcgaaagaactaaacgaggtggtaaggtaagggctggcaggctccttcagacagcgtcaggagagaagggctccccgagtgggtgccatctggctaaagcctgagagggcagtaagcccgctgtcccccaggagcagcagcaacgcaggcagggcagttgcaaaggccctaaggcacagctctgcacgcgcgcctgaggaacgcacgaggctggcgtggccaggagttgggagtggtcaagacaaagcaggtgtgacgggcaaggatcaaatcacatctccatatccaggatctcttctacccatgttgtcatcaatccagtgaccaaaacacctaccagtcatctcacacacgctcctgtgttcctggaggcctgcggctcccgtgaggcaccatgcctgctcgctcactgggccagaggcggcacgtgacctcaaagtagcccatcctcccggcaacctagggcttcgcattgtatcaacactctgctcagagtgtatgcgtgtatgcatgtgtccaggctcaccaaattgtatgcattaattatgtgcagggttttgtttttgtttgtttgttttatatttaaaaaaatataatcaaactaattgccagccaagtcagtcatcctcctgggaatatatagagtcccaaggttagcgttcctgtattagactatttcaattttaggaaaatcatgactgtgtggggaaacaatgactttaaaatgctaaaattaaaatttatgctttaactgggaaaaaaaccattgcattgtttgtttgcataccaattataccaaactaaagctagacagaaaaaaaaaaaaaaaaaacctctgctcacaaagggctggtgatatttaaatgaactgatcagattctctcaggaattttaccagaaatataagaataaggcagttggagatagggagaaaagtagacagggagagaaaaaatcatagctaggatattttaataactgactcttgaataaagatctaaaactcttaccactacagcccctagtgaccccgtgtatcttcaactccctgacccccagctataccttggttcctattatcagatttctagaagattccagccctcttaataccatttgtgtaataatggcatctgttgaacacgtactctgtgctctgtgctgtgggctttccacgctatctcatgtagtcttcactagaaagtgctgaggcaagaatcactatccccatttttacagctgaagaagcatctctaagaagttggcttacccatagtcataagctgttgtgggcagacctgagactgcaaaagtctgtgctgttcctattttcttaaaatgaagcctcattaccccagttggcctgggtgaggcttttttccttataacctgaaacagagttatctttttcagtgtctaagtattagtgccagtaattaaaaagcgatggctttcttaaaaattatatgcaaagctgtatccaaaatgtcaaattttgggatatatatagagagcaaactgatcttaatttatgtccctgtgatataaaacataaatttagtaagtgaactttggtgaaagatttaaacacaagcaataaagcatgtattcattaaatgtaccacacaatatgatacataaatatcaagccatatgaataaattaacaaaattactctatagagagctcttcccacagcacgatattcctgtaataataactaacatttactgagcacttactatgtgccaaatgacgtgctaagcactctgcttatagtatgtcatttaaacctcaccatgggagaaacagtaaaataacgccagtttacagatgtggaaacagaaactcgaaaagaccaaatagctggttagtgatgtcaagaattttgagttttctgggggggttgtttttagaggcagttttttgtttgtctgtctgctttggttttggtgtttgtttggttttgagatagggtctccctctgtcacccaggctggagtgcagtgatgccatcatggctcactgcagtagaggcaagttttaaacacaggtatgtctgcctctagaggccttgctcttaactactccaagtatcttgattacagcagatatcatactatgttgtgatagattatctgaaagtctgtcttccactatgttcccaatttcaaagtatttacatcctctccttttcacttgtccctccttgcccaggatacagtaggaatatgatatttatatgaatcaactagctgatctattagtaacacaagacttagaccaataatcattcctgttgaatcaagactattgggtgaattttgcaaggtgatgaattatctcagaaaaaaaaaaaaaaaacagaatccagaaagcttaacctcaatttagttacaaaactcaaactacaatcaattcccaagcagaagactgttgagtttttaccttcttattaacagattgatttgtgacaattctgtgccactcagaggaaagagaaaaaaaactgagatctctgaaaatctctcataaaaattatctgtaaataacaagaaagatgtcgaaatattaacgcctcctccatgagcacatcaaaatgctccctctgccaccttccatctgcttgcctgcctcacccaacgtgagcacagccccactctgctttcagcttctcttggatgtctaaaaagactgggccaaaaattgtttcagcacgccggaaagtataatcctcacatttcagacacatttagataccctaatttaaaatatggtggaaaatagcatacttgcaggctgttccttgctatagtttaaatgcatccctcacaaaattcattcctctgttaaagtcatatgcataaacttcacttctaaatggaagtaacaacaacaatagcagctaacacttacatagcattgttctcagcactctatatacagtgattcatttaatcaccttatgacactactctttttagcaccattttatagggtagaaaactgaggcccagaagggtttggtgacttttccaaagtcacagggctggtgagtagcagagccaggacttgaaaccagagctatgaactccagatactatattcttaaccactgcaccaaactgcccagggggcttcagccactaactagcttaatcctttcttctccaagatccctggttgtcatactgcaacagaaaaaaagctggagggtgagtgtggttgattgaatactggccccaaaaagcatatgtccaaggcctaactccctgaacctttgaatgtgaccttatttttaaaaagagtcattgcagatataatcgaagttaaagatctcaggatgagatcaccctggatttaggacaagccctaagtccagtgatgggtgtccttataggagaaaggtagagggagatttgacacactgatacacacaaaggagaaggtgatgtgaagacagaggcagagactacaatgctgcgtcaacaagccaagggctgctggcagccaccaaaaggagagaggtatggaatgtattctccctcagagccttcagaaggaaccaaccatgccaacaccttgatttcagacttctggcctccacaaactgtgagagaagaaatttctattgtttcaagccaccaagttagtggtagtttgttatggcaatgctatgaaactaatataatgagtcatggatcaaaatccttcagcagaaatccacatccccactctacagatcaggaaactgaggctcagagtgaggacttcattggcacgctgtcaagcacacaaggggtttgtggcagagccaagccaggctctaggctacatactgggtcttcggacatctggactagccccttcttcagtatctcatatctaccactttgagagacataatcatgcagtgttcacagacgggcactttagagtccaaccacctgggttggcttccatgtttggcacgatttgtgagctgtatacctcaaatttctcatctgtaaaacaggaacaaaaatgacacctacatcacagtgtcattataaggagcaagtaagtcaatacatgtgcctggtatgcagtaagctctcaataaatgttagctattactattattttattctaatatctacttaattatagataaaggttaaactataaagtcaggaatatggcagtgcctagaaaaaaatggatagacatattaacaggatttatctttacgggtgcacatttgtgacaaatgctattaactaatttcttatgtgggggttggacatcaagaggtaatatctatcaccctcaacttacacctcttagccagtccttactggccctgatggaaaaaggagtgcctaatatgactagccagagaccaggacattgactaggacatgctgtgctggtggacagggtcactgtagtgcaaaaggcccacagctgtgcccctcactccaagctgcggacccgaacaaggcaagccagccccaagcctcccactttcatgctctggcatggtgaccactcctggaaacactgcttccccaggcagcactgccatccacccagttttccagcctctcaggacagggccttgccaagtcacctttattctttcacttctgggcatccatgtggtaagcacactacagcctcctctcttgctaacctgatctccccctgagcatggtggctgcttggggtcagcgcacagcaggtatggccatcttgggtcctgggaatggagggagtagcaagcttccttacctaatcaaaaaatccctgcatggaaggacactgagcccatcctcagaattaataaactcatcctccgtcttccatttgactactggtctctaagtgcatagtccccttggtcagacactggggagaggaaaaagaacagtggcattcagacaccaaaaccccacccaaactcctaacaaatttatattaccttctgatggaaaatgtgtatgataagctatattttttcaaagaataatgctcattgcacagtgccttctgacttattgaatttcctaacactcttctgaatgatattgcaggtttgaagaataacaagaacatgaaacacctcgggaaatttctcccccaaaccaaataaccaccaatctgttgttgttgttactccgctttaataatagcactgggcctatgcacacatgtgcacccatagaaaccacagcccttgtctgatcacttctaccccaatataaaaatccaaggtagttgctggaatgaagataaatactactggaattaacagtgtccttaggaaaggcagggttgggatgctgatttcatcacaattctgcctgtactttttcaaggaagttcaagaaccatgggcagctgtagaaatccaagtcatcagaaaagcaaacaaaggcagctcctcccccgcaaagcatgttccctggaagggcctctgcatctgccttcttagcataaagtagtggtggcaccttaatctactgggaacttttctgcctttccttttgttccactcgaggccaggcaccagactttcatcattatccataatcatgtcaactctctgacttttgagaattaaccaatgcctgctacaccttactcttttctccttccctagatatccaaaacaaggccctttcccattttctggttctgtgggggtagctcttaaattccttgaagtcaagagaattattaagatgtcccttctggttgggcacggtggctcacacctgtaatccccgcactttgggaggccgaggtaggtggatcacgaggtcaggagatcgagaccatcctggctaacatggtgaattatttagactctactaaaaatacaaaaaaattagccgggtgtagtggcacgtgcctgtagtcccaggtacttgggaggctgaggcagaagaattgcttgaacctgggtggcggaggttgcagtgagctgagatcatgccactacgctccacccagggcgacagagcgagactctgtctcaaaaaaaaaaaaaagaaaagaaaaggaaaagaaaaagatgtcccttccactctctctctctccctctctgtctctccccccaggtacagagttttcactcaggactctgtgagaccaaacaacatccatattttaccaacatttcgaatttaaaaatgttcttcatttcacctttaaactaaaaatgtacatctgtcaaccaaggggtggaccagaggaacacggagagacaatgtcctacgtaaggtaagcagcaatgcttagctccagctcactgggctcagggctaccacatctttctggtattcagggaaatgaagaaatgcaggtttttacatgaagtcctccagttttcaatcttaacaactaattccccaggtcacacagccaacttgtagcagagccagaattggacctaggcatcctggcctcatgagctcaagaggccttagctctgtatatatttgtacctttcattcaacaactgtatactaaaaaactgctatattcaggaatgttattttaatgagtggatggatggatggatagatagacagatgggtacacaccctaatatttattaaggaatgaagggagaaagtaaaatataatttccaaatttacaaaatattttttaaaaactgagacaaaacattaactctataactatcatttttcttcctaaaataattttatttgtaattgactctgaatagggaatagatcacacagtccgaatgctgaaagtaagggaaatatagaaattgtatttaagccagggcatctgccatttaagaaagccatgagtaaggaagcactgtagctttggaatccacaggtaaaaccttttcttggattatttaagaacaacctcttttcccctctgcactcttgggaggatagggtatatttctgtagcatttctatagggatggtaattagtatagctgagaaatgccatcaacagcaaaagtaaaattagcctttacttgtaaaattttctcctggggaaatgctggtagctcctgtctccaccaagcatggtaatgggcttgctgtgtcatcccattgcaagcaaatcaccccatcagcagcgcttgaatagaaccaccagcacaacaaataggacagccaacacaaatacttttgcctgcttcaactacatctgcctcaccctggccccatgccctcatcaaatcgcactcatgagtcataacagcattgactttcttttgtcaccaaagcactcttaattttcctgaaaatttttgagtggcttggagccatgacacgttttaaccaagttgagccttggaaacaattgtattcagtatgatgatgcagcaggggaaactgaggtccagggaaaagacgtgatttggccaacatcacatctaatttggcatcaaagccaagtctaacttaattcctagtaggggctttctctttttgatgtaccaagcagtctttttaggttaaaatttacttctactccacacctactaatgtctctttatctggaccttctctgaccacctcctcctgaggtttgaagaatagaaatctcacctcctgcccaaagctgatctgtctccctactcttccaggcttggttccatgaaaaacccctcttcatactggcccattccctacaagttaaaaatatggtcaactatgtcacacaaagaaggcagggagagattccccaaactatgcatcttgttcagttaccacccttcaaagctaacctccttgtgagaagagtataaaaagcaacattaacacttccaagccactgcagccccaaatccaccctaaccatgccatgatgatgttctggcagagaccacaagaacgcaaattccaccaaacccacctccctactcaacaacaccacttggataaatgacgctttgccaacaacaaaacatgattaaaaaaaaaaaaaaaaaaaaaactcctgatctctctctctaaactgaaactgttttacccttggtcttccccagtggctcaagactccttttagtacacccacaagaatgaaagctccatacaggcaggaagtttttttctattactctaacctctgcacctagctcagcacatggttccatgtttattgacttaatccatttcagtcattcagtcatcatattgtttgaccttctggggtggcaccagtgaccttgccagtagaaagtaggtagacatatctaaaggccggtgcagagatctaagttagagaacttgactggggggatcatttctttggtacaaactattgaagtgtcattataagagtcttagctggccagatattatgcagcagatggattctgtagactgagatgagcaaaataggccaaagtttataaaaaccaatcaatcaaacatctcctctgagtcctatgtttctagctggttggattaatatatatagcttgctagatctggaaaccatgtgatctttctttgggcaacataagcgtctgccttttctgaggattcagataatagtgtttactgggaaatcaccctcatctttttttctattactccctacaatgatagtgaatttatcgtttccatctcatgccgtgggacatatttcaatgtagcataccagaaaaatgtaatgtgagtctttcctttttttttattttttgcacaagaaaagcctagctgtggctcagaattgtccagggcagccatctgaaaattaacacaaactggcttggatccagttatgggagtcaatacctatgtcaagaaaactctcctagccattcctaagcagctcatctgaacttggtttcaagagtagggtattctaattccactgactctataaagggtaaagaacaataggataacttaaactattaccacatctattttacaggtaaggaaacaagtgcagagagataaagttaaccaaattctcacagctagaaaggaacctaggtaatccatctccaaagctggtgctctcgaccaccatcatagaaaacaaagcaggaacccagaggcaggctccactaacaccatgttgccagttctgctcacagaaactctttgaacaggcagcatatcagatgcaaaggcaaaaactagggctactaggattacaatgtaagcatcatgtagtaatgtcactacatgtcctacaatgagggtaggaaacatctgataagtgttaagtagggttcaagattagcaccaagttgagactatcccatttaggttcatcagaagtactgaaataagatttggaaaggggccggggcagtggctcatgtctgtaatcccagtcctttggaaggccaaggcaggaggatcatttgaggccaggagttcaagaccagcctggccaacatagcgagaccctgtctctacaaaaaaaaattgtttaataaaaatattaggtgagcatgttggtacatgcctgtagtcctggctactcaggaggatgaggaaggaggattgcttgagccctggagatcaaggatgcagtaagctatgattgccactgcaccccagcctgggtgatggagcgagatcctgtctcaaaaaaaaaaaaaaaaaaaggattcggaaaggggatgacttccttttacatgggcttcaaagttgtttaattcagagtcctcacctgtcctaagatcctcttgtgtacacagagctactcactccatactacagtcaatcctgacactggagactgactttggagttagtctgcctgggttcaaccctagctttgccacttgctaaatgtaactttttgacaagtgacctctcctctgaggcttgctttgctcacataaaaataaatacatataataataacagtacctacttcatagggtcattatgtggattaaatgagataccatatatgtggcctttggctttatttcatttagggaagtactttacaaaccacactgattgtttattattcttacttaccaggggaacatattgtagttaggtgggtacactaaatgggaaagtgaagtgattcacagactttacatgctggcctgagaaaggcaggggctcaggccttccccaactcccccatcccaaacacttccagaagccctacactggctggatgttaggaggatactgtgcccactcttagactctggctaggcttctacagaagacagagagaggtcacatcaatggctcttccagaaaggtaaataaactaggcaagaagctttcttccctagaccaaacttcatgctcaggtcaagttccaaggtagagtcaactacccataaccaacaagatatatcactgcttcattccttattcacagtctacatagaaaaaggaaatgaacctctaaggattttcacaagatggtaatgggacagaaagtgcactttacacttctttagtgtcttcttcagcccttggcatataactgggaacatgataggtacgtaattaaccctcacttgataattcaacaaaatcattcgttccttgctcttatcacaaatgcctacagcataactgcatttgtagtatgagatttgagttacaattacaaataagtgatatagaattgccagaggtaaacttggaattttcgtacccagagacaagcataatgaatggaaagtccttaatgaaaatatttaaagatgtgcttttactatgtgacacctaatgctatgcaaactctttcaaggtaacttattcctgaaggtagactaaaatccaccacctccagtatattgtatctgaatacacttagtgaatgcagtacagtccatcagcaagtttccatcttaccaatgtacataccctttatcaccaaaatcctggcacatgccccctatttctcagcacaaactgaatagcagtgaaatgaagacatgtctcatattaccaaaagctcattcatttcactaatcactgggaactatttactcccaacacatgtgcaatattttatgaagtggtaatatctagacagaggatcttgatctaaatatcctgagatgcccttcgagtttgcagtagggatgaggaagtgaaatttgtgcacaatccagattatgcacacctttctagggaaaattatgacattttcatcagctctcaaagtgtacatggcttcccaaaggtaaaaaccccgaagagaaatttaaaatttttgagaaggcaattttatttattatttggtacatttctaaatttaagcaagttctaaatctggccatcatgtgcactgtccaactctccatctcataggcttattgatttctattggtcttaggattccttggaaacttttatattatttcacatggatattttagaaagattttccaagggatgaatcggtgagttttaatttctttccattccttctcagataatatgtactcacgagccaatcgtttttagaacttaagtggttatacttttttttttttttttttttttttggagacagagtattactctgtcactcaggctggagtgcagtagaatgaacacagctcactgcaggcatgacctcctaggttcaagtgatcctcccacctcagcctcacaagtagctgggaccacaggcacacaccaccatacctggctaattttttagtaaagacaggatcttgccatgttgcccaggctggtctcaaattcctgggctcaagtgatcctcccacttctgtctcacaaagtgctaggattacaggcataagccaccatgcctggcccaattatacttacaacgaaaaccatcaaattattacttacttctaaaagtttacagatcctaattagtatcattttcccatccactttggagaccaaagtctccaatgaaactaagggaatttgggggccgggtgtggtggctcactcctgtaatcccagcactttgggaggccaagacaggcagatcacgaggtcaggagatcgagaccaacctggctaacacggtgaaaccccgtctctactaaaaatacaaaaaaaaaaaaaaattatctgggtgtggtggtgggtgcctgtagtcctggctactcgggaggctgatgcaggaggagaatggcatgaacccaggaggcagagtttgcagtgagctgagatcgccccaccgcactccagcctgggcgacagagcaagactccgtctcaaaaaaaaaaaaagaaagaaagaaagaaagaaactaagggattttatagaaagtggagactgttttaattccatcaaggatgcactctgatagtatataaaagcgccatgtgggtccactatggtaaaataacatgaattgatcctggtgttggtcaatataacttccagaatttctctagggggcacaatgtaggtagggagtgaagaggtgagtgtggaggttagagattccaggaggctactgaagttgttattgaaatggctagttatagacagaagttaactagttatagacagaggttaacagaagctaactattcagactataaaagtcttctggattcgtcttggtcctcctaatactagaactaaggcaagcttctaactatgtgttgcacaagcatatttcccagcaatggctgtcctttcctcctcaccaccttacccacacactcccttgctagagaatctactcatcatgcccctttctcagaaagaccttttccatagctctgctgagggggcgtggatgtgtgactcattcccttggccacagctgactggacctagaagagactagacccaagctaggtcaattggattattggttctctgaatttgaagtcgcaacagcgcaactctaggctgtccctggtgagcacttgaatgaagaagatacacatgctttccttgagtgccgctttttcataagagatatataaaaatagatattaagagagaaaataagagtgatagagatgtgtatgtgtgtataggagagacagagcagagacagagatggagactggctttgttgatattcctcatcatcttccaactgaccccgattcccgctccatgtgacacctggctgccctacttacccttaatgtctagtaggtatcattatgtgctcccagtaaatccctcctccccactttttttttcttaaacttgaatgggtttctgctacttgcaaccatattctcccttaaatgagggagagtggataacttagtaaataaatggtctggattctcaaaaagaacaaaaaagatatttcacaggggaaagttgctggcagaggcagaaatcaggaaggctgggacccaagagaggaagatctgattttgagacacaagatgtggaacaaaagacaaagcctgcatagtgtatcaccccagtgaggtcagaaaccaactgaggaggaagctgagaggtgcctgttgaaggccccctggactaggaggccagcgaggtactctgaaattcctgaagatagaggcaaggacaggaggaattctaaatgattaatgagaccatcctcattgaagtccaataacccaaagtaaagagctgccctgtccctgaaactctgctcttgtagattcagggaatttgtcaaagtcacaaccacctgaaagggtctgccaggcctttaatgagcatcctgagagataatctccctcattcctttgccacctgtggttttaattttccagccagtcctggagttgcttcctcccatccttctggatgggtttccaagacaggagtgttcctttggcattctcctctgctcatttacttgacaagaatgtgtttgctacctcctgctggccctccctcctcgcctgttccttgcttccttcttcgttcttgctctctgtcctttctgtatacctctttgacagcatgctgaagatgctgtcaggcaacacattgcttactccactctatcttagagcttccatttcagccccagattccttggttttcaagcaagtttgatgtttttcccttcaagacagtggaaagagcacaattttagagctaagcatacctgagatcaaatcgcagctctattggtgaggcctcaggcaagtcactcaatttctctgtgacctgtttctcttgcataaaatagagatgccatgtgtcttgcagggctgttgagctcacacatggaaagaaactagcaaattcttggcacatagaaggtgctcaaaaatgcttacttcccctccccttttgtcagacatggacgaaaaccaccataaagtcagtgaaagtgtaaagaaattatagttttataaaataggtttatttcctttatgagttgtccatttccttacaagattgacacctatttaccaaatgtctacttctaaaagaattcaagatatttgaagattcatgattaccaatccataattggaagaatacatttttaaaaagacatcattgacaattcattctttcccacacaatgatgaatcatgttttagtttttatatcatcatttttacaaaaatacatgcattttgatcatcagttcacaaagtgaaagtaaagcactgagtgaaggcaaagcatgatatgcaaaatgaagttatagtaatcatctagttaactcagtttctcaaccttgtatctactggcattctgagctagacaacgtcaggggctgtcccgtgcactgtagcatgtttagcagcacccctgctctctactcactaaatgccagtagctaccatcccccaagttgtaacagtcaaaaatgtcttcagacactgccaaatgtcccctggagaaaaaactgcccacagttgagaactaccaagttaactttatcaacgtatggagacaaacgagacagctcacgcccagccatgggtttgtaagatgaaaagtagctgcctcagtctttacttctcaccagatctttcctactgaaaaacaaaatggctacacgttgcttccaaggcacaatcaagcactggcttcacagagaaacagaagaaattgcacgtgccagaattcggttgttagactgccccagctcttggctgcactcccacgctctacctaaaaacctacttcccaaacttttgaaatgctttccacagctttcagaacctgacctttacaacagctttatctgtgtgtctgtgaaatagatttacaattttctatgttcctgcgaggccaaaccacttattgagtccaaatgccaactgggggtggtgggaatttgcacacagatgtcaatggactccgaaacaacaacacaagagctccacctgcaactaattatagaaactgaaattgtgttctggccagaataggccacattcagaacccaccccatctgctttggcctgtaaaatcactctgttacttttctgctgtcaacatagacttgactcttaaaattctctgaggatgctgtcgatagcgaacaacagtgaatattttgggggtgaatgttttgggagtgaccactcctcctgcctttccctcttggagcttggtttcaataagtacccttggcgcaagtgagactaaaataatctattcattgaaataccctgattttttttttttggtggcttatgtgctgctgcaatcccgtcacccaaataaagtgatccagagagaaaaatggaagatggaaatcatttaggtctcccaaggtccagcacacaagaatgtttatttccctaccattagccaagtctttcagaagaaaacctgggaataaaaatctgtaaggccactaatgtggtacacatggctgattctagggccgactgcaagagattactgaggccaaaaccagctgacatctgtgacaaagatgtatagttcacttcaaatcattatcctaccttctagcaaacaaagaaaccagctcttggctctgtgccatctcatctatcttcaaaaccaaaagaagttttcactcatctctgaaaggcatttaaaattgtagtttccatctaagtaggtcatcatctaagtctggaccaaaatttttccagctctctggaaaagtagacaaaagctacagttctctgaagagctaaggaagactgtttcaagatgagaagatggactcatttttttgtccttctgagattcagcattccaaggtatgttgtggtgctaaactatattatccagttctaaatacgtgtgtttatgtaacattggggaaaacacacacaagcactcacacttcaactcggaattaaaatgaaacaccttacacacagacgcaacatatgattgacttcttaagttctcaggccccactatgactgataagcccttaaaacatttggagagcagaggtgagtaaggacagctcaagtcaaggcaattgacatctgtttttgtcttggagcatctggtcgcccttcatcccacttcctttagagaactgctcctctctcaacacctgcagttctaatagggtcaccaatcacagaaacctcttctcacataactgccccaaccatctccccacaaaacacacacacacatacacactcaccaagtcctggagggaggatatgaccaaagcaggaacagagtccctccatgaactttccaagtaggaagtgaagatgtaaggctctcttgacctttcaattgtgaccctagggtactggcaaccaagaccgcccaccacacagaggaaaaaatgagggtcacacatagacagaggcagacattgagaaccagagatgaagcaatggtgagagacaaagtcctgctacagtttaaggccctggatgcagtaaccccaaactccacacttgatcctttctgcaattttgttacaagaactaaccaactccaccccgaccctttttcttttttttttttttttttttggcttatgcaggctttgagcagcatttgtgtcactactttggagtcttgcccaaattaattagtaaggaagtttcttcatttgaatgtgtaaggtcctttaagatttcattgaacctccctgaaacatgccatggcttgttggggtggggggaggttatcaggactggcaattactatgaataacagttatcaattaacggtttctgatgttttatcaattggtgagctgcaagtaatagaatgaccaaacaacagtgacttagacaactctgggtttattttctcacatgactagacatctagaggcaggtcattgctgctgttggtgcaatttctcagagatggcagctcacacgtctctggacttgtctattgctttctttctttggcctttctttcatggttataatgtggctgacacagctccacccatcacatcaaccgtcaagacagaaagaatttgggaaggagaactgctggtgatatttgttcctttatcaggaaagaaaaagatttcctagaatctcccagatttccacttgggtttcattggccagatacttgaggaagaggaggaggagcctgaagctgagccaggatttctcagacttatactagtggaaagaagggagcctgagagaaggtaagggataagacaggtctgagaagtgagtacatctgagtcgctggcaccatcaggacactttggaaggcccagacgtggaaggaaccacatagaaagtgctcatccaccttcacagatctcctttaaggtctcacttcgagatgctcctgaagcagagcagcctttcccaaagtgtggccttatacccttatttctaggaatatttataatttgtaacagatgggactgttgttaaacatatgtatgtatattcattccactccccctctgccttggcagggagtaaatttcctctacatgactgactttgggcttggttacatcacatgctttagccaacagaatgttggtgaaaatgatgaaagccaaggctttaaccatgtttgtggggtttagttgtacatttggcatctgtgatccaccatgagaagatgaagccctgaatagctgctgttctgaggagaaggtggagacatggaacgtacctaaacccaacctccagtttaacccaactaagttgtagccaacctgcagatatgtgagggagagagataaacgcttgtctttttaagccataggttttgagatggcttgttacacagcattattgcagcagtagctgcctaatacgtaggtgcttagtttaagttttggcagagcgcagtggctcacccctgtaatcctagcactttgggaggctgaggcaggtggattgcttgagcccaggagttcaagaccagcttgggaaacatggcaaaacctcatctctaaaaaaaaaaaaaaaaaaaaaaaaattagctggatgtggtggtgtggtcccagtactggggggttgaggcaggaggatcacttaaccccagggaggtaaaggttgcagtgagctgtgatcatgccactgcactccagcctgggtcacacagtgagatcctgtctcagaaaaaaaaaaaaagaaagtttcacagtggagtaagattagaaaattggtgagttaagcaactttaatacatatttttgtttttcagggattttttgtttggttggttggttggttggttagttggttgattggttggttggttttgtagaggcagggtcttgctatagccccagctggtctcaaactcctggactcaagcaatcctcctgccttggcctcccaaagtattgggattacaggcttgagccactgcacccagcctagtaaacatttttaactgaaagagagcatttcatgtggtgatatgttgtagtagtctgcttatgttgtgggtcgaattgtgtatccctaccctcaaaaaaataccagtacctcagaatgtaaccttctctggagatagggtctttacagagatcataaatgaagtcattagggtagactctaatccaatatgattggtgtccttatgaaaaggagaaatttggatgcagacacagccacccacagagggcagattatgtgaggacacacagggagaagatgatcaagcactagccaaggagagaggcctggaacagacccttccctcacagccctcagaaggaagcaacctgctgacaccttgatcttggatttcttccctccagaactctgagacagtaaatgtctgctgttcacatcactcagactccaacatatctttttgtgggggatatacaattcaacccccacaaaacgtatgcattatgaatttccaggataagcatatccaatatgttgggtgttaccatggactgaccagaaaatccgttttgaaaagtgttatctccctgcacacactttggaaatactggctttgaaggatccatggtttcttagacttatagtggtagaaaaaaaggagcctggaagaaggtaagtctgaggagtgagtacatctgagttccacccacaaacctgatgaaattctatcactcacttccaattggcacaactcatcatatctggacactcacaatgaagttagtattttaatagaacatagttgaatgaccctgttgaaatggccctgcaggctgggggcggtggctcacgcctgtaatcccaggacttttggaggctgaggcgggcggatcacctgaggtcaggagttcatgaccagcctggccaacatggtgaaatcacatctctactaaaaatacaaaaatcagccgcgcgtgctggtacacacctgtagtcccagctactcgggaggctgaggcaggaggattccctgaacccaggaggtagaggttgcagtgaaccgagattacaccactgcactccagcctgggcagcagagtgagactcagtctcaaaaaaagaaagaaggcagaaaggaaggaaggaagggagggagggagggaggggagaaaagaattatttgcagttatacaaataaaacaaagcagtaataataaaggaaacacagaaatgtgatccatctcgatcttttcaaatttcatgttcaaaataagaatcaataaatcctatgttgaaactggatcaaaaactcatattaatattgatttagagtagattctttcctaatgtgttaagccaaaaatagaaatgatcacataaccattgtttaaaagctgtaacattccccagacaggtttacttacacttcttgggttacgtttcccaatgaccttgtcccacttctgcacacgcaagatgggtaaatattagatctagtacaatctccgagtgtgtggtgctatttatattcatgcagagccttggctagccatgcacaacctaggaaaatgtctaaaaattgctttatgtgtacctaatttggaagaaatccgttagaaatacaacgttaacaattgcacaaaataccgaggaatatgaaaagtcagtaactcttatgtaccaaactacaacacagaagtttttataaaccttaaaaagatgtattcactcctatgtttcctctctttgatctccgtaacacaatagaataaagatataaagaaaagataaacctatattcttttagagaaaataggttcactttacttcccaacagttgtatccaccctctcatcagccctgccccccataacacctatcccaacagcacaggccactaaaaataataaggggctacctcgcgtaacagtgtagtatggcagcagaacatcctttctcaatactttctcctcatccctcccccaactgttctacaggtgtgacattgagagcatgggctatgggttcatggcattccaaagaatcagctgtccataatcccttgccccactctcctccaatttaagaaaatatatcatgaagcaaaagcacaagtgacagcaccaagataacactgcatctgtgcaccctggtttatacaccaagataacactgcatccgtgcactctggtttatacaaacaagcacatgattctaaatttcagtgctgcaactcttagtagtagagcaaatgtatttatattcatgtagagccgcgtggctgagaagtagggccttggagggaactgggtggaggagaagtgggaatggaggaaggggtggcatatccatccaagaaactgagtgtcaaccctttgcacataagaaatttggtcacggccacctactcattagctccaaggttccaaatagtcctgcactccctgtaacacagagagggagttcagcatcctcccttagatctggagttgggttcagctcccttagacagaaccatgaggacttcaaaatctactgccaagaaactgatgagcaggagccctcgacaacgctgcatataagaaggaaagggctgggttagttagcattatatttataaaactatgaacttcctatacaagagcatttcaatctccttacctctaccctgtaatggacctgcttccaatttctcttcacacagaacagttcaaattgttttagatcattagaacttaggttagtgaaattctaaatatctaaatacccctgaaagaattaccttgatagatgcaatctctgattattgtggataagaaaccacaatcaaatgtcccttatcccttttgtatttctttcttccatatagaaaaagtttccatgatttttcctttaaaaggaaattaagttatggtaaatggtgaaaaccctaaacagcacaaaaaccatctctaggaaaaagaaataaattcctagttaagaatacaaattctggccaggtacagtggctcacgcctgtaatcatgccactccaaagagttagatgtccataatcccttgccccactgtcctccattttaagaaaacacatcatgaggcaaaagcacaagtgacagtaccaagataacactgcactttgggaggctgaggtgggaggatcacttgagcctaggagttcaagaccagcctgggcaatatagggagactccatctctacaaaaaagtacaaaaattagccagacatggtgacacacacctgtagtcccagctactagggaggctgaggtgggaggagcgattgagcccaggaggtcaaggctgcagtgagccagtatcgcaccactgcactccagcctaggtgacagagtgaaaccctgtctcaaaataataacaataatgataataaatcacattcttaatcatcttatcaaaactagtcattttttcatctagcatgtatgaagtaggatcttcctataatactaaatcacagctcagtgatcttttaaggaggtagtgatcataaagttaagatcttagactttggcatgaaatagaccaatgccttaagacctagctatgctgcttaccaactgtgtgaacttggataagttgcttattctctctacatttatgcttcatctgtaaaataagaaaagttctagcacctacctcagatgactgatgaaatcactaaataagataatgtacacaaagcactaagcacaatgcctagcacacagttggccctcaacaaatgtctactggtagcactagcagtataatagaaacaacagcaatagcagaagattgctccccaaactttatttcacctagctccatttttggaaaaacataaaaaccccactggtagtaatccaccatatatgtgtctctcctccctttcctggacagaagagaggactccacctcacactcccttcaattatgtcactttcagttcaaggaattaaagaaccaatgtgccatctccagtcactctcctcccctgctgtggcaacgtttgaagccatgcatcaggatgcagaaatcctggatcctgagtcactgcatggaaaagacccgtcccacagagtcacctgacctgcttcttactttaagcaaattagaaataaatctcaaatatgttaatccactgagatttgaagtttgttagttactgcagcaaaacttaccctatcctgaccaacaggtactcctatacttctaaaagggatcctaatatacttccaaaaagagaagacagtttttttaatagcttgttttttgtcaatctttatattttttactttgtaagacatcatattgcaagtaaattgacttttcaaaatctctgcgcttcttcctcattttacactttttaatctaaaagagaaaattgcattttacttgtattaaatatacagattaatactagagctttcactgagtcatatgtcacacagtcacatttcacctatgataccaaggtatcctgtgatcacagtaagaccagaacaaggaagggataatggaagtgccctcaagcattcacacactcctggcttatggcaacctgagacggttaagtggaattatggatatcacctattctaaactgaactaaccctcatgaaatggacaaatggttcgaaatgtttttaataaaagtggaaaaggttttatatgtcactaaaatgtatctcaatgtattattttgctctatctcatccacatttaattcttcgtggatgtcataaaagacacataatacactggcagtgtaatgcatcctgtaatttataaataaatatacatgtataattggggtctgtgctcaaagataaacttaatgaaagaagcatgagataagtcactttggagctaacagtttaaagaagagctttcaaactttttgtccctgcttgcaccattcctaaactgctttaaccattttccaaaaaattaaaatgaagagaaaaccagtataaaactggggggaaatgtgcattgtacaaacaggttcataaagacttcatgaaccagcaaaatcagaaagaagcagaaatgataccgaagagcatcattttagagtgaagaacaaacctttcggttccaactacaaaatcacatttctacgtctgaaaactagctttggctctgttagataatcaaaaggataaggtgattgttttctacacatagaatgaaaacaaaaggcagattttcctatagatcacaaatgcttctacaggcgcttaaactccaaaggagtggtagccagggaaacagttaggagggtcagcaggtgactccaagaaaggcagagcacttcgttagaccaacatcaaagccagttattggaaaatcacttgttcagtcaacttagagttatctcaatttccttcagaaagttaaataatatctgggaatttttgagccacgtggtatcacattccctatgccccagctcttagcacttctataagcaccaattagagatgaagctggggccaggtgtgcaatcctagaactttggaattactccttgaagccaggagttcaagaccggccttggcaaaatagcaagaccttgtctctacaaaaaaaaataattttaatcggcaggctgtggtgatatgtgcccgtagtcccagctactcagaaagctgaggtgtggaggatcatttgagccgggaagtcaaggctgcagtgagctatgatcaacgtcactacactccagcctgagcaacagcaagaccctgtctcttaaaaaaaaaaaaaaagagagagagagagagagagagcaagagatgaagctggaatttaaacccaggtatgtctgattccaaagcgcttataaaaatagcagcattttaggaaataaagtaggcattaaaaaagaaaagaaaagaaaatagcagcatataaaacaggcctcacagaataggtgggatttggaaatgaagactggctgagatttaaagggaggtggcaggaaaagcaggtgctgagaaggccaccagtggaagggagcagcaagagcaagggcatggcagtgcaaaaccttgggtgtgtgcaggaattaccaggcagtggtacagaaagcacagatgtggagggaggcagcacaagataaggctggaaatgttggcccaggccttctagtagaagtgctatgggctcagtcaagaaggtagactttattctggaggcaatgagtaatcactgagggctttaaagcaggaaaatagcataactgcaggtagacaccaggaacctgtttttcctgtggcatgaaggatggatcaaagaagagtatgaaggtgacttacatatagtagatagttaattaatgctgaatggatgaaggcaaaaacaccaagttaaaaatttattgtgtatctctaacataacaaacccatttgatccaattccatttcatattgttcaatctgctacttagagaacaacttcactcattctagtgggaaataatggtgctggtgcttcaaaataaaaatcaattcaccagtcaaatgtggcccactaaatgttgctcttaaagtctttattcttacagaaattaacattttcttcttctattcagaaggaggtacatctgaacagctgttgcaactgctgaaaaagaaaacaaaattaaccaagtacaaaagttaggcaatgacaagtgatcctccccaccccacccctctccccatctgcaaccatgtgaaaaggttatcggaaaataaggaaattacaagctgtaatggtatatttcctatgctctctcatagtgtctaagtcaaacacatactaagccataaccttcttgatgatgccaaactttcttctgcacaggtcgtggtaccatctgcaaagcatcaactactcagtgagaagccaaggctgaaaaatactgagatgagtcatgacctacctgattttcttcatgggaaaccctcatctgctccttgaggacagacatccgcgctgcctcttctttcctcaagactctctccttcttaagctcaggactccagaaagtcttaatactgttcatggaagatcccaatttgctgtccttgatgtctagctctttccggaggaggtcattctctctctgcagttctttcagctgggcctgaagatctaacattgtgctgtctcttacctgcctcaacatggaggggacctggtggtggtgatgatgggatgagccagtcagcccaccatgttgatctgtgtatgaaaggacatctgtgtgggaaagtccagcagaagcaatattgggactactccccatggctgtgacacggcctccatatacagctcgatttgtagcccttcccagagtcatagtgccctttgggtaggttgttgaagccaccccttcatgatcactcagatacatgggtccagacgtagcataggctgcattgagggactggatattctccatagacagagtcttgcctgttcctccacctcccccactacttgttcttcggtggcccaaacgaggagaccttggcaaacgaggggatctggaagggctaccttccagattggtgattgttcttgcacttccatacatttttcttgtattatgaggtgttactgaagagaagaaatgctatattaagttggggtttgagctaatatttccacgattgtccagaattttcaccgcattcttttcacagtccgtaccagaaaataactccactcagagatctacaaagtgaaaaaaagaataattaaaaacaaatttctttagaactctaactgcattgtatttttaaatatataaagataatgatagatgtacctatgtagataggtgattaataatagacagatagaaagagccacacccataatgttgatttataaagaaaagcaactctagaactttactactacaggtgaaagttttacaaattccccccaccctgcccctaagcaagataaaaattctcaaagtgaaaaataagctctattctttaagaaaatgaagctctctatattggtttgtgctaaggttagagttagaacctctagaaaattccccatggaattgcccatcatggagaccttagctataaaaaggcccctcctttggggcataacccctatatgcatgtgacttgaaagtgactctgagaagctgctgattcctgggatgtcaaatatttggcattcatgttgttaccttcccctcctgtactcattacagacatcactaatccatcacagtcttcttttccactaggttcagaattcttctcaacacaacactctagatggcttaccaccaatcaactggtattaacacatgaattcaaacctactggctatcctggagatagaagaaaaagaggtagctcaaccaatgggatgcctaaacacatagccagatcctcaatgatattaccagagaaaacaacagtcctgtctcttttccctttcacacacatctttcaggctggcctcttgagaattatttcccattttggttgaccttaatattcatattaaccacttcatgtctgtacagaaatggcaaaggagaagaagttcccatcacggttactgaagtatactagtgaagattttatgtagctggggctacagcattgtgagtatcccttcaattttagcacccatatggccttaatggggcacattatggcctcctgttcttcctcttagaaagtctttactgtattttcttttccttcagctttacaacaataaaagaacagatttgagaaaggcaaacaggttcaaatgtccatgctaatactaaccagctgagtaaccttagacaaattatttaacttgttatgagcttccactctgcaatcaacaaaatgcaggtagtaccatctaactcatagtattgtaagaaatagtaagatgaggtttataaaacacctagttttgtgcctagtaccaaatagtcaataaatagattttgaaggtaagtgtctcaatgagataagtacattaatagcagtatacatgggtatcttttattttcacctgcctatcattcatcccttccccctctcccaaatacacactttctgattatactgtcactattttccttagagaaattgttcccaaccccctactcacagttcactgggtttagataaggttgactcccttcactccaccatcctggatggtgcaaggggtgagaacatgacccacgcctggccaaccaccatattgtatcctccagacatggtagctagtttagtgatgggcatgtgacccacattggtccaacaagactccatactaggactctagttggaacagctgggaaagataagctcttcttcagctggaattccttactttcaagatagagctgtgagtacttcaatgtggaaagggcctccctgagggtggagacaatacaaagggaaccacagctaaacttcaaagagtgtgaaaccaaaccaggtgacatcacttcatactccagatccaggaatcatagaagttaccatcatctatcatctatacatctgttccctggccattttagttacatatgccaggtgactgattgcattaaaggtctcaatcctttactcctttttttatatatgtcttggcagtgttttcccaatgtgatgctaggttcagtcatgtgactttatttgtccagtaaggtgataacaaatgtgaagtaagcagacgccttaagcaacacatgtgtttactctcttgctcattttcctctaccatagtaattagaatattcccaatctagcctgatgcaagatgagaaatataaaatagaaccaagttgtcctagccaacaggcaagccgccccaagatgtgtgagcaagcccagccaaagtcagcagaactgcctagccaaccagccactgcccagcggggcatgagcgagcccagctgagatcagctaaacaccacacttatgcacttgataaatgcttcttagtatgtcactgatgttttgtggtggactgttttgccacattacaggatcaatgggtaactgatgcatttgtctataaatttcctttttgctacattcaattctagatgagatttctgtcacagatagtgacacatacagtatgaaaaaatgttttctataaaggtttcccctttccctcaagaggtcttaaaaaattatacacctgtttctaactaaagaacttcatttcaaatgtttatgttgctcagggcttaattttgtttttcttggaaatacacaaaaaccattttgtatctaagatttttacatgaataatctgtagtgtaaaaaagaggggatcaatagttctaacataagaattcggtgacataaatgataagagagacagataatggaatagtggaacaggcagttacatgaatatttaataagacagaaagatgttcatgacatactggtggcagggggagcagacgacaaaacaattttgtgatttactcacactgttgtaaaacacacaaatacacatacaccctttcaccagcaaagaaggctggaatgacacacatcaaagtgttaccagtggtggaattccaagaggttttcattttcttctttttatttgcatactctaaattttctacaattgaaactgactcaattgtcccatagagctgatgtcagtggtttctttgaaaaaacatagaaattgacctcccagttttaaaacttgagaaagttgcatttgtcttatctgagttcctttctaaggaaaccaaccatcaggcctcccagatagtgtcaaggagctcaaactcgccagattactgcatttgggcaatgagatgtcagacccttcatctgtcataattgccttgccctatctgcttccttttaaccaactcctcttccttatccctccctaattcctgtttttccactcatgattacatttcttccctgctatataaacccttacgttagttggtcaaggagatggatttgaaactgatctcccatctcctcagctgcagcacctgattaaaaccttcttctctggcaatacttgtctcagtgattggccttctgtgcagcaagcagcaggacctggactgaacctctggtgttttggtaacataataatgatatatacttttttcattaaaaaaatgattttctttctatggttccaacagttaaatgaatgtatcttttctgtgcttacaatctagatgtctgggttctaactgggccaccacttatagagatgtcttcctagaaaaagtgatgaaatctaacttgtcttcctctgtctgctccctttgtatctagagatacacatttctgaggtctgtggctaggcttgaggtcccggaatgtcataaaatttacacgcacacagatttaatcctcagtgaatttacctgcctacctggccaaggctttggagaatcccaataaccaacaaacaaagttagtttgttccctttggaaacacacacacatataacatacaacatgaaaagatgtattatcatgtttgaaatattgtttccttatttaaaaagtaatatatgttgccactggcccatagatttcttgggttctccttttctaggtttaataacagatgtatgctagtatcatagatagattgagaagctttccatttttcatatgttctggaacagttagcataataccagtcttccctattcctgaaatattttgtagaacacacacataaaactgaatgggcttggcagggaatgttgactcctgctgtaatgctagctactgaggaggctgaggcaggaggattgcttgaggacagaagttcaagaccagtctgggcaatatagcaagactctgtctctaaaaaaaatttttaaattagcccagtgtggtgtcatgtgcctgcagtcccagctacttggggagagtgaagcaggaggatcacttgagcccaggagttcgaggctacagtgagctataactgcaccactgcactccagcctgggtgacagagggagagacccagtctctttaaaaaagcaaaaaacacagaatgggcctagttgtttattatcttttcactttttcactatgtttacttgtctatttgggtttgctacctattttgtgtcaattatcattaaaacgtcccttcacaaacagtctattccgtgtagattttccagtcttattggcattgctttgtataacttttctttaaaattttttaaatgatatagcttttggttttattaatatattttactgcatcttattttccatttcattgatatctctttatctttaataaaatttctacttcctttatggtttttttttgcccttttgcattgaatgttcatttctctttaatcacatttcctaatgaatgcatataagattatacacatggctgcatattccagaattctatgtataaaactcttattggcatttgtaaataccttgctgtttttattttgaaatttttctatcccaggaattattgagaataatatatttaaatgtcaaagtggatagaaattttatggtaaactttctagttcaaattgtatagcattgggatcataaaatgtaacatatatattttccaatctttgaaatttgtcaagactttctaattggcttattagtttttcttaattattaaaccaactaatagattattatagaaaatttagaaaatacaaatatgcataaagcagaaaatgaaaacactctcaatcctgtcactcatagataacctctattaacaagctagcataataccagtcttccctattcctgaaatgtttcgtagaacacacacataaaactgaatgcggccgggcgaggtggctcacgcctgtaatcccagcactttgggaggccgaggcgggtggatcacgaggtcaggagatcgagaccatcctggctaacacggtgaaaccccatctctactaatagtaaagtacaaaaaattagccaggcgtggtggtgggcgcatgtagtcccagctactcgggaggctgaggcaggagaatggcatggacccaggaggcggagcttgcagtgagccaagatcacgccactgaactccagcctgggcaacagtgcaagactctgtctcaaaaaaaaaaaaaaaaaagaatgggcttggcagggcatgttgactcctgctgtaatcccagctactcaggaggctgaggcaggaggattgcttgaggacagcagttcaaaactagccagtatgtattatgttacttccaattccttttaagtgtgtatgtgtgtgtgtgcagttttagacaaagccagacaatataaagactatgtaaatcaaactatataaagactatatataagtcttgtattttcctttttctccatgttttatcttaacatcatctccatttcccacttaacatagatgccacaaagtatttttataacacaagatttttgacagatactatgagcctccaaagatggccatcaaaagtcctctccttcctatacagaattgtctgtagttccattagttccatcaagaaattgattctatttcctttgtccttgaatctggactggccttgtgacctgcttagaccaacaaatgcagtagaggagacactgttccagctctgagtctaaccctaaagaggcttgacagtttctggttttgctctcttaaaactcagctgccatgatgcaaagaagtccaagctatcttgctaaaattaggagccacacagaacggccctggaagatgaaataccacatacagagagaggccacgtgaaggagaaccaaagcacccagccaagagtcagcaccaaaacaccaatccagtgagacaagccatgttggagcttccagcccagcccagccaccgtctttaatcagctgcatgaataacagccatcactatatgtaacaagaccaccaatcaacccactgaatcaggtgggaagtaagaaattattatttaaagccccactccaagttttacagatttttgttacacagcaaaagaactgaaacacttaggtaattatttttaaaatggaaatatcataattaatattgtgattgataaagctttataatattttgattgataaagcttttcaatgttccgtttgagcaatattcagattgataaagctcttacttccctaggataaattctttttgttgttgttgagacagactgttgctctgtctcccagactggagtgcagtggcataatctcggctcactgcaacctccgcctcccgggttcaagtggctaattttggtatatttagtggagacagaatttcaccatgttggctaggctggtctcaaactcctaacctcaagtgatccacacgcctcggcctcccaaagttctgggattaccggcgtgagccaccatccccagccttccctgggataaattttaaaagaattataaaataaaaatgaaacagctggatacagtggcgtgtgcctgtagtcccactgcttgcgaggctaaggcagaaggaaagcttcagcccaggagttcaagtccagcctgggcaacaaagtgagaactcatctctataaaattaattaattagttaatttttaaaaaatcaaaatgaaacaatttatactcacatccttactcttgactctctttccttcacagcttctactctactctcaacatatcccaaaagccaccatctcctcttgaggctacaaaaaaaatcccgaattacgaaactcaggatttcagcactatacattcagtaaatacacctaaagaagtatttttttatttatttttaaggcagagtatcactattgtcacccaggctggagtgcagtggagcgaactcgcctcactgcaatctctgtctcccaggctcaagtgattctcgtgcctcagcctcctgagcagctggaccacaagcgcacaccccctcgcctggcaaatttttgtaatttttgaagaaacggggttttgtcatgttgcccaggcttgatcttcaactcctaagctcaagtgatccacccacctcagcctcccaaagtgctgggattacaggcgtgaaccaccgtgcccagccaagaagtatttattaagtaccaacattgtgctactccagctcggctttagaccagtacttcctgaacagtctgacaaatgttcagataaacaaggctactggggttttcgttttaacccaagatgtctcagagacttttaggacactcatatgtattgggactgtcccaaaattaagtatacaatatagcttttccaaaattgatttgacaaccgaatcctcttcccttcagaatacctgaaaacatttcactgaacacttgaatttactcatgcaataaatactttttaagcatcagcttaactcccactgttgaatgagggggataaggcagtgattgagacagacgcaggttctgactatgggaagtttgctccctggaatggactttctccataagagctttcttcacctcagatataacaggatttgagaggaaggtgattacaggactaggcactgctttaagggcaggtacatgaaatcaaccccaatcagaattgacctctaacaggaaaagatagaagatcaaaataatgactagttgaagtttcagccctactaggccaggaaataaatataattctgtatttatttttcacacctcgacaaagaagccagattgttaaaaggaatacaagtcagccattgacaggctgcagtaagaggctgtggaaacacgttgttgcttacaacaccaagatcacaatgggcaagagattatgttcaattccactgaacttatcaaatcaaacaggaaattcacagaccatcaaaatggtaaaagggtaatgtcttcaccactgtacatctgcttcttaacaataaattttagttagcgacgtaggctcaccactatttgggaattagtttctcccacaaaatttataaagagcaggggtggtttcctgggaccatttcacccccggctgcagcacatagagtgataccaatgtcatggaagaaggaaagaatcagttgacaacataaagcaaaggcaggtccccatggctgtcatgttcccctaagcctcataattcctacttgttctgttgagtcactcgcaccctcccccatgccccacccagctgtgtttcatttcccgatatattttaaggagcttgttttgacacttgggctttttttttttggttgttgtctcctaatttctcatctatcctgatttgtttctaattctataaaataaatctctgagaaagagcaaaaagatcaactttattgagcaatcaataatgcaatcatgtcttccattgcccattactgacttaaaactatttttaagcttttccacccacctataaatgggttttaggaaaaaaggtagcagttaagatcttacagttttaaatacttattatgaagccaagacaggttcagtcattggacttttttgtgaactctttaaaaatacctacaattttttttttttttttttggttgagatggagtctcactgtgtcgcccaggctggagagcagtggcctgatcttggctcactgcaagctccgcctcccgggttcacgccattctcctgactcagcctccccagtagctgggaccaaggcgcccaccaccacacctggctaattttttttttttttttttagttttagtagagacggggtttcaccgtgttagccaggatggtctcgatctcctgacctcgtgatctgctggccttggcttcccaaagtgctgggattacaggcgtgagccaccacgccccgccaatacctgccaatcttatatgtttgtgatgtgcaactgtaagaagggtaaattattaattaggtcaaactgtgtacagaaacaaataaatgttgctgacatcaaaaaaaattataacaccaaaaaaattagttgcgcaacacccttcactttaaaagaaactcatgaataaaattcaaagtccaagggtaagttccgcttatggctcaaacaaaataaaataaaagatggctttatgaacctataagaatgctttctctaattgcataggaattcataaataagatatacagtcatccactcactctcttaaaaggcttaaggactcttgaactataagctcagaagggaaaaagcaggggagaaccttgattcctgtctaactcaagtatctcagactatcatggtctggaacagtctattttaagacaaaagcacttcctgctatctgctctaaattaggttaagtttatttccacagatctccgcctcagcccatcacctgaggcctgctgacagaccgtgtgagctgagatcatcagtatctcccaagattttgccaacttaaaatatccttttttttctaatcagcatccctaacttttccaaaattctgtgtcacagactactaattctaaaaacctttctaaaggaagacacaatggaaaacagatctcaaacaagcagtggccacccaggagccagatgttacctgcagatgtgctgtgtatagctagcacagtgttgtttagaatttctattaatagttgccaacatagaaagatagacagttcatattaaaatccagattctgatgcttccttaaaaatctgaaaatctgacaatgtcaggctcacctttctacatggcaataactggttggagcaaccagcagctgccccttcaagagaggacatgtaccctccagtttgccacagtctcctccactcccattatcttatattcagtctgattcctttcctgcctgcttcccccaataggtatttacattttttaccactctactcacatataaggtcttaaacaattcattcttttacaattcattcttttaccacccacttcaagttctttaccaaatcttattaattctacctccaaaattgctcttgaatcttctccgttgtttccactcctcttgaaccaatgtgactcttgcataagctacttcatacctcctaaagcttctcctcttatcgtcctctactcttatttccaaaatatcagctaaactgttttaagatacaattacgattataaaatatctccccttacccacttaaaacccttttaaagcttcctattgctctgtggacaaaaccaaaacgcttcccatggcctgaggccctgcaggatctgagtacagccaacagcccccgcctcccctcttgccactctctccttcaaagactctgacagggtcttcttcctgctgctccaatgcatcaagtcccttcctgtctcagagccttcactcctgctgttctctttgcagggctaattcctattatttcctattccatcacttacatgatagtttcaatagcataccctctacaagatctatcccattcaaatcaggtctctcagttacattctctcaaagcgtaatgctttttttttttcatgatgtgaaagacatgctatcttttttctttttataagagaagctgactggccaagggtcatctcaatggccctcttgtttaggttaaagtagagttagactaggtagcctgaatcctctggtgaaggtgtaaggaaacccttcataacccaactgaggctgtccctcctcagatccctggtttggaaaatgtgaaatcttgtaggtgtctttatgcacaatgatccgggaacattcacggagggaagtcactgacaccccagtcttaggtgcccaggattcagagtaagtgagatctatgggaaggaattagcatagctccaccagacttagagttcccagaaattaaataattacttcaagatagaagtccaggctggtgattgggactcaggacatgtgacccagtagccatggagaagcccctattgacaaagtgtgtgggtaaggctagaagcttctggagacctcgcatgctgtatggagcctgtacagtggggcacaaaactgtgcacagggttgtaactcatgaggaaggctatatgtcctagttggggttccccaccggcagatgctgagacaaggatgtgggtgtaggaggttcatttataaggtattcccagaaagtactgagaggacaatttggaactaaaacaaggaagtcaaggaagtcaatagagggcgcattttcttctttttttttttttctttcttttttttttttttgagacggggtctccctctgactcccagactggagggcactggcacaatctcggctcactgcaccctccaactcccaggttcacgccattctcctgcctcagcctcccgagtagctgggattacaggcgcgcatcaccacacccggctaatttttgtattttggggtagggacagagtttcaccatgttagccaggctggtctcgaactcctgacctcaagtgatcctccggcctcagcctcccaaagtgctgggattacaggcgtgagccaccacacccggccgagagtgcattttcaagaaggtttctgctgcaagcaactggaaagagcttcgagaaacagtggagaaccggcctcataggtgcgcctccggaagggcaagaaactccatcatgggctgagggatgctccctggcactcccaagtgaagccaaagagaaagccctcatgttcccatacaggccatgagtgctgaggagatgcgggtggggcaccaatagcatccgctacacccccacatggcacactgtgtctgagcttggccacgggggactgggttggccttcccttgcaggaccacagagtggggaccacagagggcacgcacagcatctttcagtccgagggagaacagcctcaacagcgacaccttgtggcatcaagatgtaatcatgtgatgggctggtcggacagattgatttccagatttggatgtgggatttatatccatatcccgctcgctctggggctgtgtaagcccgaagcagcggggaggagaggaaagagagggagacgagaagtggggaaggttgggaaggcggtctagtggagagattcggaacttccagctaaactggcacatgggttccagcattttggatttaatttggacaaatgaaactgggagcaagggttgtttatttgcaatatattgtaatatactaatcttagtatatctgttacaatatttataaaatatagagattatattatttacatttaatatttaattttaatatattctcttttcatttatttttataaactttattaaagcagaacatatacatgatgaaggtagaccttaattgcacacgttaattgatttttttttttgagacagagtctcgctctgccacccaggctggagtgcagtggtgtgatctcggctcactgcaacctctgcctcctgagttcaagcgattctcctgcctcagcctctcgagtagctgcgattacaggtgcccaccaccaagcccagggaatttttgtatttttagtacagatggggctttgacattttgttcaggctggtctcgaactcctgacctcaagtgatccacccgcctcggcctcccaaagtgctaggattacaggtgtgagccactatgcccagcctgcaccggttaatttttatatagtgagcacacctgtgttaccactgtctagaccaagacttagaacattatcagcatccccaaagcctctctcatgtccagtaatccgtatatgacccaaaagcacttccataccttagaatttcatattaatatgtgcaattccttgttggggtctctcttccctcctattataaacccctacactgcaacccaggtttttacattggtgctaacactcttagagcccatggcaagagtacaaatggatgcccagataccatgtgcctatacatttaaagttataaactgagctaacaaactggtaaacaaaatacattctaccttcctaccttgaatacagagatggggaaggtgagatctgaattttgaacttagaatacttagactcctcagaattccaccaaaacattgtggccggaggaaggcctgccccccacacctccgccaacaccctttctccccacctctggcccaaccataccccacgggcctcatacacatgaactctgcagcatgcaagctaggcttgctccagctataccaggggtccacaggctttctctgtaaaaggccaaacagtacacattttaggttttgtgggccacttgatctctgtcataactactcaactctgccatttcagcccaaaagcagccgtagacaatttgaaaccaaataggcatggctgtgttccagtaaaattttatttataaaaacaagtggtagttggccgggcgcggtggctcacacctgtaattccagcactttgggaggccaaggcaggtggatcacaaggtcaggagatcgagaccatcctgattaacacggtgaaaccccatctctacaaaaaatacaaaacattagccaggcgtggtggcaggcgcctgtagtcccagctactcgggaggctgaggcaggagaatggcgtgaacccaggaggcagagcttgcagtcagccgagattgtgccactgcactccagcctgggcaacagagcgagactccatctcaaaaaaaaaaaaaaaaaagtggtagttggatttggcccacaggtagtagtttgctgacacctgatctgtaacgtcacacatatgtgcccctccacaaccctaagcctaggatgtgcacagtggtagcctggcttacccccaagaagatgtactaggaaaaaatttccaggcagattctggaagacaactcagggtcatttaggcaaggaggtcacaggcctgtaggtacccagagcggactctagaatgccaggcacaggctccaggtgggcacctgcattggtcccttggactcttcctccagtggacggtgcagtcagaggagaaccagagtaggccctctcgcccaagagtaagggaacacgggagctatgcaaaacaactttgaaataattgaaaggatgatgctggcactttaatatcatgacattttcatcatatcactaaaatcacttccatggcagttataggacaattctgtaattgtagccagagaggagagacatagtgttttaaaaaggaaaagaggagcctcaaaatcagatttggctggagtcatatttctgtcttctggatacgcaatcttgaacaaagtattttacttctctcatcctcacttttctcatctgtaaaatggggatatcagacttttcgtatagatttgggaaagattaaatgagatgatataagaaagtacttagcacaatacctagcacacagctaatgatcaacagaagttaaccttgacaagcccaaagctaccagaatataacacagtggctttcagcctcaaagttgccatagaattctcccagttcactaaacttagccctgtcagacactttggagtcaaactcaatctgctgttcaaaagtgctgaagacatcaaccccagttctctaaaactagagagaaaaatggacattgccttcccccatgatctgcaggctacaatattatgcatccatagttattcaaagtcccagtaataaaccatttcatctgtgaatgccatgatgtgaatcagtaaggggaaagtccagcttaatacagcagagattttcaaaattgctttcccatcattctccaaaaagctctatgaaactcaaacacgcctatccacacatcagtactctctcctttagttcccccaaactcattttataattactgttttccatgtgtagatttagcatgattacatgttcagctgccttggctcatgttttatggcaaggtacttgagtcaagaggctgactgtcttccatactacaaggcaagggctctgcatgcccaaatattagttaactgttctttccattaaccatttccattatttaaatttcagactccatcaatttatttcaaagtgttaaattaaggatctgaaacccctaaaaattttgttaaagtaataaactattatctagtacacagctaaatccacaagttaaaaatatagcaaaacagccaggtgtggtaagctcatgcctataatctcagcattttgggagaccaaggtgggaggatcacttcaggccaggagtttgagaccagcctgggcaacatgacgacaccccatctctacaaaaaattcaaaaataaattagtcaggtgtggtggtgtgcagttgtagtcctagctacttgggaggctgaggcaggagagtagcttgagtccaggagttcaaggcagcagggagctatgatcacgccgttgcgctccagcctgggtgacacagagagaccttatctctaaaaaaataaataaattttaaaaatggcaaaatcccaaacaataaacagtaaaattaagaaataatttgagatgttaaataaaattaaaataagtgacgtttaataaaatatgctgattataacaacattattcatcgccccataaagtctcataaatagaacaaattaagtagttgcactgaaagaataaataaggttttcagattcgttttttaaacatctatgcatttcctttcatctgcaaatgtaaaatgtcaattggcaaagcttcagttatagtatacttaaaaaaagaatattcaggaattattgggtcttacactaaaaaatcttctatctgtcaactaacagacgtttctgagaaaatgatagagagatagaataaaaactctgcccccttggccctaaaaatccaatcacacaaaattttgctacatttataatggcataaggattacgtgtaaatagctttttactagaaaagaatataggcataatcacatacgtgaggaaaaattttagcaaagattgtaagctattaaaaaaaaaagaccacaatcaatgagggatgaggaatggctccaatgggcaaattatggagacaagcattcatctatgtattctggaaagaagagaaagaataaacgttacatcctaaatctgaggtctctcaaaaatatgactgataaccatgaaagagtcacattggaggctttaacaaggatcaagttcagggtgctgaatggtatacagaaacccccttaacaatggaaattagagtaaatgagagtcagtaagtgcagtaagtaaatcaagtaattgagtcaaatctcttgtctatgaatggataatggtaggcttatctaacataaaaataaataaaaagggaaattacaggacataattcggatctattcaacaaatacttctggagaacaaatctgtaatgtggtttctgacatgatagaggtccaaagccttccatttaaaagggggtcacagcctctttactcaggttcacattaacaactctaattgttgtgcaaggctgccagttgctgtgaacaccagaaacagatgagggcctttctgggagtgatagagtgtggtctcagatggagagagtcctatggaaaaaagagtgtagtaacagacagggaaaatccagttttttaacctggacaagaactaaggagggaagtcagatccatagttatgcatattaaagaatctgcaaatctcatgagaatttaaggcttgtttttatttcagaaatctgaaaacaaataatgtaaggatattcttgatcagcacagcaccatgcccattgactttgaatatcaagctgtaccctaaggaatcactgagtcaatgtgaaaggaaataagatggtcttggggatctaaaggatgtgttctcactgggtgaaaggtaaggattgtcaagttcctcagaaagaatgaaagtttcacagaagttgactatgatgaatatggtgggaaaattgaatcatcacccagtgcacagcagggtagaccagatgatgccaaagaacctgtccagaatagtcagcatcacattctaattataagcagcaatttagttaatgcagttaaattaatgttatgaatttgaattagtaatgtcatatgacatatactctatttctaaattgatttaggttttaaaaaggtgtaagagctttaaaataaaactcaccagctttatgtttatacaatttaaagtatcattacataataataatttaagccaaccctggggttctacgagaaattattttcattaaaaaagatatcatctaagtctgagaaaccttggttaagtgattaagcatacactggatttgagacctgaatctcacatttattatctgtttaaccttgagcaagttagcaaacctctctgagcctcagtaagtatctgagtaacaatggcctcaagtgtaacaatggctacttcacaaaaataaggtgaataatgattaaatcagagaaggcagaagtacttagcacagtgcctgaggcttagtaaatactcagtacaatcctcatcatcatcaatattgaccacaggctcattgtgttgttttcttacattagaccctttcttcctcatgagtaaaatagaaataacagcgttaaacatcttgcaatgggtctaaaaaaagtagttgattaaaaaggttgccaaaaaaaaactttgcacatgcaagtaaaactttagcccatgcattaaattgcatcatgtgttcaacatattcaccatccccctagcctgcccatccctacagtctccttcctgtgggaagataatctttcctgctccaatgacatctggcttggccgtatgacttgttttggccaatgaaatgtgagcagaagtaacaaatgccataaccaaacagtagctatcagagccctcttgtgggtaaaacattcttttttcttctctaccatgaagataggctgtccaagaaaggctccttcagcctgtgtcccagaataaagataacatggagcagaatcacagacaacccctgagagaaagaagccactgagatttggaggtcctttgttagcccagcacaacctagcaatatctgactaataaacccagctaccacaaacacagtgctaaaaccaaatatgtaacatttagattaaaatataggacagtgctttctcactgatttatctctcatttctctcttcctctgcagattaccaaactaggaaatatcatccattccatgacagaatatcttctgttaggtctccagatagatgcaaatcatttgtaaataatttattttcagatacagatgcatacaaccaactattttaattgcctccaaatgtattctctttatcattcctgaccactgatttctttactgacaaatagctgctcctggtgcttggacatcgagatgaaggcaatcactggaaaagccgaaaggaggataaatcctgctaggaggtgacatagttgtacaaacaatccaaatagtgaatgccagcgagcatcaatgggcgtgggctggacctcgtatgatcagtacacatgtgagtgcctgtcctggagcacagccctaggaagaatccagctgtaactgacccaagcatgcctccacaccaaaagaaaggcaacacatgcacccacctcctgctatcgtgattccatcttataatggctgtgtgacttacagattgcaccaactgatgaccctgtcttcacttgaaccttttgcaaaacagatgattcaaccctgtaccttccttaaaggcaagaactatgtcttcttcatcttcatatctcagcactagtttacacttgcaattaaaaggcaactcaatgtagagcagtttaaagcatgggctctgaagagtccaaattccagtttctccacttacttaggttaagatcttgcaagcagatgctctaagtgcctatcgatgtccctctgacctgaacattttagagtgccccaaaggcactgccaatatcagaatctctgcctgagagtatcttttaaacctggataagctagtcttcccttgcagggtgtagaagtcccagggttaaccacccttaaaaaaaaatctgacagctatttatacaacagtgttcacaaccgcattattcatgatagccaaaaggtgaaaacaaccgaaatgtccactgatgttgaatgcataaagaaaatgaagtatacacataaaatggaatattattcatccttaaaaaagaaatgaggaggccaaggtgggtggattatatgaggccaggagttcaagaccagcatggccaacatggcaaaaccccatctttactaaaaaatacaaaaattagccgggcatgttggcatgcacctgtagtcctagctacttgggaggctgaggcacgaggatcacgtgaacccgggaggcagaggttgagaggttgcagcgagccaagactctgtcactgcactcccacttgggcaacagagtgagactctgtctcagaaaaaaaaaaaaaaaaaaaggaaatgaaattctgatacgtgctacaacatgaactttgaaaacattatgctaagtgaaataaaccagccacaaaagctcaaatattgtctgatatcatttatatgaggtacctagaatagtcaaattcatagagacagaaagtataatggtggtttccaggggctgggggaatgtggagttattgtttaattagtacctagtttcagtatgggatgatgagaaagctctggagattgatggtggtgatggctgtacaacattgcaaatatacttagtacaccaaactgtgcactttaaaatggttacaatggtaaattttatgttatgtatattttaccacagtaaaaaaataaaaataattaaaataaatttaaaaaaaagaaaagaaaaaaaaacaactgacatgaactagtggtgagacatccctactctcctagcctttgtgtaaaaataccctaaggcaggtgttttacactatctctacaatttccttatgggattaaacactagttgccattgcacaactcgcttaacaatgcaccatctattggctgccttcacttccctgtctcatatcctcattcactcactagtgaccccctgtaagtcccaagtaactatttgtctcagggtctgcttctgtgggaaagtcaactaagacaccaaggcaagtttcttaatttctctaaacattactttccttatcaataaaaataatacttagatcatgaagttattgtgaagattaaacgagataattcttcaaagtacttagcacagtgcctgactcatagtagatacttaatatgatcttcttgaatttctggtctaacaattatccaccttttttatagaagataaactacgtctctcagtttcaggaagagactaaaaaaatctaagagccaattctttcccatcttctatttaaataacatctctcatgacttagcactcatcattcaaccaaccacaagaggtattagaaagaactggaattttgtatccagctcaatcttttgcctagaggtgggctgagcccacaaaaaaagttagataagctccccagatagcaagaagacccccccaggacagacagataaccaccactccctcctgacctagggaattagagggctgtggggtcaattgtaaacaactttgatctggtaaattttatgcgtatccctttctctctttggttacaaatgtaccctcctaaggtttatggcaaagactagaattcatttagtctttttctagttccacagtgcatcattttaacaaatgaaaccatgggatcatgaaattcccagtgaggtgaatcctttgccaaatgccattttattttgctttgatttctcgttacttgtttgccaaaatacacagagattttatcacaataatcacctattctgactagcaaaccaaaggattaggttacatactctggtggactcataaataagactgatgagaaatccaatttctgtctcttgcttttgtagaaaacacctttctgaatatgtactttttaaaaagctgaacaaacaaaacttaccttgacttacatgttaaaaagggaagctctgttccccaaaacaaataaatgataaaatcccaaattccatcttgctctttaatataatccctaaagcttttttccaacatttcatacatacatagcctttaacttcactcacaactataaatagttggccaatttaagttcaaagcatctgactaaagctaaccactagccatattgggcatgcctaatggtttcaatgtttggctcaattacattatgagctaaatagttctccctgtattattgcctacagttttccattttccacttataaattaatgacaaaattcaagaaatattcaggtgattgcacaaactgttgtacaaatatggtgatgctgatgaactaaaactacttgtcggcaggtaaggtcatggtacagtagctcagaatggtggttcataagctacagcacagaagattaatgtatgaaaggcaatttaacagtgctactgtataatgtacaaaagtgtaaatcatatcgaagtaaagtaagaggcagacactatgcacgggatattgaatagtgttctagcccataactcccaatcttgtacatttcaaggaataatgaaactatttccattcatgaactttctcagacccctttcagaagctgtacactatgaattacttcaagtatttccctcgattaatctaacaaagtcagtttcattctgcccattaagtacaaagattttgaaacacaatgtgtactctctgtgctctgcttaaaatttattgaaatgaactttgtcctaggtgatattgggagagagtctcaaaaccaacaagtgatgtggagtcccactgcagatctttcaccagcagatatttttcctcacctggaaaatggtctttcaaaattattaaggctgtataaattgtgtttggtcaatgaatcagaatggacattgctaggagtcccaaagccataataatcaatctttctattgttcttcaggtcatcttgccaccctctcttcccaatgtcaagtcccacactcccacaagcatcaaaagtaggtaattattgccatgacggtgaaataaaaggagaataaagagaattcagagtccttgatcgtatccgtcccctacttgaaatctcttgaagttttaagcttgagtcccatctcctcaatggctcacagggtcttatgccctgtcacactctctggctcctctcaccatccctcatcctgagccaagctaaactccagctctacagttctacctacatttacctccgtgaaccctgaatctcccattctctcgcttacctttggacctagtgcatgctattccccctgttatttgtaccttcaaatcctccctcctctggctaattccatttacccttcagtgacactttaggtgctactttcttcaggaagccttccttcattcttcatccatgactctcctaagtcttccatgatagcctggatgttcccccaaagagcatccattattgcctgcttacttgtttggtgctccactggatactacaatccctgaactcccctacaaaattacctgctctattatggtcctcttgacgtgtacacaccctattcccagaagaagactggcacaaagcaagcatacacttttacgacgactacataacagaatggcttaattctttgttactaatgtctattatgaaagaacaccagccactcctgttttccaggttaaaataactaataaaatgataattacttagttgaacctttgcatgaagaaactgttgtaaaaatatatatataatagatctagaagagtgcctttgaagcaaattggactagatgatagagaaacagagatcccaaataaggagaaagctagtggcaaagccagaaagggaacttagggcttgtgaccccaggtcagtgctatgtctctgtatccaaaagaatctgctctgaagttattctaagcaactattcatgttgtgaattcaaggtggcccatgaatgcattcaaagcccatgtataaaaagagagttatttctcagctttaacaaaaaaggtgaagaattccccttgcgtgcccacactaactgctccacgctcacaagcctgatgaacagcagccactaagacccaggtgcttttgtatccacccagcatcaaacaggacctattttcaacaagcccatacgaatgccacgctgttatcccactcactacccaacctcctgcttcctgtcagggagaggcttcatgaacaatacgaataaagggtcaaaatgcgaaacaaagaagggggaggagggaatgttacagccttagaagggaaggaaaaacatacatcaccagaaggaaagaaaagacatcaaaaatcctctcctgagatgtcaatgtaaaaaaagagtcaacaaccctgctcctctcggaacccgccccttgaaccacgactgctcctcgaggtgatgacagctggagctggctgacaaaacggagcatggctaatctgcctcaagccaggcacaagaaagacatcttggtagaaatttgatgcccaccagtatcactgagaaaataaccagtgatcatgggaccgccctaacctcacatctggcagagctgctcaactctcactgccagagcagctcccagaccccaaacccaccttcaatcacctcaggcccatagaggatgaactcctgaccacacctatcttattatagagaaatatgccacataagaactggtaaccacagtgcacaactaggttcaatttcttataggaaaccctgctctttcttactgcaattagtcataccatttagcagaaatctttcacggtttgcataaggatctgagcatattcttaaagaacagtcacattgctcaattcccattcaagctcttgtcttctgacccactaagaagttgccttgaattaatagtttgctcctaatgcatttagggtaaatgcactttgctgcctgcaactcattcatgccctgaaatcacagaatgacaactacctttaggggtggaaagtattaagacaggaaaagagagctaatgctatcagaccacacacacacacacacacacacacacactcacacaggataattaagtgagcaaaatgtagactctgaaaaataaaccatagcaaaactaagttgctggtataagatgtctatgaacattgcggctggcctttggttttcaggtatatctcacagatgcccttccaactcttcatccagtggggctataatctcaccattgacttccaggaaaaaataaccacttagttccttcctgaaggttcttcctgcctttatttattttcttctcttcttccatgcacacgcactctctctctttttaattttgttgagtgctgattaggtgccagcaactagagattcctgggctctgaccaagcgaactctgcttggcagagtcaacatgagttcaagaacagaggaaatgcaacttcaaagcaacaaatctggaagatgtaagtggagaagtaatgcccaagaggttaagagcagaactttgaggcacgccctgggaattggccagccaagtgctgaagaaattaggctggagtagcagatgaactggcccaagagaagggtaaccaattatattaacaattaagtcagtgatgtagtggccttggacttccccagctgaaagaatgagcagaaaatcacaaagaaggctcggccctggctgtgaaagtgagacagcttagagctcctggtgcttttggcattgacaatggttaaggcttgttggttgtttctgttgtaattgtggggccactcattgtttctactttctctagtgataatttagcagccttgagagtaaggcagaggtggattcaaactctggctctgccacagcattaactctgagcaagtttttctgttccttcagtcatttgacaaatacttacagaacatctaggcactagggatacagccaaaggcaaagctcctgcctttatggaacttatcaaattatttgagtctcagtttcctcacctataaaatgggataatacatttacctgtataggtaatatgaaatgagcaatataaagcacctagcacagtgcctaccacatagtaaatgctcaataaatggtgctcttcatataacagagcaaacgtatccatcacttccaactggagtattagctccaagtagtaaggaactatctgttgttcatctctgtacccccagtgcctaacacaaagtagatactcaataaatacttcacaaatcaatcactacttaataacagccattgttatggtaacttatagtcattattcctctctaagccacagagattctatacttgaaaaagcaacatggcggcctagcgtggtggctcacgcctgtaatcctagcactttgggaggccgaggcgggcggatcacggggtcacgagatcaagaccatcctggctaacacggtgaaaccccgtctctactaaaaatacaaaaaaaaaaaaaaaaagcaagatggcataaaggctttttttttttttttaaagaacagtgaggtgcactatacaatatgtcttcaggaactttttaagcatgaaaacaaatgttattgagcataaagctttcaattcaaagaatctattagcacagagaccagcacggacagcggatgtagatgccagcccactcttttcctaactacaaagtaaggacaagctggccaggcttcaggttaatccagaaggcacccaaaaagtaagttacataaagtttagcagatgtgctcaaagatggtgtatcagtaaagataagcagaaaagtgctgcagaaaccaaaaatcacaaaactcttcatggcttaaaacaaccaaagtttacttcttggtctatatgtccaactccagttgacgggaagctgtgttcatttagtgactgaaaggcccaggcagatgaagggctccatctcaacacacatttccgtaatcattgcagtagaagagggcactgggtgctctcacactggaaatcaaatattctagcatggaagtgatgcaagccacctccaacatatgcctggaaggaaagaaaaagtggctatggggaacattaacagtctctaccacagatgatattaagacacaacctgtggaataacaaagggatttgttaaagatgatgcacaaataaaacatctgaacagctataagattcacataatcatgaaccaggaagggtgtgtaggtgtcattttagagcagtggcctcaacataaagacacttcatacaacataaatctggaccctaaatttccagaacagctctgctttctataaatatactgagggtccagataaatttttatttaggaaacaaagttttaacagctgaaaaacatttgaaaactatgaatgtaaaccaaatcctttattttacaaatttaaaaagtaaagagaagaaaaaaaggagacacagacagttaaagtaaccccaatctacccctcaaggaaggtctagaatgtttagcagaaataagtccatggacagaatctaatgtaccactgcagcaccttctgaccttacccttcatctctgctacctttaactggcacagtggagccagacccagaccaaagtcatttaatacaaggtcgtcaagggctcaataaatggtattgacaatgagtagaagaccccaccccacagcatgaaatagtgattcatatctcattagcaattctctacattactcattccctacttctgggcaaatgtgaagccatcagtagaagtgaatactagccttcaggagactttcattttgctctcagatgatcataggttaacagcaactatgatttgggttcactcaattccattatcttctcatgtccccagctctgtttcatgcccagttttccctccaccttcactcgtactaaagcatgtatgtcatgcactcaagcctcagtggtctcccaacctctggtctctgtctttttcaatggctttatactcactagcccatgaaatcaaactcaaatatttcaaccaggaatccagatgcctcctaaatcttaatccagcctaattttccaacattatctccactatggtacttgtcctgcacagccagaggcaagatgatgatcctgaaagtcaaaatgatgttgttttgaacccccaatgcttctacttactggttgggcaagtccttaacccctctaagttttaatgttctcacctgcaaaataggtgatagcacctactttgagggttttcttgagaaggtatgtatcagtgaggagtatgtgcggctgcaagtaataagtagtggcttacaagtaaagagctttttagttttatgcaataagaactacaggggaaggcagtctaagctggtactatgaatgaacgatgtcaccaagaccaagatccttccaggctccagctttgccatttgtaagacacgattttggctgggcatggtggctcacacctctaatcccagcactttgggaggccaaggcaggcagatcacttgagctcgggagttcaagaccagcctgggcaacatggggaaatctcatctttacaaaagtatacaaaaatcagccaggcatggtagtgcgcacctgtagttccagctactgggaagactgaggtgggagaatcacttgagccggggaagtcaaggctgcagtgagctgagatcggtgccactgcactccagcctgggtgacagagtgaggccctgtctcaaaagcaaacaaaaaaaaacaaaaaccatggctttatcttcattgttgtagttggctgctgcccctccaggcattgcaccaatgatctcagcagcaagaagttaaagagctgaaaagttcttggagtataccacccacgtgtgtctcactcactacattttcaggaaagcctccacccaaaaacttccacctatgccattatcagacccaactctcatggccactctaagtccaagggagtcttgggaaggtgaggtgggcttatttccatctcagacaaaattggggttcttttagttggaaaggagaaaatgaatgttgggtaggcaaccagcaagcctacccaatattaaatatcttatggaaagtgctaagcacagtgcctaacacatagttaactgcccaatagaagttaagctataaatactagtgttataattattattgttgttgtaattcacctttcttactctctggccaagtggaataactcattatatccatgtgtgcccctacatttttatggtatccattgctctatctgcatctccaactctctccctgctttaaggtccaggaaaatgccattgcatccaagaagtccttccttacacctattcctaatgataagtttcatggtggcaggacccacatcagaataaaactgtgttcaccactgcactgaacattgtctcttggaacacagtaggttctaataaatagtgccttaataatttaagtaattcatgtgtatacacaaacctgttttatagccagccctctaaaatcaaacagagaatattcctgaaatgcagaagttaaggaccaggtttatatgtcacgcagctagcaatgggagtgaggggatgaaaattgcattccccaagaaaaagaaaaaattagaaaatcctctaaccataatttttacatgctgttggaagctggatgatagttcatcaaatattcgctcccttactgtgaacagagtctacgtttacagacaagtgttgtccaaaatagtacttttccaaaacaggttattagtgaaagtgacatttgctcgtgtagtttgcctcttggctccagtgatctgccaggagaaaagcatgccccaggtagctgccatcccttcagcctgggccccaggacacatgtggaggagactggaacccaacccacagcctctacacagccaccccaaggagcccaacctataccagccaaatcacggtcaacctgaagacccatgagtgtgaaaataaatacctgttgctgtaagtcagggagttttgttacactgccaaagctgactaatatatcttatcatttgatatatgttagcatgtcttatatcttcattcattttgttccttttcttcacataagaagaagaggttgtagagtctccatgttttgtacatccagtgagttctacctttggatcaactattttaaatttatgagatctacattaccatgaatattggtgcttttctgtgctttccattcatcctatctttctaaactaagaaaatcacaataaaatataaaggaatagtgtaaacattgctgaaactgaaactgttggctggcaagtagatgccccacggaccagccaaaatgttaactggttagaggattttaaaaaaagaaaaaagaaaaaaaaaaaggctagagggtgtcctagtaaaacaagcaaatgcagattgtacaaaagtcaacctaaccaaagtcaaagactctttaggtaaatttgtggactgcaataccattcaccttatttttcaggatacctgttttggcaaaccttcaccactgagtttcaccaatgggaagagactgataaggcttacatcttgtagcttttccaacataacaaaacaagaggggccggtcatggtggttcacacctgtaatgccagcactttgggaggccaaggcaggaggatcacctgaggtcaggagttcaagaccagcctggccaacatggtgaaacccagtctgtactaaaaatacaaaaattagagaggcatggtggcgggcacctgtaatcccagctacttgggaggctgaggcaggagaatcacttgaacccgggaggcagagattgcagtgagccaagatcacgccactgcactccagcctggtgacagagcaagactccatttcaaaaaacaataaaaaataaaataaaacaagacggtcatgctattacaaaagaataattttaaatatcattatacctaatcactaatggaaaagggtctctgtaaataacaaagaaaataaaaccctaatcccttggtggggagacaactgaaggatgttaagagcatttattcaaccaagatctatttaaaactctaattggaaatttaaggtgtcaagaaaaatggaagagtgtgaattttgttttgttttaccttcttttaagtcatcatcattaagtttggaaccaaatttttatcgagccaaaatttttattttattatgtgttatattttttatattttattatgtttctactggaaatatataataaacagagttactaaatttgcctattggcccatgccacagccttcaaatgcaaaggcaaaacaggctgataaaaggactgtcagaatcacagtggactcttaaaatggttagctctacgtatgctgggagaacccacacttcagactggacacatgcagactacacaaccaaaatttgaagtcaaggccacggccaaggtcatgggctctgggtaagacgaacccgggctcaggttcttgctttcatactaaactgtggcaagatactgaattccttctagttactcatctataatttgggcgtaagaatagtacctacctcacaggggctccacaaggtttaaaaaagataatgcatataaagtactcaacaaagtgcttgcctatgcaataacaatgatgatgatagtaatagtaataatactgctttgacaaacccggcttctacatgaaaaccattctaatcagtatattctggctcacagtctgtttatgaaaggcttaattcacagaattatgttcacatccaggtacaacttctataaagtgacagctctttggatcaatcagtaatttttctaatgaattcagggagaagggtgttgaaaaatcaggctttcactagtagtgagttgagatggatctggtccttcacccatgattcatccacccgtgaaagtcttgctggtgaaaaccatgacaccatcaccttccacacccctccctgccaaaactgtaaaagtattttattaaagcacagaagcaaacagacaagatggcttacatgagaaaaaggcaaactctactactccccggaaagaaaatggcttgaccccaccaccaccgaactgacattctgcaaaagagaacaaggcagccctcacttccagaagttgagttaactgtcagaactaaaagaatcccttctattcatgtgactccccataaagaacgtttgccggctccaaaaataccttataaatccatccagtagagccaagccccaagtactgtatactgagaaacaatgtgactttacaaggacaagagtgaccataggagacaaagtgccacacccttttcccggatagctcaacggtacatgttgtctcttataaagactgcaattctggagaaataggtgggcaattctaacaccccctcccccaattccttctttacacagattcattttcatttttaagccagtggcctcggcatccgcaactactacaactaataatcaggggggtggtgggtaagggatggggaggacaaggaaacacaggtcaaatatacttgcttctaaaagtccattttcaaagagttttcttcccgcttgtctgcctctcacagctgtatccccataccaggtggaaaccaatggttaagtaaaatcactgatttaaagagccaaccaggaaactaaccatgacaagtgggagctgccctcctctcccgagcattgattggttctttgggttccaccggtccccattctacccacgtaagtggcaggtgtggctgtcaatcacagagggaaccgacaattcaccgctcggggagtaaattgcctttcatacagcaaaggcaggtagccgcctaaaatcgatccactcctaaaagagcggaccctccctctctggcaaggagaacagagacccttaagtacaaaataaataaggcagggccgaacggagagtttacgagcgctattttattaccccgaaccaaagcagctcttaatcttcactgtcctaagacgatctttcaaaggctcgtacggtattttttttaattaggtacaccttcgtaagtatccctttttttgtataattaggagatggggaggaggagagaagggatgccgttcagttcaatttcacatcgtattccttttcatacaccatcccctagccctccccgataaatcggcttcattttccctgacacgggttttttaaaaaaaaatatgctcccctctgaacccacccaggcggccagccaccccacccccgggcgggggctccacctttctccactttgttctgcttaggattgctcaagacccccgaccccgcgaacaccccacccctcgaggcaagaggggacgccaggcagaagagggggatctgagagaagaaaggcgatggcagtgagggtggctgccggagagggactgcgggaggtggcccgggcagccggggctagcgagcggcgcccgcgcgctggaggaaaccgtgcacttgttccaatccgggggtttatacatcagggcaaagcctcccttaggccgccccatccctccccccgcccaagaaagccccgtaggaggcggatggttcacccttaggctccccacgataacgcattgcagctccccacgagcgagggggacccggcacgaggaatgcccgggcacgggcgccccgagggagccgggcaccaggcggccccggccccggcgtcggcgtctcacctttccgatgctcgccccggggccgtcccacatggatttttacaacctctcgtcgccttggccccgggcggccaggaggagcaggagccggcgccggagccggagaccgagcgagc

SEQ ID NO: 2058 - DNA, 21557 bp, Homo sapiens
atgctttgctgatatatttatttacatatttccccatttcagatgatggtgacaaaaagtagatggagaccccaccctatccaccccccaacaaattacagacacagatttcacttagcatatagaagcattggggcatgtccaaattcattccactgggttactacagccaggagagatttgatcttgggggcagtctgagcacctcaggcccagaaattgagctaaagagaggtcgccattctgggccttgccactggtgtgccagcagaggtgacagaagagaatcatggtgaactgagctgtctagccctatcatgtggtctagaaggtgacagtgggctcttggatagcttccagtgagatccacagtcccacagaaatctgtgactcagggttttcatctgcaaaatggggataagaatcctgccctaaagatgtcacaaggctatcatgaagctccaatcagacacaacttgtcaaaagtgctttgccaaagttccagtgccatacaaatttaagggaatttgattgattgattgtgatggttagagtgccccgggtataacagtggactggtttatgggtccaggggtcaagcaagtgatagaactccgacagtgtgccctgggtgggcaccaatcaatggcgagtaatgcctgttgcaaagccgagtttccttagtttcttggccccaggaagtcaccaaggcctagtgcctgggtcagggctaggggaagtcactgggaaagttacagaaagagtcacaggggtcaaagagaaggaagagggtggcatataaagcagggagtagttactataatcacacacaaaaatagatacccattggatgaagggcattgaattggtagtgcagacgaaagatggagccagcaaggagagggagatgtcacagcagcagagagagaggaatgctgtcccaaataggctctcttgctgcccccccctcttcctaaagggataatgccagtgtctatctatctgcagagaaaggggtagcagggagagagaactgagaacataataatctgaccaaaggagagggatctcttcctcctgttatactgctgcccagcatcttaatgaggtgccaggtataggcaagcaactagtcggtgcactttgaggctgaggccagaactgggccgaaagcactacaaaggcaatagtgggcttctggaaaaatgcagtaattgtctggtggtcagcattgttggaagatagctaatccgcctgtacttaggcatggttttagggagctgatcactaagtggctgtggttttgaacactgagcatcacggatgctccttgaagaagagggaggtggcccatttattaataatttgaaatggtctgctgagaagactcagtgaatgggccaggtaggggagaggggcagcaaagacaaaccctctgcaagcttctgtttggggaatggggcaggaaaaactctagtcgctcctgctgctgctgctgctttcccccaactcccttggcaaggggcttggacctcctggggaactggagaggttgccccacagggtaccagctggtacctacaagttaaggcaaacaagccagtagagcacattgaagaagaagaaagtcactgggaaaacaactctcgagtagttatccaggcggtagacatggatgcagaggcggccctgctgccaggtactgccctcacaatcggggaccatgcagaagtacttcttaaaacgcttgcaccactcacagcaggccagcttggagcagaggctgcggggaccctcagggctacctgggctagggggctgctgggctgagcaagacgggcgctcctctccatcacttccctcagtggtgacaatctggcacacaaaagcttcctgatgttggcgggcacaggctcgggaacgtgcacgggtacgggcatgggcacggctattgatacgaggctaaaatggacaaggaaagaagtggggaaaagtcaagggaagataacccaagtctaagtgctgcctccggattttctggaaactgtctttggcacaccatatcttggcttctctcctccaacttctcaccattacatcaggaagttgattcaaccccgccaccaccctgggtaacattccatcactcagcaagctgaccacccatgtgccataaccccagtacccttgctagcatgtctctacactccaaagccttgccaccactcccatacccagctcatacatggcggagtttaggagaagcatgggcttttgtctggttgtagatcaggaagttgagcacagcaaactccaacagagcgcagaagcagaagacgaagcagatggcgatatagaaatccaaggctgtgatataggagacacgcgggaaattcttacgagaaaaggtgcccaacgtggtcatggtcagaacagaggtgatccctgcaagagcacaagagtgatgggctcagctcctgacctatgtgcgacattggttaaaagactccatgacaaggcaactctgccctggcccagccaactcccagccatgtgcctatgcgtatacctgtttctcctcttacctagagaggtccgggctggagcagactctgtcttgatccaaaaggaaacccaggagagcatcgtggtcacggaagaagggacatagttttgaaaggcaacatagccaaaccgcctgctcacattgaagaaaatcgtcatgaccatgaagtcacctgaaagacacaaaaaacatcactgcattacagtgctgacacgacggtcccccttagcaggacgtgaacagtaagggtctcatttttcagctcacagtattccctaggatagaggcatgatgtgacaatgcaatacatacaaataggaccagaagaagcccagaaaaaagacttactgcaagaccaatggccagttgagagctaagccaaggccagaatcttaatagcttccttctcagttcactgtcctacacccaatgtctgtctctgcaggttggcaagagagtcaggtgaaagtgaaaaaatcaattagccttctagatatcatgcccacgcagctgatatccagatggctgactaagggcttcataccctctgaggcacatcacacctgcactgctggccctcagaatgtctactctcagcaaatgagactagggaagtctgtgctgtggtggagaagcacagaatgcttttggcctcctttctgcacattcatgtgatggcaaaatgccttcgtgagtgagcactgctccacaggtggtcaaaaccggcactagcctgctccccaaagttttggtggctccctgtttcacatgagctatacagactatctgcactctggaatctgatgctaaaggcccaccatgacccggctcccactgacattttccacacgcaccttacccaaagccaatcccatctgctcacagatttcctgagatggcctgcaattttacaccaagattctaaccctggactctttggtcttagtctatgacccctaacccaaactgagtgtttcagggaaagagaagaaaaagcttaaaatgaacatttcagtcagccctccagaagtcaggtctgtggcatacacatccacagggcagactgaggtcctcacagtcacttggacattgtgtccttggtcatggctctcagctagacggtcatggctcctccgggacctgatgacaacctatatctctagttggcatcttcttttgtagcattcatgctgctttatgctctgacacaccctccccaagcactctgctgctatcatgactcccaggctggtgtgggcttttctctgagcccaggacatcattttccactttcagcatcacattgcagttgcaatactgtaaaattcctaggcctataattaggtcgtcttttaagtcccttcaaggcagggctcatgcaggccctgtggcttagcccctgcccatccaagctcagaacagcctggaacccagcagacactcagcaactcttgctcctgtcaggcaacagctttgtaaagcagaccagaacactaacctgtccgtgtgtcctcctattttggaaagtggatcaactgcccagcaggtctgggtgggctggagctgaatgagaagagcagcctttcgtactcaccttggcagcactgaaactcaaggagcaaagcttctcagattcttctggaagaaggcaagggagcgacctgttgtcagtgggaaacctgtgtgttgagtatagctttgggatagaactcctccagagctgctgcacggaccaccctcgcacttgcctactggccagaatgtatttatcaaaagtcctcttgccgtgggatcttgactgcaatttaagacacttctaattagttatacccaggccctgcaaaattgctgggtttatataatatattcttgttgcacgaagatttattattctgttggatgattctattttaattttatttattctggccaaaaaagaaccttctccgctcgtcaagagatgccaatttgtcttgaaggacaagagaaagatgctaacacacactttcttcttcttgaggagtgagagaagcacgggtaaggaaaacaatatatctggggctgatgaaccaaagcaaaaaaatatatgctaaagatggttttctgctcaaactcttatcctctttgaccagatcatggttggtcactgcagtgtcagagggacacaattaaatagaccatgtccagaggactgggactagaagaatgaatggacccaaagctttgaagaataagggaagaaaaataaactagggctatgtagactacaacagactatgatccatgccgggaatgatgatgttgatcgtttaatctcggtcctgtgaaacagtggctggactaatgtaacctggacagttccaaggaaaaagaactaagcttaatgtgtggaacttccagagactccaatttcagaagaacagggagagttttttgatgaacagaactgtctagagaagaaggaaacctccttgtaagacagtgaattcctgaccagcaataatattccatcagaggctccacagccatcagtgaagggcaagcctctctctggaggcagggctggactctcttagaagctcctgaagcagagattctctggatcaaggtccaagatggccagagtagcaggctaccactgcattctgaacccttaatcgccgagcacgtaagtatgctccagatggagagacctgccccagggcccaactggaagagtttgagaccagtcccaaagataactctgacattgaaggaaccacgtctccagatcaactagtctccagcagaggagaaagaagacctcttttctcctcaagaatcctcctcactcccaaggaggtctggtgcttacctactgtcattgctttgatgatgatgctggctctggggctttgtagtcactagggcaccattttgaaacaatgcacaatcatctactaaacggaaccactagtgacttgaaagcccctgggccttatcttctctgtcacttttgatgatgggtccccacctatccgggaaaagctgaggtgcagaaaaccaagaggcaggcccatggttagctggcagaagagcaaggctcccaagtcaaaggtagtaaaaccgcttccccagagtccccaagaaaaagggcaagtatttttaaggtagcccagccctctgcccctgcctaatactgtgcaagcaaagctctagccacatgagcatgagctttccctcatccagagactgactcaataaatgaaacaaaagcagattttctgcctagtcacatggtagcagaacaagatgcctctcacgacaaatggctggttgggtgactggctccatccacattctggaaacgatgagggcagtgccttcactgccctgaacttggtcaggatgtgtgaagagtgtttccagggttgctctgggagctaccctggggaggtcccttggctcctcattcaggtcacctaggaacataagtgaaggtgctcacatctaattgggagctgaagtgtaagatacccaggaccttcccctttagtctttgtcagagaaaaggtcagaaaaccagtggccactatgtctatgtggaatccaccatgaagcctttgataagaatctgtgcttttcagacttgttcctttaagataaatgtcaatgcagcagccagtgtagctgctgtaacttcctccagactttcccagccttaaactagctgacattagaactctagcctccacctcccactacaatggactttgcttcccattcaaccagactggattggttctgggtatggagaactcacacgagctccattccccaaagtcatccaaagaggtcagagttgtaacctcgaaactgaagggtctgcatgaaaaagccagctgcacattccgacagcagcagaactttatctacttacctaacctctcaaggagcttggcaaagcacttacttctttgcagatgagactgagacatagttacaaagtctcagtttcctctgcaaacagttgtaagtgcttagcaattataagacaggagccatgtcttacaatgtttgcacgggatgactgcaaagcatttgtatggatggccatctccaatcatccctaccaccttcctggacttccgccaagccctggcacgcttaccaactggggttgtgattatttcagttttgttgctcactcctgtaaaatcaaactggaagagcttccaggagttcttctcattgatttcaagcttgaaattttcccacttgtagatcatctcattctcaggataggaaactggaaaggaatgtgagaaagagggtcttatgagacttggaagcccacctgaggtctccaatagcatgaagtcagcctgcacaatgccttggagtcctgtctctggcctcaccagctgtgggaccttgcctctcttacctcattgttgaagtccattcaatgagtgcgtttactgagcattcctcagtatcaggccctaggccagaaatacagagatgagcaaggcatgaaccctaccctcaagcaatcacatttaattttataagacagtgagtatactactgtgatttttggaggagctctgaaaaacctatgtccacagaacagcggggaaacaaagtagataaaggtcacttggggacatactcagaaaagacttcataaagcaggtgatattcccattaaatcttgaaactcaagtaaatattctcaataagaatgaggttgaaggggttaaggggcagtatagaaaggtgaaacacctggtgtattgtggaaaggacaaaagttcaggatggctagctcacagaggatgaggtgcacaggattgggtggcagggtccagttcatgaatggccttgaggttcattctaaggaatttcaaattgatccatgagagttaacggcagattcgagactaagaagtgacccaacctaggtgacccttcagctaggtcactctggtccttctgtgaggacaacatgttgtcaaggaggccagtgtagtaatccaggcagaattaaattaatgcaggtggaagtcaaagctgtacagggtgcagagaaatagacagcatcgatagagactgggaggaaacaccaacaggatgtgctgattgattagatgcaggaggtgagggagagggaacatcaaagttcttgatttgcgcaactgggtgagtgatggtcctcttcaatgagacagatgggaacccagaagcaacacacttgttttggtggtagaggtttggaggagacaatgaatttcattttggacatgtgcagtttcaaagtgaagatgtggcaaaagtccaggtggaagataacaaaggcctaaaccaaggtagtgccagtggagatggagaggagcagacatacttgagatacgcttcagaggcacgtggaagggatgagcaacacagtattgttggcaggaaaggaaatgagggtggaggatggaagtcctgcacaaccttggcagcattttagaagaaaagcagaggcagaaaaatgtaaatggcaaggatgagaaaaagaaggagcccagcatgtttctggggccccagaaacttaagaaggtactcacagctagagaaagatagagggcaagagtgagaatccattggaaatctgagcatgtggagtgagcatccggcatcaatggtcatcctggaagggagaaaggagcctcatcaggctggccctaagcacttccgtatccacccagctttggtctagggactaccaccaatgaatggccagagtcaatttttttctttgtttgtttgagacagagtctcactctgtcacccaggctggagggcagtggcgtgatgtcagctcactgcagcctcttgcctcccaggctcaagcaattctcatgccctagcctcccgagtagctggaattagtgccagcacaccctgctaatttttgcatttttagtggagacagggttttcccatgatggccaggctggtctcgaactcctgacctcaagtgatctgcctgcctcagcctcacaaagtgctgggatcacaggcgtgagccaccgtgcctggacctcgctagaatttaagacaaaaagctcaaaggagagataacaagagagaaaacaaaacaaaacaaaacaaaacaaaacaaaacaaaacaaacaaacagcttagaagtatctggttactctgggctccatcattagagaaacgtatggagcaacttcgatcggcttttgttttctcgcccagcctagtttccaggacctgccaacatcctccctgctatcccccacacacaaccttcccctgctgggaattcaagtatccaacttgatcttaggtacctttgccactaccgtgctgctgctctgcctgaacaattccaccactgtggacgtatctttgtatcgagtgcccacgtaggatggaattgtctagataatgcagtcatactggcacatcctagttgagggagctctggactcggagccaagtaactgagtaccagttccagctctgccacaaacttggtgtgtggctttaagcaatatctttctattttgaggcctctatatctgttacataagggggctgagctcatggtctaggaaagctggacaggcccttagaggtatcattcaggatgagatctctgcccatggatctttagctaaaattatcagaaggggagagagaattccaggaagtgagactccagaggcttgacatacctaattgtgtacaacaccttgccatccttgtagatgcggaccatctggttgggcatggtgatctcatgctcgtgggtcctcttagaattcctaaaaaaggtgtccgggatccatagctggctcaccacattgccattcagaacaagagactcaaaggtgtcgttgtaacagaggcgttcgtcgtaccaggtctgggagaagatgatgtcaatggtgtattcctggtgggaaggacagaaaagcacatacttggggatgaacagaaaaaggacattcacatgcaaacatattgtttgccactccctaacctagaatcctaaaggcaatgtggtggaatgcattgagcactagaccaggaagcaggagtcagatgaggtcccttctctctgctcaaagactcttccaatgtcagaactagaagggaactcagaggttaccaagcctaatgatcccaaatgagaagtcagtcatgccctgcttgattaccgtgagcaaggggagctaggtcctcacatcatgcagcagttaacacaattctcacacaactcaggacaatagaaaagtttgccttaaacaaagctccctactactttctcttagaatccccactgtgctctcaggtagcacatagagcaagtctagtttcggttccagaggagagatctccagaaatgatacgtcattgaatctgtctttttcccacatttctgaagtcagggtgcaccttacaattgacacatatctttaatggggcatttcttattctttcttgacagtggcttaaattggttacgatcttaaatcagagccaacattgaatcaaggaaaggcacttgaagactggaatcttgccctcctgagtcttttctctagggtagacattcatgactaaaagttttcagcttcaacaacccaaccacttgttttaccaatagatctgcaaggattgcacagtcaactgacagtctgctcacaggcgactcttttcaccaaagtgtgatagtacttgttagtacttggtccatagcactactactcactttgtgctgtgtttatcctacaaggtcaaccacacatttgaaaatgattccacactttgggaaagtgttgcccaacagaatggcaaatgtgactatggtccatgcagatcttactgacatggagcaaattgaaagacactactggataaaactgaaatctagagcaccttcctggtcacaccatagtcaagactactggattaatgcagctgaattaaggaagcctatgatcactaggtatacatgatcaacatgaacacaacaatgggataggtgagatttggtgatctttaaaggtactgttagctctgacgttatagattctgaggattttcattagcacatgtttcaggtttgtgtgtcaccacaactatccagttgtttttatgtttccttataagtgagaataagagaacatttcacttaggcaaacgataagacaacataggacttgatcactaaaaatgacatgtctgtacactacgcccacacgtggaaatataaacatggaattatgtcaaaataaaaaaagattagaaaatatccagaagacactgactgacactacagaaaactgaatgcgccctacaaataaatgatttcaaggtaatgtggaggcaaggagaactgttagactctagtgacaattagtctcacttttttttttctgtagaattgtttccatttataatcaaagtcttaaataaatgttcttgtgaccttggctaaaactcgtatctttctctgttatcctctttgttaaatgggagactataaataatttgtaagtgccctcctcctcaaaacaactgccctgtttccagagctgacattgacaccctccctttaccagtgggcaaaggttccatgctattctgtgatgggcttatcaagtagatggaccctttggaatccacttaggtttgtacagaggaaggtggcatgagtttggctgtaggagttttctatttccaggtgttccaaaataaaatataattcccaactagatcacagtctcagaggatacatttcatctagaaacagacaggcgatggtggcttaattccatgggctgggctcttcatcttattgctcctgtgtaggctgtgatgctactccagccaggtcaacaccctctcagtccccacatttccatagtaaatcaaagatcccagctcaaaattgttttaaaaatttacaagcacacacaccattgattgcatacagtggagtttcccctttcagcttttatttggggagcaccagtgttaattaaccccaatccttcattctccagaattataataaaaatgaagtgttttggaggccaggcgccatgactcaagcatgtagtcccggcactttgggaggcacatgtttaaggtttgtgtgtcaccacaactatccagttgtttttatgcttccttaaaaccttctgggaggttttacagccttctgggagggcggatcacgaagtcaggagttgaagaccagcctggccaacgtggtgaaaccccatctctactaaaaatacaaaaattagccatgcatggtggcaggcatctgtaatcccagctactcaggaggctgaggcaggagaatggctcgaacacgggaggcggaggttgacgtgagcaaagatcgtgccactccactccagcctgggtgatggagcgagactccatctcaggggagctgggggggaaaggagtgttttgagtcacaagagaaacctctatttagtctcatgttttttaaacaaggagaatctttttttattttgcttattttgtttttcctttcaaataagcacctgtaacctctgaatgtgtgtgttcgtgtgcatagatatatccgtgattatttggtctccagatattgtctgtcccataaaatgtctgttaaacatcaacaatgatattgaataggaagaagctagaaatgtgcaccactggtggtgaagggagaaaaaaaccctactgcaatagaactccaagcagctcgaacagcaagtaccacaagcaggccaaggcagaactctgagttattttagagataaggaaactaaggctttatgagaaagggggctatccaaagtcacacaaatagtcaatggcagcctggccctgggatggctttcacttgcaccaacaatctctttaggtaccaaggtccaattttctctgcagaatccctaggtctttccgctgacttcttgtgcatcaaacaatgaatacccacaaccatggaggcgggcacagccctcggggaagaaatcaagaaaatccctgattgcctttgctggccaggacaaaagattgtaaaagcagccaccaaactgctgggggccagccatggaagggaagactgagaatgttccctggagtaggccagagaagcagacagaaaagagctggcagagcctggctcccatttgaatgagagcctctgaccccgacctgccccacctgcctccacaaatgtcttccaagtgtttctactgtcccaagtggctggcagtctaaacttggccagcagagcctccttcattcccaggcctcgtgaactgcttggtagccagtgggaagccttgccctctgcactcacactgtgtttatgctctatgttatgaagtgtttcaaataagcatttaatttctattcgacaactgtaagttcattacatatcaaccgataactaacagttcactttttccccagtttgacaaaggagcttgcgatgtacatcccttttagctcagccgaaactctagaaattcagtgttttggaactagaatcaactgcgataattaccacagcaagaaaaagcgttagcaactatcgatgctatgatgggcagcgattcccagattgttcattgccttttaatctcagactgggtgttacacaactgtgcactcaggtttccttcccggaggacaaggcctgctttctaaacaacatctgactgaaaggtgttgaaactcccctcaagcaactacaccaactatgtacccaatgctgggactcacatttctgagaagtctcagcttcctcaaatgtaaaacagggatccatatcctaacggcagctttggcttccatgcaggctgtcatgaggatccaaggagacaagaatgtactgggtactggtatgttctgtgactatgtggcagagacgtgtgtcccctccttaccaagtacaccacagaacagggacctcccacagctttaaagaactatttggaaccatgtagaaggcaaggcatttcaggaaaatttaacaccacatgtgagggtttggaattttcaaaagacacttggctcaggctaaagtgccaccttactggccaaagaaaataaagttgctgtctcttttctgaaccagtcctgtgttccatgctaggtttggtgactgctgggttattagactatatccttcaagcattgtcaggtgaggccactgctggcagcatgaatagccatggagcaaggagagacagcgcattcagctactgtgagtggggctactgctctgctacaagggctcttgtagatagaaattggcttcccaaacagcaaggagattttagtcacaaattctccactactcttcagttttacaggatgctctgtctcacccagaaagcaaaccgaagcatcttggcgccccctgctccatttgtcagtgtgtggttctctccactccacctaaggaaatttagccaccaccaaatgggtggagattgacatgctagaaaagaaggggcaaaccagcttgtggaaattagaccggttacttccaaatcaggttggcagtgccttagtcagccaaaggagcagagaactagaagaaaggaacaaataaatagctatgcaaatttctgggagccatgaggttactgtggactgagcactacatttggcttttggcatgctgaagaggataggcagagactgctgtaggaggctctctgcccagctagaatagcatcgtgagccactttccccactcctacaccaatgacctgaaagggtcaacagtgacaacaatggtgggaccacaagccctcaacctctggttcttgcacagaacttagtgcttcttagtttataaacaatgctagcaaaattaattgctaaattcatacccatttttaaaaggtaaattgcaagactaaaaggagactacaattctcatagtggtaaacgcactggtagcagcaaaaagtaaatctgattatcaagggaagagtcaagaaaaccccaccaattttaaaatgtagacagaaactcaaaaacatctatctgctctcatgcttctgttcttgttagttctcagcaactcaattctaggagttgctctaacagaagaacatcatgaccatgtgtagccggcagactcttgagatgtcctccagtgctcttcacttcctggtgtttgtgcccttctgtaatcccttgacagggattacacttgacttgggatggacctcatgatttgcatctgatgaggagaataccacagaagcaatgggatgtcactcctaaaattagattataaaaagtccgtgatttccatcttgagcaccttctctcatactcttcctcactctgaaagaagccagctaccatattgtgagctaccctgtggataggtgcacatggcaaggatggagggagacctccagaccacagccagagaggaccagaatcctgccaatcctgtgagtggtcttggaaatggatcccccctcagttgagccttcagatgagactccagccccagctgacaccttgattacaggcttgtgagagaccctgaaacagagaacccagctaagccatgcctggattcctgacccacacgaactgtgagataatgattatttgttgttttaagacactatgttttggggataatttgttacatagtaatgcataggtagtgtgcctgaagaatcaggcagccaaagcctcatggtttgggagtggggaaccttgcttttccacttagcctatgcgaacaccttgattttccatgaaggttaacttagcattgagggtctatttgcaaggcccatctcagagccaaggctctaactcacccagtcacatggcactttttgagtacctgtgagtatgccaaaattttgtttgccccgggccaagccatgtctgtggctgtgacggagttgcttaccaaagccttcctcagtgtcaggctctgcagatgcaagtgattcttgcagagcatcattcatcactcatttgcttagctaacatatatggagcccttgacatcaaggagttcatggagaagacagcaaggccgacataccacagataattacaatgaaatgatgtaggcaagatcaggtaaacacctgtgatataagctggaaagatgtaactgccgaagagaagaatgtggtatgagaaagaaaggagcaattaacaggtgtggaggtcaggggagatgccatgaatgagatgctgtctgagctagatactgaaaaagaaggcagctgacaagtaagaaagtggaacaatggcataccaaatagaagatcacttgaatgaaagctcagaggtacaaggtggtctgggaacaccaatattctagtgtgaccaaagcacgtggtctctaaaagggtgaagaggaatacaaccatggagggccttcaactgcatgtagtaagcagtgctgggactgcaggaggtgcatcacttgggaggccaacttagtaggtggagtaggtgtattctaggtgggagatgatgaaagccaaatgggggcagtgctgacactatgatgatacgagtggaaaaggaaagaaggaagtagagcaaaaatatagaacagtcttagagcaagagctagtaactttagacttatgtccatacaataattatcagaagaaaagaggcagtccattgtggtgtttaacattgctttattatttctattttgaatgaaaaaactggaagatatggtcatgattctgaagatcctcttcaagtagcaagggacttaccttttccagtctcattctcaaaccagtggttaaaaaatccctttctccctccagaaaataaattattggagttgttacagaagtacagagcagaaagcagaagtctgtggaaggtcccataggtcagcccctgggctaggaaatagtactaaaaaagcttagtactcaccatgtctaggatagagagaggaccaaggctgttgacggagatctcaacagtgaccacagtgggcttctctataagggaagcagaagcagcagagggtaagtgtcaaacaggcgcatgggacgggggaggaagtggtcagaggggatgaaaggggagtcaagtaagtgttggaccacacagtttcagcatctaatcctatttctttatttattctttcatggcaaaaccaagctcacggactgttaagaattggacacacatcttgaagatcaacaatctagtttagtcctctcattttaccactggaaaaactgagggcgagagaagggaaaagtcttgatcaaggtcaatgacactgctgagaatagagttaatatctcttacctgacaggtcaatagcagatgttcctgtccatgagcatggcaccctctgttactgcccaggtgcattctccatgcctatgccctcaacccctggaccctctaggaggggaagaacgtcgttctgctcctcacctccaatgccagggcgcagtttgtggtcataattactcaggatagtgttcaggatgcgagaggcttctggcagtttgccaactctgctcccagtctcagtctcagttgactttgtttcctcagagaggagctgattttccagaggctggggctgggggccatagacaacatcacgggaagaggcttcattctttgattcagtctgaggtccctcgaccctagaacattcaaacgaaaaatgaagctctgccctgcactctgtaggggccccagctagtgcctcttgggacagaagcaaaccaaaacaagttttcaacacaaaacctagttaaattgtgactggtaatagcaaattataagacagtgacagattaggcttgtgaatttcttttaaaccttgctgctctttggggactttctatgctgtccctcttttatgatcactcttttatttaagaaaaaatcaacaaaaccaagacctagattttaaaagaatgttacacgtgaaatgaagagggcatttatgtctgagcgctggcccactgtgactagccttggcctctagtcagcctgaccagcaccaaccaggagtgaggagcaggcagagggccagggctgagaggaatgcttgcgaaagccagagcggcctctcccagagaggaccagaaaattgtgggaatattttgcggttttgttggttgtgtaatactcgttgcactgggggcaggggaaggggatgaagggaaggaggctaaagagcagcctttgtgggtgtctaaacaggaaaggcaggagtcctccacccacagacagccatccaggaactggctgcccaacaggagtccaccctgagctccacagccatgcaccacagccaagaaaaagaagaagattagtaagaataattgaattaaacaaaaatgttaaaggccatctgccaaggtatgaaactcaccgatggtgttagaagtccggatagtgctgcctttgctgggaggcagtgacaaagggggcttctgaggtcctgctcacattcgggtccttgatttggctttctttacaccgctgtggtcatattctgacaactcatcagctgtacacttatgatttgagcacttctctgtatacatgttctaattccataaaaagtgtttttaaaaatcaaaatgccccacttgctaatatctggatcttattttatttaaaagcaaactcttgaaaaacaaacagaaatcatttatgacacaataggagagatttgaacactgagtggacagttgagacatgaataaattattctttaatttttggtgtaattatggtattttcttatgtttgtgaaatattaatgactagaaatacatactaaaacaattacatataaaatgatatgatgtctgagatatgcttcaagacaatctaagttggaattggagggtgggtggtgtaaaagaaaataagagtggccatgagttcacaaacaatgggggtgcactgttccccctacctttatatgtctttaaaaaattataattaaaagtctttttaaaagccatcgtcccatattaatctgtgatactggaaggcaggagagtggtttcctttggggaggaaagtgtacggggacaggcattttggagatgcatgcgtgtgtgtgtgtgtgtgtgtgtgtgtgtgtgtgtctgtgtgtgtgtgtgtgtgtgtgtgtgtgtgtgtgtgtgtgtgtgtggtgagggggttgcaatgctgtatttcctgatctaggtgttggttacacgggcctgtttacttgtgaaaagccactgagctgttcactcatgatgtctatgcttttctactggcacgtcacacttccaaaaggatttttttaagccataaggcaatttgtttcctaaaataaggggtaaacagggcaagagacgttggcatgacccctgtattgcggaccaagggactgccaacttaagaagcaaaatgcattttttctgcagtatttcaagctgttagaattgcttaagtggcatacagatgtgccaaatccacaccatttctcatgtctgaagtggctacttcccattgtgggcgagggaagaactgggcttggaaaatacagtttctactttcaaatgccatatctagaagatgtcctctttccctgaggccaaactcccagccatctcaaaagataagggccagtgactatgggaagagaggaggaaaaatggagccctgagaccctgtaaaatgagtgatgtggctggaaacgtggcacaatcagaactggcagtcagtggtagactgagcactgccagacaggaccacctaaacgcctgaagcagcccctcccagatgtctgaaatccatggacgagatcctccccgctgccccaagtttaaaagtgcagaggcaaacaaataaacctgaaagcactgagaccaccaaagccctcctgcccctagactaggtctgcaataaaaatgatatcagagggtcataaggtggctttaatcctaaaattggcttttgccagttaaaaaaaaaaaacacaacaataaacaaacaaaacaaaacctcatcttgaggtccttggggttaaagagctgctgacaatgcatacctttccccagccagccattaagctcactttcggggctagacagaataaaaacttgaaaaacactcacacattggaatagtggcattttccagggcagtttttcagacattcacatgtctctagacataatggtccagcatgaagttgaatctctgcactaccccctcccaaacagtcgactgttggtggtgtgagaagtgggggggggaggggcgcataagaaaagatgttggatttttttctaaatcagatcttttttttcattctacagatggacaaactgaggcccagatagaggaaggactgtgccccaagtcacacaactaatttgaggctaagcctggaccagggagaggtcttctggttcagtgtggcccagtacaccccattgtcacctcctcagctctttcctgacaccacaggttgctatgcttgaagggcagtttccatttccccagtcccttttccctgctgttttcctctctgaccaccccttcttatttcccccaccccagagccatcttttgccctagccagtcaccacgtcagctttctcaactagtccacatcccattttgagggatgtggatgactggaaattgctagcacgcatagaaagacatttatcaagctcctgctgaggctagccccactccagggcaccagtgagccagcaagcagctacacatccccttctctgatgagctaacgcaatctggggtagggagagaagccaccctccctccccagaacagacaaacaagacacaagcccagtgccatggaatcttcgagaaagctccacagatcaggaagcttgcaaatttgtgacacttcacacacagcaggaaccatctcaaaacaacaacaacaaaacgaagcagtcatcttccaccccaaaaagccacaaatccagggcacgaccctcctagccaagtctcagggcgaggagaaggtgtgagggaagatggttgttcaagggaaacctgaaaggggagaaggggattgaaatctacggcccaaaccacagacttcagaggagaataatattcctggcctctggctccagtctgcccaaggcccagcagggtgtctagggatgagttaaggaagtgggaggctgtcagcggtggagagggggcatagctggtgcgggaacccttagactaaaccaaagctcgtgcctgagactggcaccaacaggagcagcggcatgggaagcaagtaatgtcagagttgcctggcgcagtgcctggaactcagtaggcactcttaaaaaaaatgtgagcagcagagaacacacgaggcaacactcacacatttttggcgcagctaagctccctcagcccgcgcacccccttctcaaaatgcacctccggcccccccagtagctgaagcctgccctggccggtcaccccggggccgctcccctgttcctgcgcaagactccgaggagtgcttgtcaccaggccaccgcagtgcttctgagagcgggaatccgcgaactggagtcccgtcttccttctggcgtcctgtcttccttttggagctccccctcaaggaccccgggagcccatcctacagtgaggcgggccgaggccggcgcgcatcgaggggacgcgggactcggccagcccgcggtagggccggggcaaagcgggcgcggggctcgaggaacgcggggccgctggggtcccgggagccgtcccggctcccggggagagggagctgggcgcgaagggctcccgggtcccgggatggagactcacctcgactggaggatcaataagatgcctaggaggactggaagaactttggacaacatttccgcggagaccggcgcgaccacctgcgcggaggtcgcggctcacgctctggc

SEQ ID NO: 2059 - DNA, 27483 bp, Homo sapiens
cccatttgtcccttcaaagatttttttttattaaatggttttttaagatcctaaagtctcccagtttcccctatatacataagaccatttaaaccacaacctggttaccaccgaccctttcgtgatgattcttggccaaacccctgaactacaagcacatccatttacgcctgaaaccagaattgtcctgagattcgagcaagacacaaggcggcaattgggtaccacagcttcatggaagtaagtggtgggaatttgcatattattttgttaaatgagggtccagttcttttgggccatggcccaaatttgttgatcccagtgagggtacagatgagggcctggatttagggtgtgcggtaaggactgcccttcacagaagcaaaacaggcagctgcccctttcagcaggctcggagtctccctccaaggcagggtctgccccgagggcttacagggggtttttccggacatcaatcatccccgggctggctcgtcgcagttcccgccggggcttggacaaaggcccaaagttccagggcaggcctgcctcacccacaggaagcacccgccccaccaggggctcagccgcctcccgctgcctcagttcctcgggggacccctgctcctcaccacacaggctcgagcgtttccaggtcaagggtaacggagcgtggaccaagtcccgcgtctcctcccgggtgcggggggccccctcagtgaggggggacagccagagaagctcgggtgccaggtggagctcatcttcatttccaggagcctgtctgccctccgagcacaggctcctcttctccccacctgtcatggagagtaacgtgtcctcatcagaaacaggtggcaacaccttcccgaagccctagctccccagtgccccagcacaataagcaacctgtgaattgagccaataaaggctcgagggagagtggtctctaagctttccccaaagaaagggaacaggtctgacttcagagcgcgacgaggagttacccctgctgtggcctacagcgttcacaccgccgagcttctgtttcagttcctggtttatccacatgtaacggcccagttccttctccagagcttgaatccgggcctcatactgcctcctgctgtctgctaacccttcaccgaggtggtctagagtggaaaggtcgaggagagggtggtgagggctgcaggcggggcaggcggccagggctgtgggggtgggggctgtgggctgggtgggggccggggttgtgagcggtgggccgggccaccagggctgtaggtgcaggggctgtgagtggcaggggcggtggggggagggaggggggtgcagggcggggaagatgggggtgggggggatggagggggccggggttgtgagccatgggccgggctgctcacctcgactctgctgcaggagcagctgcatgttctgctcgtgctccttctgctgcagggtcagctggcggtccatctccaggcgctgccgctccagggccacctccagccagtacaccagcctctgctgctcctccagctgcatctccagttccgagaaggcaatctgctgctggtgctgctcctctcggagcgtcaccacctgtcccaagacccagccaggctcagccctcatcatgacccctcttcatccagctaatcctcaatcacagacacagtattggcacacttgccaccacggcactaagaaatcaccagggtcttccctgctgagccaagactcagcctcagacacctcagcagtgctctagttatcttccaacgatcagagctggctctcaccttatctgctatctctgccacaaaccctttcctagccacacactatggagctgggcagagcgtcaagttgtgggatttcatctagaccaacctcagcactatggacatctgggaccagataattcttggttgtgggggcctgtcctgtgtgttataggatgtttagtaacatccctggcctccacccccaccactgtgacaaccaaaagtatctccagccatggccaaatgtcacaaaagggcaaaaacttcccctactgagagctactattgtggccatggaccaccctgaggttagccaatcagagcagaagtggggggcgggtaggaaactgggtcttagtttcacaagtaaaataggctttaaggtcaggcggccctgcagatgagttggtcctgattctgtcccccagtctgggaggaaacgggatatccgctggagcagctgccatgagacacctccccacacgtgccgctgaggaggagctggggggccatgggctgctggcccaccttgtcaaaatacttgcagaggagggctctggtctctgaggatgagaggtagctgagcttggccatgaggttcatctcgcactgggacagcaacgaggctgaggcccgaagcacccgctggcggcatgtgatggcctcattcttatactcaatggcagcatccagggcctcgatggcctcatccaactggaacagcgtccgctcctcctgcagagacgggcacgcgtggaggaacagcacccactgcctgaatgctgaagtcctgggcagacatgcaacagccaacacgtagccacaactgggccttaagggtcccctcgtcccaagggccaagtcagcccatcgagagaggtgccccctgctcactgtcacagccccaaccccagggtgagctgggggcactgctcagaggtggcctgctcaactgcaagcctctgtgaatgatctacattcaggaagttcagagcaccctaaccaaacaaaaggcatggttgggacagccacggaggcaccacggtgtctgctgggtaagcttctacagatggggatacgttctaagaaatgcatcattaggcgttttcgacgtcgtgcaaacatcagaatatactcacacaaacctagatggtatagcccaccacacacctaggctacaagcctggacagcatgtgactgtactgaatactgtaggcagttgttaaccatggtgagtatttgtgtatctaaacatagaaaacgcacagtaaaaatgcggtgttataattttctgggagcaccattgttgtatgagctgtcattcactgaaatgtcacacagcacatgactatagtcacataggctttctctctgctcagggaacacagatgtgtgggcatgaggtgcactgagtatgcgcctgacactccacacacgaagccgagacgtgtgggcaggtactcgaatgcagcacagaacaggagtccaggctccagccagaagagagctgagaggtcagcacagcctggcccctgtgtcccagccaatgaggccaaagcaggggcagaagggccaggccagccctccccagcccccacctccacctaacagtgaaaacttgggtctgccgacagcaaggcccagcacccgcagagggctggagcaagggctgaggagagcagacagacaggcatacaatggcaccaaggggctgagccatggggccgcagggtacctcgggggacagcagactcccctgcctcagcttgccgtcgatctccaggcgctgcttgagcagcgagtccttctcctggcgcaggctgtcgatctccccgcggatctgctgctggctctgggcgctgccctgccgcagctgcccgctcttctcggacagctccttctccaggtgctccagccggctggacactcgcacgatgtcctcgttgagggcctgggggcagaatcaccagggattagagaaggaacaggcactgtcctcacaggggggacagaaagggccggatgttaaggaggacttgcgtccttccctcaagaaaccaacactccaaatgttctgctcagcagggagaccagacttagttcacagagactccaggaggcggggctaaagggaccagagcatttgcagaggggcactcagagatggcgagaggaggataaggaccagagggacgtggccctcctggcaagaacaggcaatgggtaggggtgggaggaatgatctgtcactgagatgaccggactggacagtgataggaattggccaagccctaaaggcctttctgggagccagatgcgggaggaagtgagggctctcctggcggagggaagttacggatcattccagtaggaccctggatcctcctggacatcagagtgatgcgtgctggcaggagcaaggctcctggcctctgcgggcctaggacactgggcgtgtggcccaagcccctgtactggaacaggccctgcatcaatgacggccatccccctccagccatcatggtaacattatgatcccatctgacagaagacaacgctgtggctcagaagctgaccttcctattctagatggagtaatgatgccaggcggagaagtctctttctatttggctataccaccttcctatacctgcgcctcctcattcttcctgcacaggccctgaggagggggttaatgagtgaaatgaattggaggatggacacttaagagaggttcttctatgcatacatctgtaactgtgtcataaatatcttgaagccctacagctcatggggatgcacaggatagaacccagtaggacagagcttcctctgtctggaacttacctggcagagataccacctagaagaaactctcctgtctagacctcgcctggcagggacatcacctggcaggtttatcacttggaaggacctcactttgctagacctcacctggcagaaacttacttggcaggagctcacctggcaagatctgtcctggctggacctcacttcactggacctcacctggcaggatctctcctggcagggcctcacctggctggatctcaggcgcttgctctccagccccgtcttctcctgcatcagggcctccttcttggccaggatggcctcccgcttgtggagctcctcccccagctcctccagcgcccgccgctgctgtagcaccttctccatctcctggtccagccacttcttctgctcctcaatcttctaaggaaaagtagggagggagggagggaactcagggcccacctctggctgtgtcagccgccactcgaggttcactggggagaaaggtgcacccaccagccagcccccaggggagccctgggtgcggacacagcctggccccacctgctgctgttccaggctgaccacagagccgttgctgccactgcgcctcttcctctggaatgccgcgatctcttccgtcttaatcttcaggatcttctgctgttgctcatgcttcagctccagctcctgggtgaggagctcagtgggcagggctgtttatggtgccagcatcttaccagagcctgccaccgatcccaaagcccccaggagtgcctgcccactcccaagagggccctgcgaagtgtcccccagacccatcccacacaaatctccctggagaccggcaaatagacgcaaacacttagaaataagccccacaagatgccagtcacctcatatacctcatctcactgaagtctcaccctggccttgagtttcctataacattccacattttcagatgaaaaaacagactcaggctaagtgacctgctttctaaggtcacgtggctgtgggttgcaaaccctgcctgggctcccctggctgggccgccagctcagcctattggcctggacagaaggtccccaccctgccgtgagcctgaccttgacgcggtgctgccgcttgctcatttctgcctccaggcgccgcttctgctccgtctcctcgcgaagccgcctctgcagctgtccctgctgctgccgcatgagctgcacgttccgctcgagctcctgcagtcgcttctcactctgggccgacagtgacaccagccgctccgtagcctgcttcttctccttcagcacctgggacccacacagtcttcactgggccatgcacggggctaccgcgagcctgccatagtgctgggcactcaacaagggcaggcagatagagggcaaatgggtaggtgggtgatagaccaataataataacagaggccgggtgcggtggctcacgtctgtaatcccagcactttgagaggctgaggcgggcggattacttgaggtcaggagtttgagaccaacctggccaacatagtgaaatcctgtctctactaaaaatacaaaaattagctgggtttggtggtgggtgcctctaatcccagctactcaggaggctgaggcaggagaatcacttgaacccgggaggcagaggttgcagtgagccgggatcgtgccactgcactccagcttgggcaacacagcaagactctgactcaaaaaataataacaggacacaggagccaagatggccgaataggaacagctccagtctacagctcccagcgtgagtgacgcagaagacgggtgatttctgcatttccatctgaggtactgggttcatctcactagggagtgccagacagtgggcgcaggtcagtgggtgcgcgcaccgtgcgcgagccgaagcagggcgaggcattgcctcactcgggaagtgcaaggggtcagggagttccctttcctagtcaaacgaaggggtgacagatggcacctggaaaatcgggtcactcccaccagaatactgcgcttttccgatgggcttaaaaaaggcacaccaggagattatatcccgcacatggctcagagggtcctacgcccacagagtctggctgattgctagcacagcagtcggagatcaaactgcaaggtggcagcgaggctgggggaggggtgcccaccattgcccaggcttgcttaggtaaacaaagcagctgggaagctcgatctgggtggagcccaccacagctcaaggaggcctgcctgcctctgtaggctccacctctgggggcagggcacagacaaacaaaaagacagcagtaacctctgcagacttaaatgtccctgtctgacagctttgaagagagcaggggttctcccagcacgcagctggagacctgagaacaggcagactgcctcctcaagtgggttcctgacccctgacctccgagcagcctaactgggaggcaccccccagcaggggcagactgacacctcacacggccgggtactccaacagacctgcagctgagggtcctgtatgttagaaggaaaactaacaaacagaaaggacatccacaccaaaaacccatctgtacatcaccatcatcaaagaccaaaagtagataaaaccacaaagatggggaaaaaacagagcagaaaaaatggaaactctaaaaagcggagcgcctctcctcctttaaaggaacgcagttcctcaccagcaacggaacaaagctggatggagaatgactttgacgagctgagagaagaaggcttcagatgatcaaattattccgagctatgggaggaaattcaaaccaaaggcaaagaagttaaaaactttgaaaaaagtttagaagaatgtataactagaataaccaatacagaggagtgcttaaaggagctgatggagctgaaaaccaaggctcgagaactacgtgaagaatgcagaagcctcaggagctgatgcgatcaactggaagaaagggtatcagtgatggaatatgaagtgaatgaaatgaagcgagaagggaagtttagagaaaaaagaataaaaagaaatgagcaaagcctccaagaaatatgggactatgtgaaaagaccaaatctacatttgactggtgtacctgaaagtgacggggagaatggaaccaagttggaaaacactctgcaggatattatccaggagaacttccccaatctagcaaggcaggccaacattcagattcaggaaataacagagaacgccacaaagatactcctcaagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggtcaatattcaacattcttaaagaaaagaattttcaacccagaatttcatatccagccaaactaagcttcataagtgaaggagaaataaaatactttacagacaagcaaatgttgagagattttgtcacacccaggcctgccctaaaagagctcctgaaggaagcgctaaacatggaaaggaacaaccggtaccagccgctgcaaaatcatgccaaaatgtaaagaccatcgagactaggaagaaactgcatgaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggagcaattcaacaagaagagctaactatcctaaatatacatgcacccaatacaggagcacccagattcataaagcaagtcctgagtgacctacaaagagacttagactcccacacattaataatgggagactttaacaccccaatgtcaacattagacagatcaacaagacagaaagtcaacaaggatacccaggaattgaactcagctctgcaccaagcggacctaatagacacctacagaactctccaccccaaatcaacagaatatatatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaactaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagaaaaaaagagagaagaatcaaatagatgcaataaaaaatgataaaggggatatcaccaccgatcccacagaaatacagactaccatcagagaatactacaaacacctctacacaaataaactagaaaatctagaagaaatggataaattcctcgacacatacactctcccaagactaaaccaggaagaagttgaatctctgaatagaccaataacaggagctgaaattgtggcaataatcaatagcttaccaaccaaaaaaagtccaggaccaaatggattcacagccgaattctaccagaggtacaaggaggaactggtactattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaatcacgattatctcaatagatgcagaaaaggcctttgacaaaattcaacaactctcaataaattagatattgatgggacgtatctcaaaatcataagagctatctatgacaaacccacagccagtatcataatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaacaaacagagagccaaatcatgagtggactcccattcacaattgcttcaaagagaataaaatacctaggaatccaacttacaagggatgtgaaggacctcttcaagaagaactacaaaccactgctcaaggaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatagaaccaaaaaagagcctgcatcaccaagtcaatcctaagccaaaagaacaaagctggaagcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaactctagaagaaaacctaggcattaccatttaggacataggcatgggcaaggacttcatgtctaaaacaccaaacgcaatggcaaccaaagccaaaatcgacaaatgggatctaattaaactaaagagcttctgcacagcaaaagaaactaccatcagagtgaacaggcaacctacaaaatgggagaaaatttctgcaacctactcatctgacagagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgcagctataaagacacatgcacatgtatgtttattgtggcattattcacaatagcaaagacttggaaccaacccaaatgtccaacaatgatagactggattaagaaaatgtggcacttatacaccatggaatactgtgcagccataaaaaatgatgagttcatgtcctttgtagggacatggatgaaactggaaatcatcattctcagtaaactatcacaagaacaaaaaaccaaacactgcatattctcactcacaggtgggggtggaacaatgagaacacatggacacaggaaggggaacatcacactctggggactgttgtggggtggggggagtggggagggatagcactgggagatatacctaatgctagatgacgagttagtgggtgcagcgcaccagcatggcacatgtatacatatgtaactaacctgcacattgtgcacatgtaccctaaaacttaaagtataataataataaattaaaaataataataataataacagtatactaataatggtaaatactacgacatttacgcaccaggcaccacactaagagctctgtgtatattaaatggtcctaatgagcctacaaaaagtgtaattatgattatccctattttacagatcagaaaactgaggcagagaggttaggaaacttgaccaacgacacatagctagtaagtggtagaactgggattcaaacctgagcagtcaggctccagagcccatgctctcaaccactccacgatattgtctcttggacatttgaactgagaaaataaggatgggtgggcatctgcaaggatggacggatggaagggtgggagggacagatggctaggtgggcgagatcatatgaaggtaaaaaaataggataggccaggcacagtggctcatgcctgcaatcccagaacttttgggaggccaagataagtggatcacctgaggtcaggagttcaagagcagcctggccaacatggtgaaacactgtctctacttaaaaaaaaaaaaaaaaagaaaaaaattagccaggtgtggtggcacctgcctgtagtggcaccccgctactcaggaggctgaggcataaggatcacttgaacccaggaggcggaggttgcagtaagctgagattgcaccacagcactccagcctgagcaacagagtgagactccgtctcaaaaaataaaaaatgaaaacaacaggatggagaccgtgatgggctgaattgtgtttccccaaaattcctatatgaaagccctaaccaccagcacctcagaatatgactgcgtttgtaaagaaggtctttagagaggtgattagtttaaatgaggacattagggtgggccctaatccagtatgaccagggtcctcatgacaagaggaagagataccagggctacaagcaggggaaaggccgtgtcaagacacagccaggaagtggccgtctgcacaccaagaagtgaggcctcaggggaaaccagacctgtagacaccttgagctcggactgacagcctccagagctgggagaaactaaacttctgctgtttaaatccccctagtctacggaagtttgctatggcagctgtagcaaactaagacagagaatgcatgaattaacaaaaggggatggaaggggtggatgcacctgtggataaatggacaggtggtcaatccactgataaaaggctaaaccagctaggcgtggtggctcacacctataatcccagcactttggtaggcccaggtgggcggatcacttgaggtcaggagttcaagaccagcctggctaacatggagaaaccccgtctttactaaaaatacaaaatcagctgggcgtggtggcacgtgtctgtaatcccagctactcaggaggctgagacaggagaatcacttgaacccaggaggcggaggttgcagtgagccaggatggtggcactgtactccagcctgggcaacagagtgagactctgtctcaaagaaagactaaaccgatggcatgggtttgacggacacatggaccaacggatagacagacaagggagaatgggatggaggggtaagcgaatggagagctgaaagggggaccgggagacagaggactgcacgctgcagggtaggtttctttagacgcccacccttcaccctctcgttgctctcccaggtggtcttcaggcaggacctgccccctgcctctactgtgtgtaaagctgggcggacccccagcttctataccagcctcaccctgcagggccagggctggagcacaaggttccacagtgaacttgggcctcagagcccacatgtcctggtcccaaggatggcagcctaggaggcaggagtcaccccagcaccccaccctgaggccccgagactaacctgcacctggctctgggccgcagcgaccctcctgcggaactcctggagccgagaccgctcgccagcatcctggagctccttgccctcgagctcccgcagctgcctctggccttcactcagctcggcccgcacctgctctgcctcctgctccagctcccggatacgctggctgtgctggcggttcagggcctgagctgcctttcctggaagaaagcgggaatgtcagcacaggcagccctgctccaccgagagggccagctgtttgtccccctgggaggtttcccagcccttggacacctgtgtgggtttcaccaagcctttgcaccaccagtaccacagtttacttaatatttttcttcaaatcaactctatttatttatttattgagacggagtttgctctttttgcccaggctggagtgcagtggcgcaatcttggctcagtgcaacctccgccttccagattcaagtgattctgctgcctcagcctcccaagtagctgggattacaggcacgtgccactacacctggctaattttgtatttttagtagagattgggttttgccatgttggccaggctggtctcgaactcctgacctctggtgatccacccaccttggcctcccaaagtcctgggattacaggcgtgagccaccgcgcccagcctcaactcaccttttaaataagcctcatccactgcagcgacccaaggaaattacaaattagttttatttttaccaaatgcattctaaaataaatatgtaacctgaacctgtatataattaagcctttagaactaactttcatttccaggaaatctggaggacaaaagaatgagctaaatgacaccacaaaaaagcaaacagacaaaccccaaacgtggggtttgggacattcagcaggatgactgagagaagggagatgtcagagacctcagaaacaaatacagtcggccctctgcatctgtgggttccacacccatgggttcaaccaaccatggatggaaattatatttttctaaataaatggctgcatgtgtactgaccatttacagatttttcttatcatcattacctaaacaatacagtaaaacaactatttacccagcttttacattgtattaggtattgtaagaaatctagagatgatttaaagtgatttaaaggaagatgtgggtcagttactgtaaatactataccacattatttactaaaccttttttgagcatccacagattttggcattcacggggtcctggaaccaatcccacatagatatcaagtgacgactgtatgatgtgtgtgtggaacaaatgtggagcctgattcaagcgatccagctataaacagacactgctgataatggagagaatgtgcttatgctctggtcattaagaggactgtgccgggtgcggtggctcacgcctctaatcccagtactttgggaggctgaggtgagcggatcacgaggtcaagagatcgagaccatcctggccaacatggtgaaaccccgtctctactaaaaatacaaaaattagctggttgtgttggcacacgcctgtagtcccagctactcgagaggctgaagcaggagaatcacttgaactcgggaggcagaggttgcagtgagccaacatcgtgccactgcactccagcttggcaacagagtgagactccgtctcagaaaaaaaaaaaaaaaaaaagaggacattagtttcattaggtgtgctgatggtattacagttaagtaaaaaaaaaaaaaagttcctatttttaaagcagcacactgggaggtgtagggaagaaaggacatgaagtctggcatgtccttcaaaatattcagcaaagaaaaaagggagaggaggtaaaacaactgtggaaaactcttggtaactactaagtctggaggatgggtatatgggacccatggtactcgtctcatgtctggttgaaaatatttatgatgaatttggtaacaaattcattaactattaaaatataaacgctccactggccagcacctaaaactaccccgtgtcccctccttcactcatatcaccagtcataggcataacacaatttggagacgctcagtcctccatgacactcactgtgtgctccccaggactgagagatacttcgcccagcacaatggctgaaacattgcaggcactcgataagtaagaagaagtgccgggcatggtggctcacgcctgtaatcccagcacttgtggacactgaggcgggtggatcacctgaggtcaggagttcaacaccagcctggccaacatggtgaaaccccatctcaactaaaaatacaaaaaaaaaaaaaaattaggtgggtgtggtggcgggcgcctgtaatcccagctactcgggaggctgaggcaggagaatcgcttgaacccgggaggcagaggttgcagtgagccaagatcacgccactgcactccagcctgggtgacgagtgaaactctttctcaaaaaaagaaaaagaagaaaaaagaagtactgcttactaagagctattctaagcacttcacctgaattaactcacttcaccctcacaacacccctattcagtaggtataacgactatccccattttagagatgaaaaaactgaggcacggagggtttatgctacttgctcagggtcacacagctggaagaggctgggctgagtatcaaacctaggccatccggcccctgctcctaaccacctcattgttgaaatccctctagaacagtgcagaagtaacgatgagaagtccccctcgggtgagaggcccacctgatgcccacgcctcacctgtgcggaccagctcgccaataagctcctccttcatgcggatgttgatagccagctcccggatcttctgctgggcctgggccagccgccactctgaggctgtggcaggggggacctggcgggcctgaactcgggccttgctcccaccaactgctgcaacaggcagcctgtcaaggttgctgccccaactgacagtgggggagacagaggagtggagagcaggggctgccagggatggtgggtgggactgtcccaaggtggctggcccagaaccgtggaggggcagtggggaggaggccctctctgcatcccacccagcttacctctggaccctggaatggctgcatccaactcctcaaggcaaagctctgggcccttcctctctggcagactccctgggcgtgcccccgccctctgactgcagttgctgatcctatttctggaggacagaagcaggaggccatgctcctccccagcccctgccccagcctagccacccccaggcctggagggaagaagagaggccaccgggtcttccacctcccagggtcaatataaacccaggatgtgagtctggcagaatcaggagtccaggggcagagttttaggaggtacagggcagctgggggcatagagggccaccctggaggctgaagtcaggaggcctgggcccaccttgtatcacactcgctccagtgagacctttcggctcagtgccccacagctctcccccaggggctggccagggcaacatgagggcatcctaggacccagaggcttccccactgctgtcaggagaggagacggtgcgatccccagcctgcctagccctgggccctgagcaggtccttgtcaggtgggggcagtgggtcccactcacctgcgcaggtgtaaggtccgcctgggcggctcctcctcctcctcttcctcctctgaagcagctgaagagccacttcccagcctgttcacctcagtcagcaactcagctccagcctccctgccatttgtcacctgctaggggagtgagccatttcccatcccaagtcatcatccctgcgatataccccaccttgcctgccctcctcatatctctccctcctcaagccctgccttaccttcgtgatccagctcaaatgacccctctggcagccttctgaatctcaagctggggtgagagcttcctccctcccctcccctcccgcctgctttggctcccatgatacctggtactcctcaggtgacaatctgccctttctaccttgtgtacaggtcatgtgcacccaagtcctatctcaccaccaattccctgccagagtgatgggtgaacatgagacttctgccaacccccagctttgagagctgagatgacccaggcctaaaagccccagaggacccagaactttcaggcaggagtaacctttgtccaaacaaggttccccacgtggaaaagtgaacttgcaaagagagccatccaaagacagagggggtggtctgaaaggtgatgagctctccgtatgcagaagtgtgcaaggtttccacccgatgccggaagcctgaaccccctctgtaacctcctcattccaagcgatcttcagctaccccagggatgcccgatggcactgcacccttctgagaggcccagagtcattcaaatcttggctcttcctctggggacagctgaaagcagcctctcgcatctcacagccagtcccatgaaagcatgagtgggggacacgtgccccagtgcccccttcccctgccccgaacttgaccagtccagcagggcccacagacacccagcctcaccctcttctcacctctcccctctgctcagagccaacttcatctccagggaggcaggcaggcggcaccatgcccagcacatgggcgtgggcaccccccaggggggctgtatgaggtcgaggcacaaaggacccgggaggcaggccattcaggagccgcgggcccccccagcctggccgcaccagctctaaccgcagccgcagttccaccatctcctcctgctgctcacgcagccggtcgctctgcaagacatggtccaggtgccaagggggcatgaatgccccgacaggcaggagtgtaggaaactgaggaacaggtctgaggccactccaccgtctctgggctgaaaatgaggagtgtcaaatactcctctcctccccaacaactctgtaggagttcagactcaaactcaccccacagatcccatcacactcctatcctgccagaccgccacctccaaccgccgccaccagagggcgccaggagcaatgctgacctggtgacgcccggctccaaggtcccccgctgctgcccctcctgtcccctctcccgtccaagctcacaccacccagcaaagctgccctgcctggcggtcctgcacacccacctgcgctgttgtgatgctcacctccacactttcgctcatgtgcacctcctgactctacacccctaccccgcagtaccctaccctaactccctcccatcctgagaaactcagctctgccttcccttcatcctcctctgggaagccttccccgcactgtgaagcgggcgccgcacctgcagtttgtactgctccatggcgtcctccagcgcagccagaaagtctcggttctcctcctccagccgcgccacctggttctgcagggtcagcagctgctgcgccccctcatcctcctatagggcagggagaggggcttcaggggcgggggttgacagggcgagctggacacccggcctcttcttgtttagccctgctttctatctactcttccaagccctacctgcagtgggaactccagacccactggtgggaggaaaccccagaccccagctggcctgggtgccctctgcaagccatttgggtcatctcttgtaattatccatcgtatttgtattaataatatcaccactattattaggaacaatttactgcgtcttcaccggcatgctaggcacatgtgacaccctcagcccttacaacatccccactaagagatggggtaagtcctacggttatccctattttacagctggagacctgagactcggtgaagttaaggaagtgaccacggtaatcagcagaagtgaccgaatcccgaacgtgccctgctaatgggcaggaggcaggggcgcagctgctgtctgaagaccctcttccttcctctccaccactccccactgcccacaaccacaaccacaacctgtccctcggccacctttcgcccgccggccccctgcgccgcctggtcctcgacggaggcgctctcgatgccgctatcgggcccggaggcggagctcagggcgctgcgctcgccctcgacggcgcacagccagtcgcgcaccttgcgggcggcggcgccgggcagcccgggctcggcctgcagctcgcgcaagaggctgtaggcggcgtcggtgcaggcccggtagcgcgcgcactcggcgcccaggcgcatggcggccgccgcggaggcggtggctgggcctggggcgcgccggccgcggtggatgatgcgggtctcggagcggtgccgtggcggaccccgcgcgccgctcgccgtctcttcgggtggccgctcggcctcgggccgccagttgaccgtggcgcggttgcggatgttctgggcgcggctggcgtagttgagggtgttgagggtctcgtcgaagtcggaggaggaagggctgacgcaggcgatcatcaccgtcttggcgttcccgcccagcgagtctttgaggatcctgagggcgcgagggggaggctctcaggggccccgacgctccaggcccagggccagcgggccagacctgggaccggctcctggcgcggttcccgtgggctggagacctcaggggacctgggcttccacccccactggtgtgctggacactccccgcctccccggcccccaggccacataggagccagggggcagctcaccgggtgatcttggagtcgcggtagggtatgtggctgccccggcgctgagggtcccccagggcgctgatgacgttgcccagcgccaggaggctgctgttgatctggatgctctccttgagccgctcgccggtgctgcccgtcttgagcaccctctctgagcccgccaggtccacgaagtggaacttggagacgagcagctggcccggggcggggcggggtaggcggctgggggcgcgcccccgctgctccagggtcacggtgaagaccgtgtgtgagcggctagacaggtggttgaggtgcgtggctcccgtgtgccgcgccgcgttgcccatctccaggaggctcagcacctcatccaggccctccacgtcgacctccttcaccccgcacagcactgcgggcacagaaggccgtgagccccagggcaggggccgccagactgaccagccaggagggcaggcagagcagaactagccccaaacctgcccttcctgacccactgctccctccccatgcccacggggtactgcccttcctagttccggcttgaggggctccggcttcccactggcccacctcagtgcctctcactctgggtatagaagcatgtactgaactcagtggaggcaagaagctaaagcaaaacctcccagggcttgggttttccatgaggagttgccattcccagacaggtaagcactccactccaaacaggtgaagcccccctaagcccctctccgtcagtggaggaccccagagttcctcaccaacattcccgcgctcatcttcccggagctggatgtcacggctggcagtgcccacctcgagcaggtctcggaactcctccttgtacacttccaggtaggacacatgtaccagacagtcaagcaggtcgttctcatcgatgagcttgaaggcctcggccatggccctcgggacaatgccctgctcatcctcaaggagggaggctggggagacaccgcagggcctcctgccacttcagctggacacggcccatggcccccaggcccggaagctcataggcccctgccagagctggaggatggtgctctaggatggagaaggcagtggccgaggccaggatgggacaggtggcctgagcttggccatgctccagcgtggtcaggcagaattataaaatttaagagttggaagcaacctctcctgattcaatcaacccctttcatgctgtaagcatccccttcactgcatcctcaacagattatcaaataaccttgccttgattactcctaatccatgctcagttatctaaagggcctcctaaatttatcccaaggaaataatcagaggaacttcagagcagcactcttcctcatgacttcaaaaaatgcaaacatcctaagtgtccatccgaagatccaataggagatctggccaaatcaactttttttttttgagactgagttttgctctcgttgcccaagctggagggcagtggcgtgatctcggctcattgcaacctccaccttccggtttcaagcgcttctcctgcctcagcctcctgagtagctgggattataggcatctgccaccatgcccagctaatttttgtattgttagtagagatggtgtttcaccatgttggccaggccggtctcaaactcctgacctcgtgatccgccggcctcagcctcccaaagtgctgggattacaggcatgagccaccgcacctaaccaactattttatattcacaatggaatgccaggtagccattaaaaagttagatttttttttttttggtagagacagggtcttgctgtgttgcccaggctggtctcccaactcctatgcccaagcagtcctcccagctcagcctcccaaagtgatgggattacatgtgtgagcccctgcgcctggcctaaaaagttagattgaagaatatttcatgatacagagaaatgttcatgatacatttgttgttgttgttgtgtttttgaaatggcatctcactgttgcccaggctggaatgcagtgaagcaatcttggctcactgcaacttctgcctcctgggttcaagcaatcctcctgcctcagcctcctgagtagctgggattatagacccccaccaccatgcttggccagttttttgtttgtttgtttttgagacggagtcttgctctgtcaccaggctggagtgcggtggccagatctcggctcactgcaacctctgcctcccaggttcaagcgattcccctgcctcagcctcccaagtagctgggactacaggcatgcaccaccacgcccagctaattttttgtattttagtagagacagggtttcaccatgttggccaggatggtcttgatctcctgacctcatgatctgcccacctcggcctcccaaagtgctgggattacaggtgtgagccaccacgcccggctcagtttttgtatttttagtagagatggggttttgccatgttggctaggctggtctcgaactcctgacctcaggtgatctgcctgcctccgcctcccaaagtgctgggattacaggcgtgagccactgtgcctggccaatgatacattattaagaaaatcaaacaggacacaaaagaatgtatataatataatcccatttttgaaaagtaaaataatcttcccagggaaagaaactggaaggctaacagggcaggggatttccgaaaggcaattatcaagtacattttatttcgtgcatgtgttttgctgtattttcctaattttttttacacaaagtatctttctgtaactgctatggtctgaatttgtttatgctccccaaaattcacatgtagaaatccttacctccaatatgatggaagtgagggctttgggaagtggatggggggagccctcataaatgggattagttcccttataaaagagagctgagagagaccccttctgtgtactaccatgtgagtttagagagagacagcgactgtctgtaaggaagaaggcccttcaatctgctggtgccttcatcttaaacttcccagcctccagaactgtgaggaataaatttctcttgaggagccacccagtctatggtattctgttatagtgaagggagcagagcaaggcagtaacccgacagaaaacagcttgtgttacttaaaaggggacacttccttcagttggcccaaaggatctttctcgaaactgctccagagcctggctgaagcaccctgcagccctgctgtgcagtatccaaagcagcctcttccaggacacacggcccccattcccaactgctccagctagaacagattcctgaccttccctagccagcctgacaacctctagagacacgccaccttcccgtgcccttcctctgctgaggtccccagagccaggcagcatggcgccatctctatggaggtgagaaggccactcacctccaacgacccttccttcctgccctgcctagcccacagacatggctggtcccagcctgggccacagatccctgtctaggaaatcgactcttcctcccccagcatccccaccttccacagaacaggcagcaagaggacaaggcagaaatccaggaaggaactaaggctccttaaagtgggcacagggccacgaacagggtcactcacccacactggcctcccccatggtgtatgtcttccctgagcccgtctgaccataggcaaagacagtggcattgaagccctcgaagaaggcctcaaggaggggctgaacgcaggcctggtacacggcctcctgccccgcatcctcggccagcaccacgtggaagccaaagtgtcggtcacggcccagagtgacgcggccaagccctggctccacctgcaggcagctctgatgcccgtgcagcagctccttgggcagcagtggtcgaactcgcagggcaacccgcactggggcctcctcagcccctggcagcctctgagcctccagccccatgccgagggaggactgctctgggccctgtggagagagagagaagccctggccatcagcacttgtactccaggagctggactcaccctgcaggggactcgagccagatcctgcagctcctgaccttggagggattgggggagggtggtcaaagttcacaatatccccatgtccaacctggtgctcaaaaattgcaagggccatgatatatatagtcccccacaggaacatgtcatggcttccggcactggcgaaatgaggccctaactcctgaactccagtgtttcagctgcactcttccctatggcccctatggccccatctcctagaagaacgcacacacacagcaccacaccacaccagggaactcctgtccctaacacccactgggtttaccacagtctttgtgtcaagtcactcacatcccctgccccaccttcttcaaaaaagtcaacagatccttcaagaccaagctctcaccaccaaatcctgccaattccatctcctaaatatctctcaagttcacctgctgcttcccattctgttgctaaagccctggtcctggccactgacatcgtgccaggatgactttgagcagccttccccctggcatcagtctccctgtcccctcccgcagggcaaccagggacatctttctttttcttcttgagacagggtctctctctttcacccagactggagtacagtggcatgatcactgcttactgtagccaaggcttcccaggttcaagtgatcctcccacctcagccttcagagtagccgggaccacagacatgtacctggctaattttattattagtattagtattagtattagtattagtattagtattagtattttgtagagacagtctggctatgttgcccaggctggtcttgaactcctgggctcaagggatccttccaaagtgcagtgactacaggcatcagccactgcgcctcagaggcatctctcaaaatgcaaatgcaattatttcactccctgcctaaccccaactcccccaaaaaaaggctctccactgcccttgggattcaaaatatttttgtttttgtttttgttttgttttgttttttatttgagacggagtcttgctctgttgcccaggctggactgcagtggcccgatctccgctcactgcaagctctgcctcctgggttcacaccattctcctgcctcagcctcccaagtagctgggactacaggcgcccgccaccacgcccggctaattttttgtatttttcatagagacagggtttcaccgtgttagccaggatggtctcgatctcctgacctcgtgatctgcccgcctcggcctcccaaagtgctgggattccaggcgtaagtcaccgtgcccggcctgggattcaaaatattaaggggaaaaaaaaaaaagacaagccttaaatcaggccctgcctccctggactactcacttcccacaccccaggcctttcctcgcctcctctctctgcctgcaacggctaggtgttacccaagcctcctcatccctcccggctgaggctgcagccaccttctaattcagggagccacggaagctcccctcctctgtaaccccaccacgacacgcacacaacccccagtgctgttccacccgcccgtgaccactccaactgcaggttactacccgcttctctccccgacctcccagaccaggagctggaaggcagggaccctctgggtccactttgcactttatcaccagcgcccaacacaaggtcccacgctgcccaacagatagtgatggataatcttcatccagggaactttccctgccctccctcctcctaccgcgttcctcacccccaccgccagcccggcacttcattctttacccttcaacctctctctcagcacagtaacctttcgttaattcaatcacccagcccctattgggctcccgaccctgggcacacagcggtaaactctgcctcgcaataccgtgtgggccttcgcgcacccctccgcgtgagcgttccgagcccggtgcagtcccggcttccgcgcgcccctgctctccgcacagcgctcccgctccgaaggtgctctgacaaccccgcaggcgctattcggagccggggcagggcagctggggctggaggcggcgggcgcgggacggagctccatgaaagttggaagaagtgattacaaatcgggacccgactctcgcagccttggcgctcgcccctccacgcaggcccgggatgccggcctcagcccccagatgtcgggaagacggcgccggccagtccaaggaagagcttccaggaggctggggagcaagggtgccgggctcctcatgccgggtcaggtctcccaggagtgccggctcccagggccactaggcccaggcctgcgcgaggagggagcgcgcgcctccctccacccacccggtcctcgcccctaacccgctctccggcccacactcacctgcctggctgcaagcgccgtcccgggccaggcagtcaggtttccatccccag

SEQ ID NO: 2060 - DNA, 27845 bp, Homo sapiens
attaccaggtcaaaatttttattcgttcattcatttattcatttgttctgcctgtgcaaggcagcctcactcccaggctgtcagcaggactttttttttctcttttgtacagatctggttcttggctttgctccttgactcagttgacctcctacccctcacagcagggtaaagacttgcacatcactgacaggcggctcggagtcagccttggagtcggccttccatgcccagccctgaggccaccatgccacgttccagttggctcaagcagtgaggggcaaaaccagctccagggccaggtggaagggctgcttctctcctgcctccatcaaatgctgaccttgcctctgaatgaccaagcaaaacaaaggaataaatgaatgaataaaaattttgacctgttaattccttaagaccttgatacgtattcgtgggtaagcaattttatactattttataaaactgttttcagctgttttagtcagggtcgggtgccaggcacctagacacccccctccccattcccaggaaggttttggccaaacctgcatccaccaccttggcatgccaacgcattcgaggccctggcaggccccgactcaacagaaccgtctcgccctctacagccaccacagccacgtgggccaatacccagcacgcgccccactgccccaagcctctctgccggcgtggctctcccccaacctcactctcaatacaaaagggacagcaccgaaagaacaagggaggccggaatggtggcattattcaatcaaatatacagagtgcttcctttaatatgtacacatttacaaaaatgcactttcacgaggaggggcggccggggccggcaggtgggcagcgcctggtgccacggcacgcgtggacagttgcgaggggtctgtgtgaaggcacttgtcacgagcttcaatactgccgccgtcccaggatgggagaactgcgcagcaggaagggcacttctgaaagcacagtggagagatcgctggagcgggcgttctgggcaggaggaagcacagacggcaggcagggtggactggccagcaagcgcgaggttgacctgccagccttgggccacgccgatgacctcaggccccactaacaaccacaggtgcgtcaacagccacgggccgtgccggcagccagggccacatcaataaccagggtcccaccgaccaccgtaggtcccaccgacagccacaggtcccattgacagccacgagtcccaccgacagccacaggccacaccatcagccacgggtcccaccaacagccatgggccacaccaacacagccatgggtctcaccggcactttggcctggagccacagagaaacccgagtgaggaataaaaggaagattctgtaaacagtgcacaacctctggtaacaaacgctacgatttggtgacgacgcagacaccctttgctctctcctttcatacagcgagtgccacgcacggaaactttacaaaaatagcaactatccgagaatactccattgttttcagcctgacagttactgaataatttatacaaggttaaagaaacgtagaaaataaacatttggtttttgtttttggtggtttttttacacaaaataaagaaactatgcacatggcctcggcctccgggtccggcagacggcatggctcccaccgagggccctgggtcccggcccagctggcagccgcccctactccttgccggcgtagcgggcctcattgatgctcctgaccgcgcggttgtccactttggggcctgaggcccagtgggccggcctccccggcgagcggccaggatctttggtgaatttgtgtgagaggaacttctccgcctccagggagtcctcctcaccgcggcccagatcctcgtcctcctcatcctccctgacggccgcgtggccggccggcccgggcagcgcctcgtccgccctgcgcggcggcggcgtgaagttcttgcactggtagagcacgtccttgtggccccccggccgctcaatggggttgcggatggggttgagcggggcccactggttgttggcgctctcctcccgcggcagccggctcctctcccgctctttcctgcgcttgcgtgtccaccacacgcacaggaccacgcacgccagccacagcacgctgaaggcaccacacagcacaggcaccagcagacctggggaccggggagaagagccggtgggcaatgaggcctgggcacctgcggggcactagccacacacccaggcctgggagggccctgcgggccaggcggccgggccccaccctccggttgctggctcgtggggagggtcccaggacgggggctgggaaggtcaggttgtggggctgggcggctggggcagcaggtgccagggacttctgtgttcctggtggctggcaggatcggcaggatcggccggctctgtgcccaatgcctgagttgcctgcctggtgccttcccaggggcccacctcccgcgcttacctgtggaagagccgcccgtaacaaccgtctccaccttgacctcggtgacagccaggagcagtgagctgttcccccgctgggtgatggcggccacgatggcgtgggccgcgccctggatcaggctgctgtcaggcaggtccctggcagggctgaaggactgcggcaaagaacggcattgtggggatggctcgagggctccaggctcccagcagcctgcccccaacactgaggccctggccacactggagcaaggtgggcgcacgggagacgagagcccggggtcctgcagtggcgacttcaccaccaggcagtgagtggggagtagcggggggaggagtggaggggtggaggctgtccccatccgggcacacaggagagcccagggtcctgaggtgtggggacctcaccaccaggcagcgagcagtggggggaaggggaggggtggaggatgtccccatccgggcgcacgggacagcccagggtcctgcggtggggacctcaccagcaggcagtgaggggtggggggaagtggaggggtggagggtgtccccgtccgggcacacaggagagcccggggtcctgcggtggggacctcgccaccaggcagtgagttggggaggtgtgtggccccattcgctgacacctgctccgtgatggccatcccttcttgtcagttcccagcccccacccccacctatgggccacaccccaggggcaccacaaacctagtgccttcacgaggccacagcaacccggggctgtgcccctgcctccaccacatccctgatggcgccctgacctgtgctggcacacttcttacatcttcccctgcccctactgcccttccatcacccagcagcacccatccatgtcccccaccccctctgcggcctcagggcaccaaaacactgcacgtccttcctgtgcctggccatggcctccaccagccacactgtgccatggccacacccactgctctgcacacccacccaccatgttccagaacattccctcccctctccgggcatgtctccaccccagtctcacccgacccccttggtatccattcacatctgacaccccccaggtccagggcaggtgccagtcccaaagcaggcctcccagggcagactaagcccacggactctcctgctgcctgtgacgtagggacacagagacaaaaacagagcaggggaccgggcgaggatgcagctgcaggggaagcgggctccacaccacagccctgcatctccctcatgctggccaggcccagggagcagttccacgggtctgcggcatggacagcgaggggccgcagggagacaggcctgcccgcagtccttccgcaccaggactagcctcgccagagcctctgtccagcatagccaggacctgcatagtacgggacccagggcccacccaggtgctgctccccactgggcactcaccacggccacctccacagcactggcccccgaggacgcccggtcgcaaagcaacaccagcaggcggtcccgtgccacagcccttgtggctggcagggagcggatcccggagcaaatggcgcccaccgtggtgccctgggcagagacaggcagtgcgtgggcagggcagggccgtgaacctgacacctacatccctggactggcgctgtgggtacacgtgggacacaccctacagcccgcccaggagagcacagcaaggatgccaagggcctgggggggcagcttcccacccggctgtgccctataccaggaggcaggagtgacggtgcccacccgcccatcctcagggcggacccagctccacctgcaggccagtgggggaaggagaggcagggcggggtacagtgggtctcctccagttctgagcccctcctgggagacaggggcccagctccaagcacacagcaggcaaaggtggctcctaggccagggcaaaactgcccacggagctacagcccaagagctggggccaggcagccatggcgccgtcagtccaggccctcagggcagctggacaaacaggcacccccagctggctgctctcccagcctcctctgccacctccacccagcaccaggcccaatgcccctctcatctgaccccacagggccactctctgtgaccaagagtgactctgctcagccaaccagggcctccctgccctgcggggctaggctttcgccatgccacgagcagatgccggcgtgtggcctctgcaagctcagatgccaccaggcccctcacctggggcacgtggtcacggttgaaatgcaaggtgaggcgggcacagttattgtccaggtggccggagcgtggcaggcagggggtgctcggtggctcttctgcgccgcactccccccaggcctcacagggtggtcgcagacactggcctggggccttctccaggcacctttgccccagtgggcactgggcgctcagggcctcgggctggccggccagcagacaaggcttccatccgcaccacacctgggcaggcacgcacaggagggtcaggcgcaggcgcacaggagggtcagatgcaggcacacagatgagaacccacaggcaggcacgggccccatgccaaggagggacaccgcccaagtctgtgagccccagggcccagcccaccccctacccagggctcccagggaggcaggccaagctcgacatcagaaagggcaggcggagcaaggcaggacccagaccaggcctgttttcccaactgcacatcgaagcatggggcctggctgagctctcgcctccctgggtgtccctgagggcagacggctctcagtccatccggaccccagcacccgcctcctgatctcacagagtggccagggtcagcgtgcaccagcctcgggtagggcagggcggctcacgggctgccctcaccttgctgcagtcacggcggccatccaggcagcggcagctgttgcagtcttccacccaggagcttccgtgtgggaacggagtgccccgggaccagcaggatctcccgaacccgatcactgtggggagaaggggctcgagggtcagcagtgggcatctggccctcggggctgggtgtcacccatgccccccaacccgccccaacccagggcaatcacacggggcctaccttcctggcaccgggggccggctcggccgggtgggcagctacagcgatacccgttgatctcatccacacacgtggccccgtaggcacagggcgaggactggcactcgtcgatgtctgcagggagagccaccgctgctcagtgcagtgaggccaacgcccaccgcaggaccggcatggcctagggcagcggggagccagtggcacacaggcgcaagccccaggacaatgaggagcagcccctgcccccgagcccaagctgctgcctgcctgaggccttcctgagcccagcctgaccctggcccaacagcaccctcctccgtctgcttctgcagtgggcctgtcccatcctggattagccccagctgctgcgtcggaccagccaaggggtgctggacagacagctgggccaacacccagggacaacagccctgcggccacagaggagcccacgtcaggctgcacgctccaacccccacagctccctgggccccggactggtcccccaggctggggctccccacttaatcacttggcagggtatacagcaggaaccccacagggcacagacatgtggggaaactgaggctcagaagagaggcaggaagtagttgtggccacactgcccttcaagggacgtggacgttgatgtccccagactcctgacaccgcggctgggctgaggggctcccagggctggggctgtctggccactcactgatgcggcagtcaggccccgcgaagccaggtgcacactcgcagcggaaccagttgacgccgtcaacacagatgccaccattgtagctgcagagcagagggtgggcatcaggtggccccccgtggtatgccaagtcccacccacccctgctgtggcccccagggtgccactcaccaaggcagagggttgcagtcgttggtatctggtttgggagaagagaacgcaggggatcagtacccaccccccaagcgtgccaggcactgtccaggctggcttggcgtgatcaggctgtggggctggggagggtcatcaaggagggtgccttttgctgggggcaggggcagcagggggaggggctggcagaagggactggggggcgagtcgggggcagggatgtcatctgggtggaggaaagcggcccccgcccacacccctcccacactcactgtgagtgcaagtacgaccctcccagccgtcccggcagatgcaggagaaggaggccccgctgcccacgcaggtgccaccattcacacaggggttgggcaggcagctgctgttcttggctgtaaggagaggaggaggagggagcgtctcacctggccctgggctggccctgggtctccataccgcgcccccaacccagacagggcagacagacccgggggcagggggcagggggcaggtggcaggtgtggccctcaaaaaagacccctcggcccatcgcgcccgagggagcggtgcctgggagggcatatgcccggcggtcgcagaggcagcgggggctcctcaccgacggcgcaggtgctgcccttccagccgggggggcaggcgcagcggaaggtgtcgccgctgtcgtagcaggtgccaccgttgctgcaggtgtaggcatcgcactggaactcgcctgttggcacatgggccgctcagcaggcaggccccagaccgccagggccagggtcctgggggcagccccaggcggccagggcctgcggacactcacgtgagtggcaggtcttgcccttccagccgtcgtcgcacgcacagtagaagtcattgaccaggtcgtagcagcggccgcggctgtggcagggatcgggaaggcagtcgttgggatctgggggcgaggacgccggtcagcgggcggggggtcaccggcgctcagggagggcttcccgggggaggaagcactggagctgggccaggtgaggacagagaggggcgggggaggagcgtcgggccgggggagctggcctcgggcatgggggcagcctgggactccaccccatggtggcagcaccccctggccaggcctttctgggtacggggcctgccgcacccagacagcggtccatctcagggtgataaggggcccacaggggtggaggcacaggccgtgtgggcgggtgctggaacactcactggtgtcgcagagctcgccctcccagccgctggggcagaagcagcggaaggcgtccacctcatcgatgcatgtgcccccattgcggcagggctggcccaggcagtcgtcaatgtctgcagaggcgagcggggtgagccagggcctcaggccagcccagccccaccaccagcccgccgttcgtggccactcactctcatggcagtaggtgccagtaaagccactgtcacagatgcaggaaaagttgccccctggctggctgacgcagcgtccatgggggccacacacgccggaggctgctgtgccaggcatcccaggccccgcgtctgacccgcagccatcgatcactatggcaggcagtacagtcaggagtcaggcccgcccctgccccaccacctcccccaccaccccatgccgcacccagcacctctgcaggccccgccagggcacggctcgcggggcacggagcagttcttgccaccaaagtcatcagggcaggcgcagtaatagtcaccctccaggttatagcagcgagcgccgttccggcaggggcttggctcacaaaggtcgacatccacctgcagggtggggggtgcctgtgagagcctaggcccaggcccaggccgggaacacaggccaggcctctgtccatacgaaggtagatccctggggacccccaggcccctccgccctgggcctaacagtgccagccagagcccaagacccctgcccacctgagactgcccaggccttagctgaacgcagatacctgtgggcccccacccccacctccactgcagcccagcttcctcactgtccctcgggaggagtgtggccttggcccctgctgctggcaggaaggacagctcctgagcccctcacacactgcctggccaccctcagagccaagactgtgggtcttttccagggccagccactgccatgcttgcaggtcctgaggtcagacccctgccctgggccccaagaagccctctggacaggaggcccatcctctgcaccaaggccagggcaggatcgtgggcggccgagggtggtagggaggtgggtggggggaggcagggaaaaaggggaagtaaggggagggggtggtagggaggcaggtaatggggaggcagggttgggggaggtggggaagggggtggtagggaggtgggtggggggaggcagggttgggggaggtggggaagggggtggtagggaggtgggtggggggaggcagggttgggggaggtaggggaggggtgatagtgaggtgggtggggggaggcagggttgggggaggtggggaagggggaggtggggaagggggtggtaggggtggtggggaagggggaaggcaggttactttggaggcaggggggaaggggaggttgggggagggggtccagtaccaacagatggtcagagggaggcgagagcatcagccctgagagagatgcccactccgacccaggactcacctatgacaggtgtatacctctccaccatcaggcacccaccctaccccatgtgctctgcccaccagagccccctgccctccagtcccgagggagtgcacagatggacagataggcctgggcagccagcagcccgggggctcctagcccaggccaccaggaaacccatcacaacaagcaatggccacagggggccaagcctggtgacctgtgacagccccgcctgcccacctggcacccagtggagagctgagcctgggacgccttggggacaacttcccctgcagcacccctgggtcactcaggccccatggtcaggggacgaggcctgccctacagctcccagagcagcaggtggggcagggtgaccaggcagacctcacctcacagagaggcccggagaagccctgggggcagtggcagtggaagccgtcggccaggtcctcgcagaggccgccgctgtggcaggggctgctggcacactcgtctcgttccagctcgcaatgccggcctccgaagccccgtgggcacacacactggtacccgttcaccaggtcctgggcgggccagccaggtgagcgtcccgcaggcaccctgacggccccgcagcacccacgccacacaccctcctggccccgcctcaccttgcaggtgcccccatgctgacactgcccgcgacagtcgttgacgtctgggggcagaggagcagggtcagaggcggggtcccatgtgcctcggcccacccgccggcgcccaccccccatactgactgatatggcagttgatgcccttccagcccgggatgcaatcacagtaatagccgccaatcaggtttttgcaagaaaaagcgttaaggcatggcttcccttcacactcattggcgtctgtgaaagagacaaggtgggagccgtggggctcgggccctgcctgccccctgcagcacgggcacctggcacccgcagcccagcagccccagcagccccagcagcccccgcagccccagcagcccccgcagcccgcatgcgcggcccacgttcccatgcactcgctcggagcccttacccagctggcaggtggcccccacccactgctcggggcagatgcactcaaagccgtccacctggtccacacaggtgccaccggccgcacacgggttcgaagcacactcatcgatgtctgcagagggtggagaaaggtggggccctggcagtgtgagccgtgggaataaggtccccatgggcaggtggcgctgcaagcctgggtcttcctgccatttgtcctcgccaagccagccgcagccacacgtgtggacttgaccactgcaccccatccccagcgagttgccccactcccagacccccactgatactaggcaggagtcccctactcacgtgcagacactcaccaagggcacaggtgggcccgctccagcccgatgggcagtggcattcgaagccggacggcacctcatggcaagagcccccgttggcacacgggttggaggtgcaggcgtgctcagctgtagaaccgcggggagggggcagagctggcagccaggcccccagctttccacaagcactcctccccaagcccacaggttcccaagctgggggtcaggggcccaccacacaggacgccagagggatggggcctgaccggctccccagggaaccagtccctgcctggccagaatttgggtggccagccccccacgtacccttctcacagttcctgcccgagtagccgtcagggcaggtgcagcggtactggtcaggctcggcgttgatgcacgtgcctccgttggtgcaggggtggtggctgccacagtagttcaggtctgggggcaggggtgggatgctcaggggaaaagccggccccccgctcccccacaacccacacttcgatggcagagcattaggcctgccgccccctaccactacctttgtcacagagcaggccgccccagttggtctcacagttgcactgccagggctccacacaactgccatgcacgcagccggggtaggggacacactcatcgcagaacctcccttgccagccgtagctgcacctgggggaaggaggaggggcgcaagacccagtgagctgtggtgcctgaaagggtggcaggggagccaggcacagtcacccacgccacacccagggccggcgggcggcctcaggcctttgaactggagcagccccagccaggcaggggttgcagccctgccggccagccccactgtcacgggcattcccggccgctggctgccgacggtcagccccagctgtcccgtcactcctccctgagctattttgggattcacccgtgagctgggccccgagagcaggcaccaggaaaggaaggccctgccgggaccccggggatgagaatgccggctcggactcacaaggtgctgccagggccgggaggcaccaggggctgggtaggccagcgggcagcaggggagcactcctggctctgcctcggccatgtggccctgggcacagcacgtgccctcgcccccacctcaaaggcagtcatttcgctcgctcccagtaaagtcccacaaggtacccatctcacagatggggctactgaggcccacaggctggcctgggccagccctgcccagggtagttcctgattctgcaggagctccagctgcacccccagctgcaccccccaggacacaaccaccaggactcgccctgccccaggctatcggccaacgtcctgtcttgggagtcccccaggagagggcaggtggccagggtagaacatggcctgacttgagggtgcctccgtcaggggagagagcctgcaacgaccccaaggctcagcaggctgccatccaggccctgccgggactcccggggggcccttcctagaactctccggtcctgcaggacgggaatgtcatccaggccacgtcacttccacaccggcacccgccacactttatttttgtaaaaggaaagaaccacggcccttcctgagccgccctcaagccacacagccagcaccgaaggcctatcagcccagttcagctgccacaaatggggaaactgaggccgggaagaacgtgtctccagtatccagcccagcatgcacagtggtccgcgtgggtggcctcacatcccgcctagaatccctcctccacagacacagagacccaggctcagggcggggctgtgacacaccttgggtcatcggccagagagcggccacagccgggctcagagcccagacctcgtgggtcccaagggcgtgctctcgaccctgggcagggcagcccacaccaggcccccacctcctggtttccccagccagcagccccagggccctggagaggcggcggcaggaaggcatggccatctccgcagcatccggtgggggggcgtcctgcactggaacctgagccgaggctgtcagcaacagctgggcctccccgacagggccagcaagaggggcaggcggagctcacctactgcccccacccaccaggccccccagactccggctcatcttcctgcgggtaaagggcagggatggccaacttctctgctgccttcctccagccttggtgtgacattcaagctgccagccagcagccatccagggagggtggcactgccatccaggttgtgtgatgcacactgggccaggcgagggtgagtggggccgactcccgtagatctacatctacatctgcccagaccaggtccaccttgttgcactttctgagctgacttgggactcgctcaacctgccgggaatccctgtgtgtgcaagtgaccgggtgggcggccccagccctgcttgcctccccgctctgggactggccgggaaagctcctcactgtaccctccaggccactcaaccgtggggcctgtggaagggtcacccacctccccaccttggctcccaactcagctggttcccaaactccccgactcctctccaaaacgccacgctgtgtgaccctggggaaatcagtaggctctctgtgccccagtgtcctcgtcccatggaggcaaacccactccacagagggaggtcctgggacccctgcaatccaaggctggctggagggcggtgctcacctccacctgctgtctctccacccgctcgcgcccctctctcgggctccccagcttgctcacgcacagtgagcgccacggctcgaagcccgtgcccaccccagaccctgggccccagcccctctggttgccctgctgacttctctgctccactctagggcaaagctgccagcccccctggctggatcccccacactctggtctgggtccagaggcctccaccatctggacttggctgtaagaccccggacactcccttgtggaggcccttgctgactcctcatccatccgccctgacctgtggcagccgggacttgctccttggcctccctcctctctgccttccccactttcccgtcaccgcctgaatgccaccccccacaggccccgcgtggcgcaggccaggcctctcccacgagctttctgggtgtctccagggacagggcaggcatcgcctctccacatccagctaaccccggccccgcctgctcctctgtggcattcctcctgccaccatggctctgctactcagcagcttggggttctccctgactccacacccttcctgcttgatcaaatccatccacaaacccctgggctccaccccaggatgtctgcaggacccgtgcgcctctcccccttccactgaccccctccccatcccgctggcccctcccccaccacccccacatgccccacagcggcctccccctcacagcctcccgtctggtgcttccccactcaacagctaccacagcccttccacccaccttgcccagctacaaacctgccagcagccccttcctctgtccctggtcctgcaggcctcagctcccaccactggtctgctctgccgcccctcgcctgctggtgtcacttgccggccgctcgccgcccaccccctccccatgggcagggttaccgtgtcctctgcccatgccccatctctgggtggcttgcagcctccgggtctctgcccctcggtgacgtgactgtccagccagcctccccagtctctcctcactgtcctcacatggctgccgccatcagacacatcccatgctcagacacgcacctactgcactaaggagcctcccgagctcagggcccggctctcacagctgtgtgcccaacctccagccagctccgggcgactcctgacagcaaggctgtgtgtgccagtgaggacgtgagggcaaaggttgggagggcaaagacgggccggcggcacactcacctgcactccccaggcacggtgcatcccccgtggagcaaattacacccttgtttacacacagctgcgaacagagaggagcgagaggcacagctgcagccagcctggccgcaaggcctgtgcccggggccctgcccgaggccctccctgccctccacgcagcccagcggccccctcaccttccttgcactccttgcccatccagccgtccatgcaggccttgttgccgtactggtcgcaggtgtagtggccgaaaaagtcgttgcggggccggcagaacttgttgcaagtggcgctgtagtagttctcgtcgcagcgcacgcggatctgcagctccaggtgcgccacgtggccgctgaagtgcaggctcttccagcggtcctccgggttgatcatgccggcatgcgacactcgctcgatcagcagctcctcttggggaggcggcagagtcagcacaggccagagaaaccagcccggccaggggtcctccaggaacaacggggacggggcagaagcctgcggctgctgcaaggccggggcacagcaggcagcagcacacggagggcagggcccccggccaggctgctacagaaagctcagggccccgagaggcctctccctcccgccaccaagcctgcgccccgctcccaccctaaacgcagagggtcggggggcccggctaggggctaggggccctgcagggagggctgctgagaccacaggctccacagagaaggcacggctgctgccagggcgtgagtctcacgtcccacacctgtgcccacccacctgcagccctgctccaacacctgcacccacctgcgccgtgtccagccctcgacagcacggacatggtgctcagttgccctcccctctcctgcgctgtgacttgctcccagaagtgccaaacaccactaccgtccccaccttaagacaagcctcccctcaggcccccaagacaggcataggtcccgtgacccgctgtctaagcctcactttaagtaagccaccaggagaccaggggccaggggcaccacagctgctggcgctggtatgcaaagtccgtgatgccggtccctgcgcttaggcacaggctcgacgttttgcacaataaaaggtgaacgggtcctccagaccccacctctcccgcctcgggccaaggcctgggaggacactgtgctggcccactccccaaggggcgtcccggccgccccagcctctccaggctcacgttgtcaagagccctgacgaccttgcttgggactcagcccacctgtctctctgccaccccctcaggaaacacccctgccctgagccgctggggtccccacaactgctgctccccacctgggcacccccaccgccgtccctgccctgaaaacagcccctccactctgctggcagccaggatgccctggccccgctctccctcctccaacccattggccaaccccatgcctccacttctgagagcccctctcacccccagactgcccctggtccaagtcaccctgacacgcccagattcacgtggcagctcctcctcggtctgtgtcctggccccacagcccaccctccataaggcagccacagcttgccaggcggagcccgtgtcctctcagtggcttgccagcctccatgatctgagcccagccccggctgctccccctgcacagccagcccgctcctgcccagaccttcacacgagctgctcccttggcctgtgggtgcttctgcattcacccatggaagtcatcccgttacccctgcagggccctgcagagcccctgcctcagggagagggccaccaaggctccatgctccagtacagacaagcagagggggccacaaagccagagacacactcaagggtgtcccctccactaagtcactgccatgggccccaaaagagcacacccaagaggagaacaacataggcaaagccaggactggggaagagagtgcatgcacagctctgcaagtcccaaacgtggcagagcttcctggcagccaaagcaaaaagggaaacagcacacatgatcctcagggtaaagcaaggctttgtcccaagcagacagaggagctgggccctgccacaggcacgctgaagctgagaggagctgccacctggcccagggctcactcaccattcggggtggtatcgttgtcccagtcccaggcctccacgatgagggtaaaggagcgctgcagacatggggaggcgggtcaggtacctgaggccacacctgcctgcctcgttcagggtgggacaaggcccagggctcagacgctgcccctgggtctgccaggctctggcccttcctccccagccagggacccaccaccctcctcatcctcaggccacatcctctgcagacccaaaaatgacccagctcaagggagggagactgcccctccaggccacgcgggctcaggggcctgggctccctaccgttggggtgccagaggcccagcctgccctgagctggctcaagtcagcacggagcacaggaagagcgaccggggggagaggtgggcaaagggcagcctggctggagtggccacagacaggggccccatgggcagccgggacccgagcgtttcctgtggaacgccccttggtgcctcactgggggtgaccacgggggagaacgtggggccccatcaccacgctggcggcctccaccaagtgcacggggtggccaagtacagggcgcccagccagaggccccaacaggccggagctcaggtcctgcaggcatacagcacacaggcaaacccacacctacctccaccctcacacagaacaggtggcaggaggggcccttgcggtacagttggggaaactgaggccaagaggtcctgggactgcccagcacagcctcagaccatggccactatgccccctctgcccccgggccacctggcccttgtaccccagccatggcgacaggcgatgctgtcagccaagcaaagagaccacagggctggccccctgctccgcctagtgcagcccacggagaccgtcactcacagacatgctcagacaggtgggacccccgggacatgccctgtactacccagcactgggtacccacattccacagcctctcagccctcactgcccaggaaccccccagtctacccctggtgtgctcttgacccctgagcccagccctggctccttccaggtggggcccagaggagggggctggggctgagtcacctcagggcctgctggcttcccaccccggggggatgctgcgttgggcagtgtccaggcaggccaggctcactccatccctcagcacaccccatccaaccagccccaaggcctggctaagctggggaaaaccacacttccccagcaaggcccaaccccacgcctgccagcccttccctggtcctcacccgccgcccaccccacgcacgtcccagtgcctcggcctcatccagctaaggacaggcctggcctcccaagatgtctcagaagactgcactcccacgtccagcccctcccctaaccaacgtgctaccagccacacccagcccagcctccaggacccccacccagtcccccgccccacacctccgactgtccctcaaatacagacaactagggcccaacatgactgctgaccctgggcctcactcacagctgggcaaccccggccccgcccccgagcccctgcctgcagaacacccggggacggcccgaggaggctcacccaggtaggagcacaggatggaagtggggggccatccccaacccgctcctagaaccctccctagccacgtcgagctgacaacagaccctcaatcccacctcttaagctccccttaaacccgttttcccacatccgccatggccccgccaggccacggggcccagtccccgcccatctccagggctccctgaggtcaccagggcccgcaaacctctgcctacaggcgccagacaatccccagagttccatccacatgcctcccaaggctccgtccacaccccccgccgagctctgtttacaccccccagagctccatccacacccccaaagaactcaatccacatcccccaacggggttccatccacaccccccaacaggctccatcacctccccagggctccatccacaccccgcaacatgctccatccacacccccccagagctccatccacacccccccagggctccatccacacccccccagagttccatccacacaccccaacatgctccgtccacacccccccccagagctctgtccacaccccccaacatgctccatccacaccccccagggctccatccataccccccagagctccatccacaccccccgagttccatccacaccccccaacatgctccatccacacaccccaacatgctccatccacaccccccaacagggctccgtccacaccccccccagagctctgtccaccccccccaacatgctccatccacacccccccagggctccatccatacccccccagagctccatccacaccccccaacatgctccatccatacccccccagggctccatccacaccccccaggactctgtccacaccacccccaggactgtgtccacaccccccaagggctctgtccacaaaccacccccgtcagctccatccacaccccccagggctccatccacacccccaccaggactctgtccacgccctctcagctcagagcacccttggggttcccaaggctcctgcccacccccacccacccaccccagcctatcaacccatctgcctggagcaccaccctcgcagctgcacctggccaagcccttccccacccccggtaacacctggagcacccagccgcttcccaggcgtctggcatttggctccttccttcgttccttccttccttcgttcacatcaagtgtacagcaggcatgcctctgccaccaaggacggcaacctatagccagcggggctcggggaaagcaacagggggcaggggctgttgttccaataaggccaggccaacgggtcacagtggctcacgcctgtaatcccaacactttaagaggctgaggcaggcagatcacctgaggtcaggagttcgagactagtctggtcaacacggttaatcctcatctctactaaaaatataaaaattagccagccatggtggcaggtgtctgtagtcccagctactctggaggctgaggcaggagaatcacctgaacccaggaggccgaggttgcagcgagccgagatcgcaccattgcactccagcctgggcaacgagggcaaaactccatctcaaaaaaaaaaaaaaaaggccaggccaggctttgaacaggtggcattgagattgaggctgcagggcatgaggaagtgaaggagctgcatggcagagcccacaagaaggcccaggggctgagaacgcatagcccacggggacagtggggtcataccacagatccagaccccaccacggacttccttcctgaggctaagcgaagtgggtgactgttgcgggtctgagtgaggtctgttcgggtgttgggggtccgagtgaggtctgttgggggtctgagtgaggtctgttgggggtctgagtgaggtctgttgttgggggtctgagtgaggtctgttgttgggggtctgagtgaggtctgttgttgggggtctgagtgaggactgggacccaccaggctttaacagtcactgtagccgctggacaggaaccagcaggaccaggaagcagcaatagtgaggtcagaggatggggccagcatgggtctgagagcagctctggccacggggcaggcagagaaaagccaggccacccggtctcccggcacagccacacctgggcttcagggccagcagggagttcctctcgactcccaggaaacctcatgccagccactcaggtaagattactgccaccttcgcctgagcccagggctccggttacctgctcccgcagggacgtgtgcctgcccgcccgccgagagggcctcaccgcccgccagctggggtccctacacctggatggcaggaagtcatccagagtgaacctgagctggctgacggggcggtacctgcctcaccccacctgccagctctcccagctccccttcttccctaggggccagcctccaggacttatttgcctcttctgtgaataacaacctctcacccccgtccttccaggactcagttgcctcctctgcgaatagcaacctctcatccctgtccttccaggactcagttgcctcctctgcgaatagcaacctctcacccctgtccttccaggactcagttgcctcctctgcgaatagcaacctctcacccctgtccttcctgcctggcgggccacgatctgggacagggttttgtcaacaccaaacccctagaacacaggagggactatagggcctggattgggcgggggttggcgggcatgttgcccttctaggaacggggctgggacatgtggggatgtgggcctggcgctggcaggggcaataggcgatgtgtgggctgggggtctggggacaggtgagagacccatcacctgcccaggttccccggcaagcagggagaggaacccaggccctccctcaaggccagcctagcagggctatgcccctgcccagtctctggaggccaagggggaagggcttcacccctgcaggcccagctaagcctctccctacaagcccggcctgacccacccccaccgcacaagcagacccgcagcccaacttcatctcccaccatctgattgcctcctccccagcccgaaccctcaaggctaagtctaaacccctcctcctgtccccaggcaggggcaacagcagtggcacaagccagaggacaggcagacaagacaatagatgttccaccccaggccagggcacctcaaagcccagggtaccccaggtccagggcaccccaaagcccagagtatcccacagcccagggcactgcatggcccagcatactccaagacccagggcaccccagttccagggcaccccaaagcccagggtaccccagagccccaaagcactgcatggcccagcacaccccaaggtccagggcaccttaaagcccaggacacctcaggtccaaggcacccaaagtacagagtaccctcctgcccagggcaccctagatccagtacaccccacagccttgtgcaccccatggcccagtgtacccacagtccagggcaccccaaagctcagggcactccaggtccagggcacccccagcccagggcactgcatggcccagcacacctcatggcccagggtactccaaatgccaagcaccctaagtccacggcaccccactgcccactgtaccccaatctacagcatcccaaaactcaggcaacccaagtctagggccctgcacggtcaaggccaacacagcctccctgctgccccgctaacggcccccccaggtccagggccctgcacggtccaggccaacacaacacagcctcctagacctgctgccccaccaacgccccgacttggtttcttctcctcggcctcccgcatcagcctcccgccccctacggagcacagcgcttggtgcaggcgccaggagctccaagcacagatacatttcctgaaacctgagcttctgagaggcccaggcctctgccaccattgtcacccgaggcagggaagaaggggtgggggcaaacaccatccccagggctctgggccccagggccgcagcaggaggagcagaccaaagcccatcccacgcaggaacacacacacccatgctccacaccagagaccagccagggccttgcctgggtgtacccccactccccagcacaccccctctaggtcccaggtcccccaccgtgaagacggtggcagccagggccggctagcacctgccacaaagcccagggtacaactgatgccagccacaccctgctcaggcctgggatgtggggataggaatcccgctcaggcctgtggtctggggacagggactccgctcaggcctgtggtctggggacagggcctccgctcaggcctgtggtcttgaggacagggactccgctcaggcctgtggtctggggacagtgacctcactcagatctggggtctggggacagggaccctgcttaggcctcaggtctgcagacagggaccctgctcagtcctgggacctggggacagggacccagctcaggcctggggcctgaggataggggccccactcaggcctggggtctagggacagggactccaatcaggcctagggtctggggacagggaccccgctcaggcctggggtctggggatagcgactgtggctggggcctgggattgcagatccttgtcttcctgcccccactccaccaccagcagcagctcaggccgaagcctggctccacaagcaccccttcactggcctagcttgctcccctcataaagacaccatggagcagcccaggagggcccctgagagcagcagtcccctcccacccaggcctgccgcctgctccccaacccgcccctccacctcccagccttcctatcgtgctgcggctttgacccttcagcccaccctcagggaccagcgacaaacccccagcccactctccaatcctccctggccaagggcagtcctccctggctccaatggtccccgtgttgcctgggcactgaatgccccaccctgcccccataccaaagctttgaaccagacccccaatgtacaaggcggacatgccctgagttctccccagggctctgggccccagggccatggcaggaggaacagaccgatgcccacccaacacaggaacccagatgcccacattccataccagaccagccagctctcctggtccctactgggaaggtgtgggaaggaggggggtggtccccagtgtgcagacaggatcccctgaaggtagggtggggaggccagggccctgtcatccccagcccaagctcagaaaaaacaggaagcagagtggtgctgaacctcacacctgccacgagcagcttaggtagctccaggcacagacctcagcctggcccaccttgagccctagggcggctggatgcagggggtgggctctgtaaaaaccttcctccctagggggcaaaggagagggtagggaaggctgggaaggggaggaactggacaggtctgggagccgggctgggggcacaagcagagcccgagctgggagtccagcagccccatctgacttcgtgagacctgcaatgaaaaagcggcagtgtgcccctttcacaggtgagaaaagctcagcccttctgatggcccaggacctcaggcctcctgagctgatagacgcagggtcagccccaggcccacctcctgtatctacagggccttcacccatcccgttctcctcataagcccagatctgtcacggggaccatgctccagccacaccaccccgcacagctgccctggagcccagcacacacatgccaagacagaacaagaaagaccctcgctggcaggcaggctcctgggctcctggctccagagatgggccagccaggcaggcacgacttccagctgcacctctgagggtggggccctggctgcccaggtcacggccaactgccaccaccctgctcctccctcagccagcaggtgtcccctgggcctgccacctaccaggccccagagcaaagctccctgctgcccccagcatgacactactcctccccaaacctccatcaccacctgccatgcctacagagcacccggggtgcgtgcacacacgcagctgggagaatgtggcctcaccctgccagctacaagccaggcaccagaaccaacccaggctgacaccggcctcctggggacgtctgggggtggagccaggagaggaggggcagccaggcagcctgctggcatgtggtccaccacctctccacattcaagaccctgggcccacccactgagggaagctgagcccgagaccagcacagatccatgactaatagcacacagaccccggccacaagaagccaggccagggggcagagggccacccagccaggcctgggtcaacagcagagaccacaaggtgggagagtcactcagggggcagggggtggagggagcgaatgcagagcccagactcccccactcctcttccacaaggccctctcattccctttactccaaggagcccaaaagccccacgggcctgggcaggatgccaccctagcctccaggctgaaacccctcctcaggtcccagggagcctgaactcggtccttgccttcccatcacagccaagtacacctcagctcaccgcacagagctggacctcagcaagccagggcagcatggccagggactgccgccgcccgagtgcaaataccagggtgctggcatcacggcacagctcccgcccggcagccaggccacatggcaggagaccagggctgcccccaaacacgcagctatgactctgccctggcccccaacccagagacaggccgcctgccccctcctggggcattcgaggaaccggctggaagcaagaggcagggaggtgagctggccccgaaacccagtgcccggactccaaggaaggcaagggcctacccggtcccatcccacacctgaccggctggcccgcggggcgaagagccagggcggacacgcgatagcccgccacattcctccaagacctccctgcccccacacccactgctgccaactcgagcagaaaacacatcctcaggtagcgatgtggggccacgctggctcaggcccaggtgcagatgacaggctgcgggccctgctcagacctgcctgctgcaccgccgtgggggcgaggggctgggcttctcacaactgcctgggccctcccatgcccgcccctgccttttccatctgggggacactttcccctctctggggcccccctggtcaagggatactcggcggggtgctcacgggttgaggacatggccagaggagactgtggccagcttccacgggtgggagctcaggaagcggtgaggatgggggcagcaggcaaggctgccagccagggctgcaaaggtacagcacaggactgggagccacacacggcaggcccaactggcgtgagctcggcagggattgccctcaactcacaatcacttcagggcccaggataccaggtgggcacactccggtgcctcctgctgactggagccacttcctggctcccagatccatctactccctgatcacaggtctgcatggtgctctcattcccgcactcacccagttccaggcccccagcacaatgaccaagcagggaaggacctctgggcaccagggcaaggccgtgctccaggcaatgaggtaaggcgcccgaggcctgggcctgcccacctaccactacccacctgccagcccactgggatgagtacctgtttcccagtgacactggacccctaccacccctcctcccagcacgcccaggccagggctcctgcctgactggccacctgccaggggagaccagacagccccgactcagcttctgcccctccagaataacaaaaccaaaaaaacccacaaacagggcagtgccacagaaggtcactgcaccaggatccactatctctgtctctgaacgatcttgggtcaccatcgggggcttctgccgacataagcgttaggcgttaggctctcccgggcctaggtcccacggcgcccgcccgtgccccccaggcatccaggaaactgcagggcaggcgcaggctggccacgggcccggggcggctcagtcagggcctgccctagaccagccccagcacgcgctgcgcacatgccaccgcggcctgcccgggaccggggcgcctcgcctcgcctccccacccagacagacacgcgcagggcgacgcaggcacacgccgcacaccgccgcgcacgcgggacgccgccgccccgcccccgccgcgaccccgctcccggtggccccggggccccggcgcgcccacgtggccaggcgcggaccaagtccccagagcacgcgccccctgccggccccgccccgcctgggcgcgcgcggctcgcacgcagacccggccgcaggtgttgggggtcgcgaagcgcgcggggccggggcgcggagagagagggaagggctggagcacgagggatggagcgcacgtaccggccaggcgaactggaaggggatgacgacgaggcccgggtcctggtcgccgccggcccgggcccgcgcccgcgctcggtcccccgcagcgcccgccggcggcaggtagaaggagttgccgcccagcacgggcgtggcgccgtggccgtagctgcagggccccgtgggcgtcaccttggcctggtactccttaaggcacacgcgcacgtacgtgtcgcactcgtcgtggccgcagccccccgcgcgcgttgtccggccgtcgccgtcacagcaggcgccgctcagcagctccccgttcacgttccgcagcgcgctcagctgcagctcgaaatagcccatgggccgcgccgcctaaaaataaggcagcgggagagcggagggaggcgcgggccggggtcggcgggccgggcgccaggggtgggggaacaggccccgccgccccgcccccacccagccgcgcccgcccggagccccagccgccgcgcgcagcctcgagggcttccgaaccacggcggccccaggcagtgcccgcccggcccctaggggcggcccggtgtgccccgtccgcgacccccgccgcccccgccgccccgctcacctgcacccagagcgccagcagcagcagcagccgccggggaaggcgcccccggccctgcgcccgcattgcccccgcgacccgcccgcccggccccgccgccgccgcccgcgcccggctcccagccgccgcgccggcctcccagcgcccgcccgccctccgagcgcccgcagaggcagcggcagcggcagaggcggcggcggcggcggcgcgggcggggtcgagcgcagcgccgcggcgcgcgggcctgggcggcgggcgtgcaggggcggcggcagctccggctcgctggcggccgcgctccggctgcccggcccggctcccacccggcggcgacggcggcggcggtgaaggcagcgggtcccggcctcggctctgcgcgcccgcgctcccggcaccgcagccaacaagttcggaacgagactgacagctcgctcgcccattcgtcacccgcgcacctgcatatgcatgag

SEQ ID NO: 2061 - DNA, 27845 bp, Homo sapiens; identical to SEQ ID NO: 2060

SEQ ID NO: 2062 - DNA, 121585 bp, Homo sapiens
ggaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaaggtacagagatatttctagtcacagaggttcttgggtggagcaatgacacaatttttaaaatcctattagatattatgttgattacctgggtgacaaaattatctgtacaccagacccccatgacatgcaatttacccatgtaacaaacttgcacatataccccccttgaacctaaaataaaagttggaaagaaaaaataaaagaaagaatatcttattggcccacttcataggctttccactagtcattccctaccacatacttgcggagaaaaaaaatatttgaattggcattcctttcttcctttctgagctgaattaatagtagccttgggaaaggaaccatttgcaaggtataaacccagggctggtactataattcataatctgcatctattaacaaaaactgtgttttgggaagttttcttaaagtgatttgtgaagctgttgagcttaaggggccaacactgtcattttatgttttcctattctagttcatttagcaaactcatatacgtttatgtttttagtttagttttcttcccagggtcttatcttggccaaggtagactcaaaagtgtggttattcttatcgtggtatgtctttgtctttgggtctctgaatgctttcggaactcaattgttatcgtacttccttgggtataggttgaacaatttgacaaaggaaaactcaaaataatcatgataatcttaaggagccaattcaccttacctgtcaacgatggaactagcctcttgaaaatccaggaagctcttttctaagctgtctcagcttgagctcaaagtggaatcatttattcatgaggttgggttacagacagcggtgaaggccccaaccattgtatatgatatgccatgtctaccattcaagcattgacatccccggaagactttccagaaggcaaataatcttcctaaaagttataggtagaaaaagattatagagggctatttagaattcatcagtttccaggtgacaaaatccattattaaaatttgaaagtatgagagaaaagactggtaaacaggattgtagtcgatacagtcaaagctcttgatcagctttccagttctcaggaatttttccagatttcactagatctggaattaataccccattttttttctgtaattaccagcctgatcaaataactgatttggaatcttccatctacctaattgcatccgtgaaggtgctttccctgtgtcttagagacagaatattgagggtacaatcatctgacgacgaaaagaaggcagagaaagataactcctcccagagctcactggcttttattagtagcccggctgtgctgtggttggggccacacctcattttggagtgagggtacttctcaccatctcctccatggtttccagcatcagcttcagcttggttgtcattaatttgaattattctgcaatacttggtgatgcatgtgtgtgactaaaattaaaacctatttaggtgaaattttgacagctcgtctctatgaccttgacagccacttagactatctcaagaaggaaagggcttgactgatagtttcctcctccgttttctttgttcatctgagaaaacaacttttataagatctgttcacctagctagacttcacccagtctctcagctccctttttaccaagccttagaaggttagagaaaaaccaggctagataatttaatagcctctccagatctcagagatgcttatactgaaggcagccagatagcaaagtcacgagtgttcctggctcttcaagtgccctatgcacatttcaccaaaggtaggtacatggcatgtatacaaggtgtggggcatatgacatccatgaagaaaattcgtctgtgaatgatattcctagccatgggctcagggttgacttccttaagccgtgtattactatgctagagcgtgaggaagaacttatttctcataggactgtttatatattacatttcactgaagaaaagtatgcctattataatttaatagctatatgcattttcacaaactgaattcacacttgtgtaaccagcacccagatcaagaaacagaacatttctgtaccctagaaaccccctcatattcccttctagtcatctccccaccctaaatccccaaggataacaactgtcttgacttttaacagcagagattagctttgcttggtttcatactttatataagtagaattgcacagtatgtactcttttttgtttggtttctttcaatattatgtttgtgagatttattcatactgttgtgtatagttgcagatcgtaggaatttctcttgatctttgtaactttggatcaattaaattgtagttgattagagacatgcccagggttgttgaatggccaatgattactatcccacagggtgaataatctcttttctccctcccttggggcattcccatgtaggcagaaaactcttaaattaggagctggttggcagatcataaaaatagattgagccaagcaccatggatcattcctgtaatcccaacaactcaggaggtcaaggtgggaaaatgcttgaggccagaagttcaagaacaacctgggcaacataacaagaccttgtctctaaaaaaattttaaaagttagctgagcatggtggcctgtgcctgtagccacagctacttgggatgctgaggtgggagtattgcatgagcccaggtgtttgaggatgcagtgagccgtgatcatgccactgcactccagcctgggcaacagaacgagaccctgatagtttgaggatgcagtgagctgtaatcatgccactgcactccagcctgggcaacagagagagaccctgatggtttgaggatgcagtgagctgtaatcatgccactgcactccagcctgggcaacagagagagaccctgactcctaaaaaaaaaaaattgattcattctcttttggctgggtaaagagcctctctgctttctagtaatgggcaaacaaacattcttcataccacaccccagttttttaacctcttttgtttagagtgtcgttgcacatgaattagaatcctactggttaagatatagtatcagataagagtcctaaggaatgtcctcagccattctgtagttacatgaatcttcccggggatttgctttgtgctatcagaggagatgccttttccaagtgaccctttctcttgggcctagctctgctcttaactctgagaccttggacaatgacttctttctgtgcctcagttccctaaactttaaaaaaagagtgtggtctatgtgatctccatggtgccttccaaattcaggataccacagttctgtgacgataaggggatcctacactgggggcttccttctggttgttaggttacctttgttaaattgtgataggtaaattgtaatcccacagataaggacaaacaaaagtggatataggtgtggagagggctagcttaagcaaatgaagaccagatttcttgaagaatgaagcattatttcaggtgctgatatctacagtgtcagcaatgaagaaataccaaattgggatccaaatacataaaatagatatgttttaccagtaaatttggttccagtggcaaaaggacccatttctctggggacataggcttagaaaagataccttaatttgtggtatggctgtacacacctgtgctttatgtgaatttgggtctgtttgtcactagcaaaagtcatttttaaaaatctttttttaatctataaaacttaatgattcactgcaaaaattatgataatagaagtcattatattttgaacctctatgtgccaggtattgtgttaagcactttatatgtattatctcctttaatccttaccataattttataaagtagttactattgtcatcatcgctgttttatgaaggaagaaactatggcttaaagagattaagcaggccaggcacagtggctcaagcctgtaatcccagccctttgggaggttgaggtgggaggatcgcttgaagcaaggagttcaagaccagcctgggcaacatagcaagactctgtctctacctccctcccccacttaaaaaaaattagctaggcatggtggtacacacctgtaggcctagctacccaggaggctgagacgggaaggatcacttgagcccagaaatttgaggctgcagtgatctataatcatgccactgtactctagcctgagtaacagagccagaccctgtctgtttaaaaaaaaaaaaacaacaaaaaaacaaaaaacaaaacagagggctgagagcggtggctcacgcctgtaatcgcagcgctttgggaggccaaggtgggcagatcacctgaggtcaggagttcaagaccagcttggccaacatggtgaaaccccgtctctacaaaaacacaaaaattagccaggcaagatggccagtgcctgtaatcccagctactcaagagattgaagcaggagaatctcttgaacccgggaagtggaggttgcagtgagcagagatcatgctgttgcacttcagtctaggcaacagagcaagacttcgtctcagaaaaaaagaagagagagagagattaagaaaaatgaaatgaagctaatgtttaactccagtcacctggctctagaatccaacgttttcatctacatactgtattaggattctctaagtatgttgtacagagaagagaaaatcctggattttctctgtttcattgaattcagatatttcacttagttatagaattaacctaatttttcttttgcacataaaccttcaaagggtatggagatgttgaacatcaacattggattgtttttcctacctggggttggggcaagcagctggaagttgggaatgaaatagggcagcatgtttatactccccaggggcaaaatatctgtgccccctgtaagagggaaacaaggactcattaaatgtgagaattggccccaaatctggctcacagctaatttagctaatttagggatgtcagggtggctgcacaattggcccctctatgctattgaacccccttaagggaggctccttgctagccctctggtttgtggtaatgtctgctggtacatattttacattttgcatgaagccatgttggagattcctttagctaaatataacatctggagaaagtagcctcctgttcacagcttaaaaacagactgactttgtctaggacgagagggaaaattgagcccgtttggtgctcctgacatctcctttcatgtaatgaaagctcagtctgtctaacctctgttggaaccagggtttgggcaaatattattgctgccaccttcatttgtttaatgcggtggcttcaaaaaccatgggcaaaaactgccaagtttgactcccatctccctgtggtctccatgaggggcatgttctaaagaagcccaccaagaacagaaataatttttcccacttgcttagtttaaactgaaataaacttgggtgtgctttttcctacaggagagaggataatcctgttttctctttttacttagctggaacacactaaaagtacctctgactttgctttctcaaatcactgtttctagcccttcacagctgctcacacttaagcttggaagctggtcagttcagacagtgctaaggctcagttgcatccttatttttacagcactgcagtgaactgtactcctgttttgctgttaggactcttaagtttctatggcaaaaatttaggttaaattgaaaaagccaagtcagattccctatagaccagtagctttcaactttgcctgggcatgaaagttacttggggagttttaaaaaaatctttgtgaccttgaataaacaaaggtttcttagaatataaaaagcatgaaccataaaattttataaaggataagtcagacttcatcaagtcttggacttttgttcctagaaagactttatttacaaaatgaaagacaagacgcagactgggagaaaatatttgtaatatgtatctgacatggacttatatcagattatagaataaagaactctgagaactcagtaataagacaaactacccaaatttttaaaaatggaaacaggttttaataaacatttcactaataaaaatatacaaatggctaatcaacacatgaaaatatgctcaatatcatcactcgtgatggaaacgcaagttaaaactgtaagaagatataccatacattcactaggatggttaaaattaaaacatctggcaataccaagtgttaaggaagttggccagaaccctcatatgttgctagtgagagtgtgaaagtggtacaaccactttggaaaatagtggcagtttcttatggcattaaatttgtacttgtcatatgacccagtaattccaggtatttataggcatctacccaagagaaataaaagcatatgtctaaacaaagacttgcacctgaatattcataaagcttttgtgataggctgagtaatgcctccctcaaaaaaaaaaaaaaaagaggtccatattctaacctttggaacctgtgaatgttaccttatgcatgtaatactttgcagatatgactaatttaaggatcttgtgatggggatattatgcttaattagctgggtgggctgtaaatgcaatcacaagtgtcctcataagaaggagattacagataaaagagaggaaggtcatgtgatagaagcagagggaaacagagtcatagagagaggatgctatgccactggctttgaatatggaggaagtggccatgagccagtgaatacagctctagatgctggaaaaggcaaggaaacggattcttcctgagagcctccggagcagaagcagccctgctgactcactggtttcagcccagtgaaattggttttggagttctgacctccagaactctaagagaacaaatgtatgttgttttaagccaccatgtttgcagtaatttgttacagctgccttaggtactttattcataatagcccaaactggaaacaacccaaatgtccatcaacaggtgagtggaaaaacatattgtagtgtatccatatatcaatactactcagcaataagaagggaaatgctgatacaatataaatgagctcaaaaaacattatgttgataaaaagaagccaagcacaatgagtacattctgtatgattctgtttctataaaattttagaaaaaacaaatctgatctatagtgatagagaatagatcattgattgccttggggccaggatggggatgaaggattgactgctaagggacacaagggagtttgtagggtttttatagcctacattatataacattttaaacaatgctttataacatttttataatgttacataatcttgaccatggtggtacattagacagactttatcatattatacacttaaaatgtgtacattttattatgtaaattatgcctcaataaagttgatctaatttaaaaaatactcatgccaagaccctaccccagcatgatttagtcagaatctctggagtagggcctgggtgattgttgcctacagctagggctgagaatcactgctgcactgttttccatcttggggaaactgcagagcacagagaatatctgatgccctaagatcctgtctatctgtatgtgagccatgtttgcctctgcaacagacagtgttaaagcatctaggctagtttctctaggcaacccattgtggtttcctactttattcttggagggtgatgaagggtgaagttagcttcagataaataaatctggtgacaaagggtgaatctggcttccttcacactgcaggaagtggggaatgcaagaagagtgctgaggaaggaatgtaagaggctcagttaatacttttctccagggccttggagatgttaaacatgtccttttgccattagtgaatcagtcacaagagaattgccacaacagtcagatttcttttggcactaaggaaatgaatctggtagttaaaaaggataaatgagatttaaaactaaaagcagtgcatgttacctatctgtttggtatccatttggactgagataggatttcctatggcgtgtcttgagtccagctgtttggcatgtgtgagaagagtggatgatgaaactgtgagagggcattttgggtggtgtgatggtcataaataagaagaggagaagtggtgacccacaatgctggtatagttgaatgtccctggtaagtgctgtggattgaatgaatggaggaaaagaatggttttccaaaggttgtgtccctgtgctctgcccccttaagaaagggtttaactctttgggagaaggagtagatgagtgatttaaccctccctcccttccccgtctaccatatccctcctgctcgtctgaactcagtatctgtgattggactgaatttcctccacattatagcatggtcactaacagcgtttgcacagtgctttacggacagctgttccagttgcccagtttatcttgttggtagcaaaaatctgttctaattaattgagctttattctctcatatctgatgaaaagatcctctttggagaaaagaatagaatgtgaagctgagcttatttgagtaggggatggaaggctgccagctacttcaaaggtatctctgctgataaggggcgtcaggtttgctgccaaagccaacaccgaggggagctttgcagctcgtgctgttgggggtgttttagctttggtttctgtgacactgggtcagcagcatctgtgtgctctcccttgaggctgctctctgggtggtccaggcttttatttagacttcggaaggtgcagctcaaagggaatgtgtgcatcaaagatgtctgtagtcttttgcttaggttagtttgtgtgtttgcctttttggtgttttagttcttaggtatctaccttttctaaaagagctcaaggtgctatatttagaactttcaaaagtataatagtacttcgatttgtataaatcaaaggattattaagggaatctgaagacgaggaatggaatatgggaaatggaatatgggaaagagaggtgcagtagacaaaaaataaaagtgtccatatgcaaccttgtattggaatactaccctaaattaggagattatacagtcaataagtattttagtgaatactgcatgcacagcattatgctgctaggtgcttaaaagagcttgaaaatcaaattgaggagtaagatttgcctcccaagggagcttggggtttttggtttatttaggtctctcaaaactttctgtgggatgatgatgatgacaaagtaataatagtaacctttcgtaaaattcacactgtgaatacctcccactgtagtaggccctagatgtgtattttctctgaacctttcatctatttttgcaaagtttttttcctaaactatttatgaaagtataaaatacttagagaaagtacacatattataaagtgtacagctcaatgaatttttacaaactgaatacagctatgtaatcagcacccagatgaagaaagaatgttactagtatcccatgaaccctccttctctccacttcaagtcattactctctgaagggtaaccattatcctgacttctaacacaatataagtatttgcccatttaaaaatttgtttgtgtaaatggaatcagataatttttttcaacaacttgaatatgtaattcacttgccttctggcctccattatttctgatgagaaatcagctgtggttcttagattcttattattgcttacttgtatgtaatatatcatctttttgtttgtttgtttgtttgttttaaagagatggagtctctgtcccccaggctggagtcctgttgcatgattacagctcactgtagactcaaacttctgtgctcaagcaaacccagtccttccatcttggcctcccaaagtggtgggattacaggcgtgagctgccatgcccagcccttctttatttggctgcttccaatatttattcattatctttggtttttagttctttgattatcataagagtgtaagcgtggttttcattgtattcctttggcttggttaaatataatatccagacaatccctgatctgtcaaatatctaatttgtagaaattgtaggaaaaatatcaattttttcctcaatttgagaaaaatttttggcaaatatttttttctgtcccatctctccttcctgttttgctttgttatcaattgcatgtatgttagactacttgattcagtcccacagcttgttaatattctgtccatttttttcaaatttttgttttctgtatgctttagtttagatgatttctaaagtttaccaatttggctgggcatggtggctcacacctgtaatcccagcactttgggaggccaaggtgggtggatcacttgaggtcaagagtttgagaccagcctggccaacatggtgaaaccccgtctctactaaaaatacaaaaattagctgggcatggtggtacgtgcctgtaatcccagctgctcaggaggctgaggcaggagaatcacttgaacccagaaggtggagtttgcaggaggctgaggcaggagaatcacttgaacccggaaggtggagtttgcaatgagctgagattgtgccactgcactccagcctgggagacagagcaagactccatctcaaaaaataaataaataaataaataaataattaaaacaaccaattctttcttttgttcacctaagatgctataaatgccatccaatgaattttttttatttcagatttttttttttttttttttgagatggagactcactttgtcacccaggttggagtacagtggtgtgatcatagctcaccgtaccctcagactcctgggctcaagtgatcctcccacctcagcttctcatgtgtctgatactacaggtgtgtaccatcatgcttggctaatttttttagagatggggtctcgctgtggtgcccaggctaggcttgaactctggggctcaaatgatccttccccttcagcctcccaattattgtatggatatttttaaaacatagttggcaattacttaaaaatccttgtttgctatttttaacattgacattatctgtgggtctgtttattgattttcctcttgacttttttttacatgcctactaatcttttattgcatattggacatcatagataatatgtcatagaaactctaggtgtacttatcttcctctgaagagtatgaagttttattctaggaggctattaaattactggttgatcaccttgatcttgtgggggcttggctttatacttcattacagtgggtatattttggttttgcccttcgtcttagaaaatactgtataattaaggcatggcctttctggggttttcatgggaagcccaagatgtttatcaagcccctctaacttggcaggctttgaatgccaaattctatcttccttacagtgggcagcacctaagacgaccaactatcctgtttgccttgggctgagggggttcctaggacatgagacttttagtttatctgttcaattgttgatggcatttggatagttttcagtttgaggctattatgtatgttataaataatgctgctatgaacattataatgggaagttattctttccaatgtatggttgaacctggtcacaagccaggctttaagaatagtgaattcaaaaccttttctctctctttctctctctctctccttctctccctcctctgtctctctccctcccccccttccttctcccctctgccttctcttccctctcctttctctcttccttttcctctttccttctccctctccttgtttcctccctcccttccttttctctattcttttgaataatcttttaaattttatagtagatgtatgttatagaaaatttaaaaatacagaaagcaaaaatatgatataaagaacagatttattgtacatactattttgtaatctactgttttagtcaagaccttctcctttacatttcaataaacttttgtctcatctaatacccaggccatgttaaagatttaattaattactcaaaaaatctctttgacaactagtttgtccaagccagtatctaatgcacacagttttatgtcccttaagtgtactttaatctagtattattttctttccatgaaactgatttgttgaaaaggccaagccagatgtcctgcaaaatctcccatcttctagatttgtttggttgtttacttgtgttgttaagcttctgcccgtatcccatatttcctgtaaattggaagttggttctaaaggtccaagtggattcaagtgacttagaatgcataataagtgatgttagtacttcatgtagcatcagagcaggaaatacataacatctagttagtctaccgatagtgatgctaatattggcaccctctagaatagggctgtgatagtctgacccttccattttctagttacattttttaaatcacatgatagaaacctgattgtaaggtgttattcatggtgccagcctacaaatattgggtgccagttcagtcattcgtctgataattttagtatcagttgataattttagacaagttactttttgtcatctttgtacctctcttacttgactataagatgcctctctgaggctgggcacagtggcttatgtctgtaaccccagcactttgggaggcggaggcaggtggatcacctgaggtcaggagtttgagaccagcctgaccaacatgctgaaaccctgtctctactaaaaatacagaaattagccaggcatcgtggtgtattcctgtaatctcagctactcaggaggcttagggaggagaatcgcttgaacctgggaggcagaggttgcagtgagccaagattgtgccattgcactccagcatgggtgacagagcaaaactccgactcaaaaaataaataaataaataaataaaataaaaatgcctcctgagaaaaggagaggattgttaatacagctcatcaggcaccatgcaaatagtagtttgtaaaaacgtattagtcttgggagaaaccacacacacgaatagtgtgcaagctgactaggtgtcaatttgttattattaagaatcacagcaataatttttttaaaaaaagcataattctaaatgaatgctaaccatgcctagggactgtgctaggtgttttacatgtattaacctatttaatctcatcacaacgacactttgagatgagtactggttttatcatccccatttgtagataagagcatgggcaaagggtttaagcaatttactgaagattatacagctggttgatgggagaaatgggattcaagcctaggcagttggcttcccctgatctcttcacatcatcatgctctgctgccttgcatgtaggaaggtggcagtcatattggtaagctaaagaaccagtgcttgtgcagggaattaatgactcatgcattctgcagtcatatgttgctgtgcttctgtcaggtcagaatttccattgtgctattctgattctgcttcttgcccagcttgtccagagagagagtagcacctttgattttagcctcccttgttgcaggacaggcttctgttgactcccctatttatctttgtcaagacttttcctttgaattcctccctgcttgtctgagcatgatttttatttaaagtgaggacaaaatttaagttttcctccttttgacacagcgtcttcagttttttttcattttcatcttctttccttacaatactggactttctctggtcttttagtttttctactagatcctacctttctttgcttttaagcccagcccttggggttttttgttttgttttctttttttttttcctttttctctgttctctacaaatcatttgggtctacatccagcttctcccagcatttactcaatatgaaacttccagttatagattaatttgaattctttgcactaattgtttaaaagaccataggaacctcagaccatccctcttcatggtctcaagagctcccagaatcatcctcttggtaagctaagtagttattagtaaggcccagggacaggactgagaagtaacatcttctattttttatttcagttttcctttaagttggaagcaaacaaacaaaaaacccttcagcttagggttttttcaattgttaaagtaatactgagcttcagttaaggctatgaaagaaaagaaaaaattttaaaaagtagtaacgtgtttttttcaagatattgtgggtaaaaacataataaaaagaaaataataattacttggaatcatgattaacattttgatgtatttccttccaatcttttttatacacatttttttaaaaatgagagttacattatatattaagcttagtgtaatttttttcatttaacatttggagaagcatttttatcatgtcattgcatcttcttttaaatgttgcctatatgatcatacagcagtctgtagtctggctgtcccttaggtttttcatatattccttatggttctttggctatgttgtctttttttttttttttttttttttggagatggagtttctttttttcaggctgaagtacagtggcgtgatcttggctcactgcaacctccgcctcccgggttcaagtgattctcgtgcctcagcctcccgagtagccgggattacaggcgtgggctaccacatccagctaagttttttgtgtttttttagtagaggtggggtttcaccatgttggccagactggtcttgaactcctgaactcaagtgatctgcctgccttggcctcccaaagtgctgggatttcaggcgtgagccaccacgaccagctggctgttgtcttgactctcccctggactatgttcttgtacatctagaagcaattaaaaatctcattgttgtctttttggaaatcacttgtttttaggatgactaggtagccaaggctttcatttggaaataccctacttccatttaatataaggtaaggagagagggtttttccccctgctgctttccctttttcttcctcttctgtcttgctcattgtcttagagcttagctgagaatcagtgctacgcctgagcttgggccctggctggctcagtggagttctttcaccatgctgagtttcactttcctcatctttacactaatgaaattactcataccctcactgttccttctcagaatgctataggcatcagtaaaacctgggaacaaagtgctctgcaaagttatgttatggtcagaaggtatctggttgtgttcatgcagaagagcgtgtgtcttgtgccttcgcccagctagggtggtctttgcaatctctaagctaatctttttttagcggtatattatcatataggctagaaaggaaatacagagaacaaactgggagatccagtctccaactttaatcatctcttctccaaagccaagataatccaagccttctgcccacataagcattgcatcccttcctgccttgcctcttcccatgaccttgtttttcttttgatgttcattttgagggtggagagtagaaaaagcattctctttttgctgctctcagagtcagtggtctttctggacctttaagttctcaggcaaggaaaaccacatagtctacctgagctttcagggactgaaggaaaaaaaaaagtattgctttactcaaattcaggaccacaaataaccactaccaacccattcagttgagtttaataatattattttattgtctgtaattgctcggtattcaagttggcagtataaaaggcctgcagagcaagcttaaaacatggttcaagatcttagatttcttacatctcaggtgaaagacagaccatagactcccaaagcaggttacaatttagatagcaatgtaatgagtcgtacagacaatttgttgtctataggatcttggaaaaaaaacagattcatgaaaagtgagtcaggagagcttcatagaggggaaagaattgggccgatgttcttttaattacctgctgccaggattctcaattagccatctgtttcttatcttacagaaatatcttttgaagatttccatattatctgattccaagttcctttcctgcctctttgtccccattagagatgtcactcatgaggacagtctgacagcagagacttccttttgaccagcaatgggagaaatatgtggaaatagcctgaagcctgagtatagaaggctttgaatgccagtccaaggagttcaaactacaggtcaaagagagccattgacaattttaggcagggcaatgaaatcttgaaaaccatgatttccagtggcattggcagcagtactcagtgtggtttagcatggaagaaactatataggagcctgctacaataattcagagggataatagaaacttggataatgacaatgggaactaaaagaattagatttaccagaaggcagaggaaagacattatagacaggactgagtggcctgacatgaggtgggaggaggtcattcaacttagtcattcagcagttcacttagtcattcagcagatatttacagtgtgcctcccatgttccaggcactgtgctaggcactggaatatagcagataacaaaaagttcttgccttcatggagcttatattctaatagttgaaacagataatacataaaaaagtaaatatataatatatcagatgatgataaaatgaaacagggcaaagaggatggggtacaagggatattgctctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgatattgctcttttatatagggtggtcagagacggcttcactgataaattggcattggaactgattcttggaggaaatgagggattttgctgtttagctctttgaggaaggtatttcaggcagagataatagtgcacatctaaggccatgagatgggaatgcgcttatctggtttgagaaacagtaaggagaccttgtacagagtaggcaagaggaagagtggtgggagatgtggtctggggcagcgagcaggtttcttcaggaagggccttggaggctactggaggactggagaggcatgatacagtctgacttctgtttaaatgggattattccagcttctgtgtgaagagagtgctttaggaggagtagggtggaagcagcaagggaagaccaattaagggagcttctataaataattagggcaggaaatcatagtggattgaaacagggtggagctgtggagatggtgagaagtggtcaaattctgggatatattttgaagatggagccaataggatttgctgcttgattgatatggtgtatgaaaaaaatagcagtcgaagatgaccccaagcattctggcctgaacaattcgaagttggaattgccatttattgagggaagtgtgtggaagagccactgattctagtcaagccctgtaattcatgaagaatctgagagccaatgagaagtaacttgccttagtttacccagttaggtagtagttgagatgtgactgaaactaccaggtcttctaaattctactcactgctctgtccagtacataccatatttctgacttcagctttagacatggtaaagggaaggtttagtgagggcaagagctagaagaagacttgaaaattaaccacacaaaagaccagttgaggtcatgaaagggtattcagagtaaagggtagttgaggcctagaaagaagactttgaagagctagcaaagaagagagaagaacaaattaaaatgggcaaaaggaaaatgagagtaatatggctcaaaggacttaagagagaagaagactcaatgatgagttctacgaaggggtcaggaagaatgggaactgaacaaatgtcattagatttgggttttagaatcttgggaaactgtggtgcctacaacttaacctcctttaaaattttaagcacttttcttgccgtttcagctaataaggagaaggaatataacagggtaagcctgagacagagaattaaaaacaaatttacttccaactcctgcattaccttcttgtgaatcctacacaagaatttgactttcccagactcccatatgcccatctataaactgaacaagaagcatacttcttgcccactttgcctcctggagatcctgtgaggataacaatgacaaaggataggaaactgctttggaagagaaatgctacataaatcaagatatccttttctagctgactttaagtttttaatttaagaaaaattcttgaaagagtcacaaaaaactttagagatacactaaatgcaggacgtgttgactgataaaatagatattcttcttggaaacaatggaaaatacttcagtatcattttgattaaatcttgcttaataactgttcattagactcatatcaaatcctgtcttggctttgttatttaatttaatttaattttgtagtcattgttacccaaccacaaaagaattacccctgtgcttaaggccacacagatttttcaaacattgatatatcagcattggtccttctgatgaaacacaagatgaggttttccctgctgagtgtcaggcagtctgtctcaagctgcaggctgaagccccagtggaatctaattccatccttccagtccccttcatacgaagagtgggaaatagtgggaatggaaattaattgtacctgctggcattattaaagttatcagtgcgtatcccctcttgggccaggaagattaaaaaggctgttgtaatcagagcacatgatttctgacacactggatgggcttcctccccaggttagatgtaaggaagtgatctgagcttgttgcctctggcctgataccacatagctcggggctatgcagtgtctgcctcatcctcccatcagccctggaggaaagccaggatcctgctctctgaatcagagatctcttagttggaaaatcaggccttctcacttaagactagtgtattctggctgcgcattcctcacaagatgtagtcaggttaggttagaccttagagtcacaccttgttcaggttcaacctgagtgaaataaggaattgaggtgctgctccctggtgattcagctcattttagcaagtgtttattaaatgctttccccaagcaccacaccaggcccagacaattctgcctgtacacatcctgtggtatttgttggttggaggaaagaggctcttgtagtttatgaattaaagaaaaaaaattcctgatctgggaatgagaatcttatcctacgtttcacactgactcacagcctaactttgactgtgaatgccgcctaactttgtaacctgtctaggacttagttttctaatctgtaagataatggtttggactaatctctctaagatttatctctgaaattctgtaattaagtgagggaatttctatgaaagtgcttggcaaaccattgggctattatgatagttctaagtggaaacagtatgtttcctcaatacacagtgaattgagttctgactctctggggcagatagatttctgactttctgggccatgtgttgagaatatgaagatggctgatgtggcccctgatattgaatacagtgtctagtgggagaaatagacatgcacataagctatgatgatacagtgtaataatgggttcttgggtggagggaaatatgaggtgaggtttgccttatgatgtcctttgtatcttaggaagaatgggagtgtaggagaggggagcataggggatttctgggagataaaaccatttatgcagaaagcaaggaagtataatagatgaaaagcgttccggaactacaggtggtgtgggtgaggatggctgcacacaggtcccttgtaggggagtggcaagcgatgaggctgaggaggtgggcagggccttgcctgccacatcaaagggcttataccctgaagccagtgaagcagaagcccctgtaatgttattgttttaacttcttattttgagataatttcagacttaaagaaagattgcaaagtagtccagaaattcctctgtacccttaacccaaattccccaaatgttaaaatcccatctttccaatatttgggggcgagatttttaaaaaatctcgtataagcacagtacaatgatcaaaatcaggaaattaacacggaggtaatactataatctctcaatcttactgaaatttcacttgttgccttgctaatgtccaattcaaatttctggttcagggttcagtttaggatcacacatgatgtcgaggtgaactgtcatcttagtatcctctaatctctgacagttcctctgtcttgctttgtctttcatggttttaaagagttctggtcagttattttgtagaatgttcctcaattttggtttgtttggtttcctcatggttggattcagtttaagcaattttggcaagaacaccgtagaagcgatgtcatatttttcttagtgcgttatatcaggaggcacttgccgttgatttgtccccattactgacggtgataattttaattactcggtgaggatgggtgtcccctttacagtgtaataaatgtcttgtgaagatactatgtaaatatcctatttctcctcatcttttgcttactaatttttagcatgcttgttaactgaaacaatcctactagcggattttaccaagagagtgccatggacagatttgccttttagaaagattactctgaaatgtttggatgtgagagagatgtgagaacagggaaaaagttactacagtagttcattcaagagcggggccctgatctaaggcagtgagaggaggagtagagaagacagaagagccatttaggctatgtttggaatcaataagcagggtttacattttgtgctatagatttaaatgctggaaaaattctgaaatggggggaaatatcacattttttatagattaacaggcatctatataacctctgggttgctcttcttttttttttttttttttttgagatggagttttgctcttgttgcccaggctggagtgcagtgcgcgatcttgactcactgtaatccccgcctcccaggttcaagtgattctcttgcctcagcctcccgagtagctgggattatagtatgtgccaccatgcctggctaatttttgtatatttagtagagacaggttttcactatgttggccaggctagtctcgaactcttgacctcaggtgatccacccgcctcggcctcccaaactgctgagattacaggcataagccactgcacccggccctgggttgctcttctaagaatagctgactttattaaacatattgtaggtttcattaaatgatgtttcacaaggtgttgcttctcctggaccaaattcctgttgttcagctgagagctatttctaatctccagtgtggatgtgctcatcatttggttataggatgtgagcaaatgagatggtgttctgcgtagcccagaggctgcttccattagccctttcccgaaacttttgccactttcaggcttagcagtatcctctcttgggttcagaatgcctgctctttgccctaatacaaaacctagagctgtaggccatgttcttatgatttgacagtatcagggaagcatttcttattgacttttccagagaaagagagaaaataagcaagccggcaacaagacagaggggaaaagggaagtggctcagttcttactttaagaaacaacatggaagatatgtttgttgatttgagggtggtgaatttttgcactatagctttgtgagggagctggaaagagcctttcagtttttcatgactgggagtttaatttggtttataacattacttaaagataactttgaaattggtctaagaacttagggttgttcctgaccccaggtcaatggcctacttgacctaggcgagaggagaaagagttaaggatagggagttgagctttttgctccaaaatctatagagggtacacccctcttatattctggagtcttactgggtttctgaaaatgcccttgtgggtcatgaaacaatagtcctttgaatatttttctgccgctgctgatgtgagctgcttaaactggcaggcagatgatggaaggaatggttacatgtcccaggcgggaggtcatgacagttggatctgtggttgacagaagaatttcaacacacattcaaatcagctcctaagatagattgtctgagttccctgggcctgcctcatgccctcctcaaatgcatttgactccttctggcccgtaatactcacacttcaaatgtttggcttggcgtccacaaatcaactcagggccggggtaggggtactgatgagcagtgatgccctctttgggagctaccacagcataggaaatgaacattagaccaggaatcaggtaacctggttggggacccagggctctagatggtttatttttttattttccttattggttaaattccctaccgcagttttgacattctcttctggatactgactgtggtctagagaaacagctaaggaaggcaaatctgaattaaaatctggttcttgggaaagaactgaagttttcagattttgcaaaattatggagagtgcagactaggagaaaaaggacaggcatagttgtgacaaggagctcttttttctagttctgcattctagaaacagtactgatgagtccaaaaatatagagataaaatttgtcttttttcttgctttaaaaaagaaatgcttctaaatgtctacatacttgcctaagaaaatatttctcaactcctccagaatatttagggttaactaaaaattataaaaacataccacagagctagtccactctttatgcctagggtttacccaaaaggtgtgcatgctctggcttggagaccctgaccccatctcaacttgctggtttcaagtctacatatttggctgcaaagccctaatgccaggaggaatgcggaactgatgagtccaccccatctacaagctagaaggacatcttgattaaattagtgtcaaggggggtggagagaaaggcacagtgacacaaagggtgttttgaggagccctgtagcgcctgtggagaatgaatgttctcgttaaatatggccgtgacctgcagctccacacatgccagagacacagctcaattgtccccaggatttggggggtggggacgatcatggggagaggacagcctggcatggaaaggcaggaatgcaggaaggcctgttgttgttttctttttgcgataactacagcaagcaattctttgatcatggtccttgtgtttgtgtttggaagggatcaagaagcgatttcctttcccctgggtgtttgaacctttgctctgctccttgcttctctgggtattaaggggactcctgaaagcccccattgtcttcagcctctttccacccccttccttggggctccccaagaagattgttgcctgaactctgtagggcaagaatgagaagcagtgcccccaagacagtgcctacccttgtcatttacccaccatcctcatctcatttatccttaagtcccaagaccaaagcaaagaacacatgggctgttgaaggcttccacaggactgccctggtcagtgggaaagcagtaatgctttctagctgggtaaccccttggctgagttccatctgcactgtggccagggtgcgtggtgagacatgcttttgccatttgccctttgaactgccaacaatcccaatgtagcaaatggatttaaagctgattgagttttagatttctttcctttaaccagaatattctagcagcttatttttatagttctgcttatatgattctctttttaacagatggaatcacaaccttttctgcagtatatatctgatgaatttaaaaactgatacatcaagaatattcttttgtatatgtctttcttgctgtgaaaatttatggcctttcttccccctatcttcgctctgtaattattaggtgcttactatatgcaaggtattgtataagattaggagaatacagataagacaaaatagcattgaaggagtttatgagttcaattccaacttcaccaattaatagttgttctcatggacaaattttttgacctctctaagctttagcgtctgtaagtactaagtgctttttgtgcagagagatgtagagaggtgaaatttgagctgggtttttagtgaatgaaaatgatttcagtaattaaagatgaaaaagtacggagtttgtgagcatggagggggagctggagtcaaaggatattccatatggaagaacaggcttcaggatgaaggagagcaccggaatgtgtgaggactcttcagagggtggtgagtaaaaatagtttggctaaatcagagtgttaatgaggagagcagcttgaaacaaagccgaaaagagcctcgaatgccaaacttggagtttgaacttcattctgagagcactagggaacgatggaagacctactcatagggaaatgataaaatattgctgctatttccgaaagactgggcctctaattccaggacagggtaataagagcctgagatgtggtagcagtgacaggaggaatgaaaagaaggagacagatgccagacatatcatgaaggagaaatgaacagcgtatggccacttattggaaagagaattcgaagtcagcgattacttctttcaatttttttatgctagtgccacttaggaaaagccagtgtgctgttacagaatttgaggtggctggtgaagctgacattttcacatatgtctcaggaactagatgcccaaatctttctcagaccccagatggccccatatagagcttttatacgtgccaatttttagaatttcttgtagagttcctccatttggtggtcaccagaggatctctgagattagtatctggattcttaatcattcagctaatttcagagatgtcctttatttgaggtagatttaacctcctttttctgtttgatggagtgtggtttttgaaaagtccctaaggaagtaacgtgaaaccatacttgaaacctcaggcttgcttctctcttgttttaccagaatgctttggttaccacgtcctgggaaatgaacaacttaaaacgtaagtgtggcaagccttcactatcaccagtatctgttcattgtatcaaacaaagcatatttccattcttattaggtttccagaattgcactgggcctggtgagggctacaaataaacataagataatctgttttcaaaatttaaacttagagttgtgcttctagaaatggaagcttttctagaagaaaattcagaccaatccttttgcttcatgggagctgctttccttgaagaggcttctgccattttagaaaatattactgagtgtcaaaaagctgagcagagtgtttaatagacttgtagggctagcaggacaaatatgggaatttaaggcccaggggcccaggatgggtagccttggtaaaattccccaggctttgagacaccaaagggatacaattaagaaggaaagataagccagaaatagactaaggcagtttcatagagactgaagcctggattcaaattatcttaacctctaattggattaaggtgatttaggatagccagtggctagaaacaaatttaaatcctctctagaggaagatactgtggaagatactatcatcctagacctaatatatctctcatcatttttcatcatgatgtttggcactcagttataaataattaggcctatgaggaaataagaactgtgaccaaaagctaagagaaacagctagacccacaggagatcctagtaatggtgttaacagatgcaaactttaaattaactatgtttaatatgtttatgaaattaaattataaaaacaaacctggaaataataaaaaaaattaactcaaaatggatcaaaggcataaatgcaagagccaaaactataaaactcttagaagaaaatataggtgtaagtcttcgtgatcttggattaggcaatgatttcttacatatgacaccaaagcacaagcgacaaaagaaaaaataaataaattgaacttcatcaaagtcagaaacctctgtgtttgagaggacactgtcaagaaaatgaaaagacagctatagaatgagaaaaggtattttcaaatcatatatctcatcaaggtctaattttcagaatatataaagaattcttagaactcagcaacaaaaagatgaccagtccagtttaaaaatgggcaaaagacttgaataggcatttctccacagaagttacacaaatggccaacaagcacatttttgacactgttatttattgggctactgcaaatcaaaaccacaatgaaacaccacttcacacccactaggatagctataattttaaaaaggaagaaagaaaaggaaagaagagttttggagagggtatggaggaatcagaaccctcatacattgctggtaagattgtgaaatggtgcagatgctatggaaaactgaaaattcctccaaaacttaagcatagaattaacctgtgacccatcaattccacatctaggtgtatacccaagagaattgaaaacatatgctcacacaagaacttatacacaaatgttcataacagcattattcaaaataaccaggctgggcacggtggctcacgcctgtaatcccagcactttgggaggctgaggtgggcagatcacgaggtccggagatcgagaccatcctggctaacatggtgaaaccctgcctctactaaaaatacaaaaaaattggccaggcgtgatggcaggcacctgtggtcccagctactggggaagctgaggcaggagaatggcgtgaacccaggaggcggagcttgcagtgagcagagatcgcaccactgcactccagcctgggcgacagagcgagactccatctcaaaataaataaataaataaataaataaataaccaaaaagtggaagcaacccaaatgttaatgaagtgatttatggaacaaacttaaagtatggcatacctatacaatttaaacaaaatgtgtcatgtccatacaatagagtagtatttagtcataaaaaagaaggaagtgctgatacatgctacaatatggatataccctgaaaacattgtaagtgaaagaagctaaacataaaaggccacatattatatgattccatttatagtaaatgtccagagtatgcaaatctatagagacagaaagtagattagtggttgctaggagctgggggaaggagagatggggagtgactactaacaggtttgagttttcttttggcatgattaaatattcgggacttagtggtggtggttgtacaaccttgcaaatatactaatagccactgaattgtgtaccctgtagtggtgaattgtacagtgtgtgaattatatctcaataatttaaaaaaatcaaacaaattttagtacaaaaaatgcagtaactaaaagagctcaatgtgtagatcaagtagcagattagatggtgctgaataaatagttaatgaactgaaacgtcagaaaacaatgcatactgaagctcagagagataaacagatggaaaatacagaaaagagcataagagacttatgggatagggtaagtaggcctaacatgcttctacttgaagtctcagaagaagagaacaaagagaatgggatagaagcaatatttgaagagataatggctgtgaatttccctaaactataaaagacttcaagccacagactgaagcattatgagccccaaacaggagaaatacaaagaaaatacaaacagctagaggtaaaaaagacgtattatcttcagtggagcaacagcatggttgacagctgacttctgaacaaaagcaatggaaagcagatgacagtggaatgaaagtgtagaaaggaatacccttcaaaaatgaaggtgaactaaagatgttttcagacaagaaaaatatgagaaaatatatcgccagcagacttgcactaaaagaaatactaaatggcattatttaggcagaaggaaaatgatcccaaatagaatcttagaagtgcagtaaagaatgaggagcaacagaaactatatataagaatatagattggccgggcacggtggctcatgcctgtaatcccagcactttgggaggccgagacgggcagatcacgaggtcaggagattgagaccatcctggataacatggtgaaaccccatctctactaaaaatacaaaaaaattagccaggcatagtggcgggcacctggagtcccagctacttgggaggctgaggcaggagaatggcgtgaatccgggaggcagagcttgcagtgagacgagatcatgccactacactccagcctgggcaactgagtgagactccgtctccaaaaaaaagaaaaaagaaaaaaaatatagatctaagtgaataatcactgttaaaaacaacactaataatcatctgtggggttttccttttttagatgtgtgggtgggagggacagagtcttgctctgctgcccagcctggactgcggtggcacaattatagctcactgcagccttgaactcctgggctcaaatgatcctcccacctcagcgtcccaagtataacagctgggacaagaggtgtgtgccaccatgcctggcttattttttattttttgtaaagagagggtctatctgttgcccagcctggtcttgaactcctggcttcaagtgatcttcctgccttggacttccaaagtgctgcggttacaggcatgagccaccacaccaggccaaccctgtggggttttaaatatgtataaaattaatataaatggcaacaatgaaatcaacaatagaatctgtgtctgggtgggggtagggaaatgggtttaaagatattttcagaaagtggtaaaagtagtaatttgtattaggtgttggcaattcaaggatatatgttgtaatttttggtaaccactcaaagaatagtattgtaccaatctaagaaagggacaaattcagttaataaaaaagtaactcaaaagaaggaaagaaaaattctggggagggcaaaactatagagatacagaacaaatcaatggcttccagtggttaagggtagcggagagtttgactctaaaggtgcaggatacaagaggtttttggtgggtgatggaactgttctgtgtcttaattgtggtgatggttagacaactctgtgcatttgccaaagcacatggaactgtatgccaacaagagtgaattttctgaatgttttgtaaatggaagaaaaaaagaaggtaggaaaggagaggaaagaggaaaatagaagaggcaggacaaatagaaagcaattagcaagttggtgggtttaaaccataatataaggtgtaaattgacttatgcaaattaaagacagatttttaaaaagcaaaactagagtgtatgttgcttgtaagagaacagatacactttaaatataaggataaagaaagatttaaagcaaagtgataggaaaagatagctacaataaaatcaggccaggtagattcctttctttctttctctctcctttctttctttctttctttctttctttctttctttctttctttctttctttctttctttctttctttcctttctttctttctttctttctttctttctttctttctttctttctttctttctttcttttctttctctctctctctctttctctctctctctctgcccccccacttctttctttctgtcctttttttttcttttttttttttttttttctgagtcttgctctgtcacccaggctggagggcagtagtgcaatctcagctcactgcaacctctgcctcccgggttcaagcagttctcccgcctcagcctcccagatagctgggattacaggcatgcgccaccatgcccagctaatttttgtatttttagtagagacagcgtttcaccatgtcagccaggctggtctcaaactcctgacctcaagtgatctgcccacctgggcctcaaaaggtgctaggattacaagcctgagccaccgtgcccaggcagtccaggtagatttcaatgcaaaaagtatttttcgttataaagagagacatttccaggctgggcatggtggctcactcctgtaatcacagcactttcggaggccgaggcaggcagatcacttgaggtcaggagttcgagatcatcccggccaaaatagtgaaactctgtctttactaaaatacaaaaaattatccaggcatggtggtgaacacctgtagtcccagctacttgggaggctgaggcaggggaatcacttgaacccaggaggcggaggttgcagtgagccgagatggcgccactgcactccagcctggtgatagagcgagactctgtctcaaaaaagaagagagagagacatttcctagtaaagactaagtttccaggaagaaatatatacttaataacataggcttaaaatatgtaaatcaaatgggacagaattaaaatgggaactagataaatcatcaccccaatgagagatttaacacacctgtctcagtgaatgattaaacaactagaccaaaaaagtcagtaaaaatacagaagagttgaaaaacaacaaacttgacctaaatgacatatatggatactgcgcctgacaactgcgggtagatacacattctttttttttttttttttttttttttgagacggagtttcgctctgtcacccaggctggagtgcagtggtgggatttcggctcactgcaagctccgcctcccgggttcacgccattctcctgcctcagcctcccgaatagctgggactacaggcgcccgccactacgcccggctaactttttttttgtatttttagtagagatggggtttcaccttggtctcgatctcctgacctcgtgatccgcccgcttcggcctcccaaagtgctgggattacaggcgtgagccaccgcgcccggccagatacacattcttttcaagtgtacgtggaacatttacaaagtttaaacctgaaatggggaggaaaaatcgaagagcttaggggagaaattagagctggagattggaaatctccatttccaaagtctaccttctttttctcacaattccatgatttttcagtaggagtggggtactggccaagagggaaggtatcctcccccaagaatattgatttttcttttttcaactgtatgtaggccatgactaatgggaatggctacccatgtgtttactgtggacaaagacaagaggcttcaaaccaccattgtagctgaagaaagctgatacaggctcaaatcttcatcccagtccctaggcaatgcattctaatttctgtcagtaaagggctctactcattctcccaaagttggctttgtgctcctcttaggtccaaccctggcacctgaggtgtcaagaaaatgctgtcttcataactcactggagcctcttcctctcgattctaaaggctactcccagtgttctaaaactacacagatctctcgatgaattggctttgctgctgggttcctctttcttaaaagtatttaatcagcgattttcccagtgccccaggcatttcctgtacgagtgctgctgactgttttacttcctaccaggctgccctcctcctcttggcattcacacttccaactttcagatgagctctattaactcctgttcttccagcctccgcctggctcagccatctgggagccacacaggcattctttccatcccccagctcatagatttccttattgtagaagggcatatgttttcaagtaccttatcattctggctctttcccccgattctctcccagttccaagccattgattgtttttcctccttagttcattttacagctgctgagagatttgtgctctcgtgctgcctgtttgcttttgtgtcttttgtcccttatgtcccagtctactcaaggatacccacagtcacctagataccatttctactctgtgcttttagtgtcctgcttgggaaatggggtgatcactcatcttcagaatgacctcaagaaatgctttggcatgagagatcagggcctgaagacattacgcccccactcaaatcattatccaaaagggtaaaagatggaaatttgccaagacaaagatcacagtggtagtttaagaaatgaaagcttagatttgattgtctgttttgttttaagggatgttgttttgagtttattttcttagtattaggataggtcattcaaagagattggaacaaccatggaagaacattcagattattataggactgtgtttcagactgggagagcagagggccgttagcctcttcctgaccccaccctgaactcccctgaactcccacccttgtcccgagtatgcctgtccctgacaagagactttggtcagggaccaaagtgagctttgttagtgagcattcacagagggtaggagctgagtccacaaagttcacatcatgccaaggaatggatttcctcccagggccactagcattacttgtgggttatcaagtgttactgctcacacattccagagcttctggaaaagccgtaaggaaatggctttcagaaagccatttctgtcctagaggagagaggtcctggatttcactgaaccagaacttgatgggtggttttggtattctgtgacctaggtagtggggagctccttcctttggatgtttcctttatgcccacagtcgaaccatatcctagttgtacagccaagaaggatcttttctgtttaatctatctggaggaatagaaggtaattgtatcctccttattttcattctgccacccctaccttcatcatttcttcctttctgctaagcactttttatcgtctttctttgtttcgttttgggagttttgtttttttgttttctttcctcaggaaagctgaattatttcttacagagtcatttagttcttactgaaactggggaagaaaaagattatgcaacagcaggcataaggaaaaacagagaacgttcttcccttcgggcccacagagcccattggaggaattcagctacaatcctgcctgggaagtagtttccaggaccttcgcaattccacatagcatctttaacatgtttgagagtacgtaaggaggcagcatagtgcggcggaaagaacactcaagtgagtgttgagggggctggattctaatattaatattagccaacatttattgaacaggctaggtgctagattctgtttaaagcactttatgtggattatctcactattcttattatcctattttacagatgtggaagctgaagcatagagggtttaaatataatttacccaaggtcatcaattggggagtagaagtaggattcaattcctgctccagagcctgcatgttcagctctcttttaatactgcatgtggtccttgataggctactgaccctggaaaagtcatttcaacttttagggctcattggtgaaccataaccaaagggagctcattgtggctaacctctgatggagtttccacttttaataatttatatgatgaaacgcagctatattgtttagttcttgtcattatgtgaaagcatagtatttaaactttgatctcattgattcagcaactgattattttatggccactgtgcacaaagcaatgggctgggtaccacagaggattcagaaaaatgcttaaaaagttaaaacctatctcttccattagctttagatggtttcatattgtagttgctttgagatttttttagactaagtttttcagataattaaacaggaatcaaattcaaaaactattcatattccagaagaggaatcctgaaacaagtattgggccttagactagtcaagtttctgacattttcttttaaaatataacttgtcactaggatagtttatatccattaactcctgagtgaaggagcttctggtgaaattgttttttatggtgcttacaagctcaaggggttctttaaaaatggaatgtgactgctttgggagtcactaatactgaagctggatcattataacctgaaatatccattagtaacttagaaagacaaactcaaagaaaaataatttactgtgtaatagctggattttttgaaatcagatttttttttttttttttttggcaagctagattcaatatctagcttgctgtggaattaggttatggtgtggaaacctcttggctgggacaggaaaaaaaattgatcttaaactaaaaaaactaacttaagatattccatttctagtaatacctttgagattggaagaattgcattctgatgggcccagacgttagattaatgtccatctttctcaacaggttgtaaacttttaaactttctgttttgcattcagaccacaagtgcctgacacttaatagatgttctataaatatttgctgatggactctttattgctcactccctaaaatccagccatttctcccttgccagcattcaataattgaacctgctttgaaacatctgatcagccacttcaagacggcaagttattttagctcctgtctaaataagttagtgggctccagtccttaaaccactattttctttattaattcctcaagtacagacttttgtatgtaaccagtctttttaaacctgtgtataatgactcattaatgagttgtaaaataaatgtagtgagttatgaccaatataaaaaaatagaaaaggccaggcacagtcgctcgagaatataatcccagctactctaagaggctgaggtggagggatctttaggccaggagtttgagaccagcctggggaaacatcacgagactccatatctgaaaacaatttttttaaaaattagccaagcatgcctgttaccagctacttgggaagctgaggcaggaggattgtttgaagccaggagtttgagaccagcctgagcaaactcagtgagatcccatctctacaaaaattaccaaaattaaccagcatgttggtacacatctgtcgtcccagctacatgggaagctgagggaggaggatcacgtgacagttgagcccaagagttcaaggctgcagtgagctatgatcaggccactgcattctagcctgggcaatagagcaagaccttgtatctaaaaagaaagaaagaaaagaaaaaagataaaagaataggaaatatcatagtggacagcacataagtagaggtgaagccagctggacttcctcggtggagtggggtcttggagaacttttctgtctagctagaggattgtaaatgcaccaatcagcactctgtaaaaacgcaccaatcagcgctctgtgtctagctaaaggattgtaaaggcaccaatcagcactctgtaaaaatgcaccaatcagcgctctgtgtctagctaaaggattataaatgcaccaatcagcactcttaagagctgtaacactcaccgcgaaggtccacagcttcattcttgaagtcagtgagaccaagaacccaccagaaggaaccaactccggacacataagtacttttattatagacacatattatgctgtattgcaataaaaaatgtattttttgaacatcctagtctacctatcttcagaaggcaaaagcacctctggtgtccctgttgtggtatctcctagcctacctctctataaaagttttgcaattaagtatatttgtgttttatacatccttgggcttctcatagtttaaggtcctaactggagttcagtctttctcagagccgtctcatggtatcctcactgatgaatgaatgctgaatagaaagagccctgcttgcatatatgcaggtagtatggtggaggggaaatctagaagtcatttctgagctctgacctgctggatcatcaccccctgaacccccagagcctcggcatacagcctcacactgtaccacctattttggtggcccaagttagctgagagagaggaccagacacagtgcccaccatcacctagcactggccctgctaccaaacagtcattccttttagccctctcctccccaccaaaagcatttcaggcaaagtgccagctcctgaaatgtggcctctttgaagtggttagtgaatgcccctgaaaccaccaccttatgtatggtggtgcttctgctgccagagcttaatacagggtcatgttcctttcctctgaaatctgtaacataaattcagttttaaactggattttttttttaacagttggtctctgaacaatctttagggtggggaggggatagtagtggttgttggggagatatgtgcccttgaaaactggattcttttttggaaaactgctgacacaggctaaatggcagagaactaaatggccctactgttcctacctgctgacaggctcagccttgggatggggctgaaatgagctctcgccacatggcagagacatgccttcctctttttattcttctttcttacaaatagggggtacttttgtgcctgtcaaaaaatacagctttgaaatgtagataaccaattaacaacagtcccacccccaacttggaaagcacatgagtgctgatctaaataactagagaatcggtaacaagtaacctccctattgagaacaggtctgaaacctctttcataattggtgttctttgggaaacgctaatagacaaacccatccaagctcaggaaatgtactgatttaaagaggtctaaggaagagtgaccagcccagtggccaggcatcccggatgcctaggatccttatgtttccgtacatatctgctgttacatcctttctgtgagcaaggaggctttggaacattacagtcttgtcttggggagatgagatgacacagtgcatttcagttctgtttccaatgctgttatctgttggaaaaaggaagctttcctacccattttgtcagcatacaactggtaggagctgttgcaatctcattgtcttctgatcagcccctcggcagcagtcagagtggaggccagtgaagcactctgaccaaatggttgtggtgagtttcaaaataagagatcccagcctgagcacaccatcacacttcccatccgatagaaccagcattgttaactgtaccacatctctattctaaatttaggcatctttttttttttccaggcaaagattactatgcaaacatttaagagaaaaactttgtccaaagtaattttttcccccaacttctatttggtttcctgcaatgttgagatgactcattctcttccaagaaattttaaagaaaagagatgcaggctgtatgttagtacacaaagactgctctgtaaattctttttcttccctgtctagaaaccccttgcctttttatagagaacggaaaagctctacagtcttcattgtcatgtactcggcctcatcaggttttgttgttcccaggaataaatgtcccccttgtctttgggtggggcccccttgtggcttaccagctctgtcaaccccactgcagtggccagcacggaagcccttcctggggccacgctttcccccaaaggcacacagttaaggtttctgaaacagagaacgaatggccttttatcatctgtgaaaggagagacactggcaatttcctgcctctggcctagtgtcagaatttctcctgattgctagaggctgtattgcacattttaagtgggctcgctacacatgtagtcccagcccaaccctcagccagagggagcagtaagtcagatcacttcagcagcctgttcaaataaacagggataatagttgagtggtcctcccaactaatcagtacatgaaaggaaacatctgcctgggcttaattgctgttgtttttggttacacttttccctccccttcttcccccatcccccactctggggctaggttatttaagtcatgggtaagcaacagggtagaggaataggagctttctcctttaacctctgccattcaaacataaggaggagttaagaaacgataggctggcagggggagatggcccggaggcaggagggcagggcggtgggaagtgatactcatggtcacttcctgaccctgttgctgactctggggctcagagtgagtcatgttgcctcacttcacctccttgggcctctgttgcttcagtggagctcagctttcctctcaatggaaaggacaggctggtatgtgagatcacagatgaaaggcattccctcttgtggcttcttccagcagttgaggtcattggatgagagaccctggaatgataaatttaagactggcaagatcccctgaacccgtccattttgtagagcatctgggtccccgaggagaacttgctcattatcttctagccaaccagccatacactaaagggagggatgtttgaagctaatatggactctagaagccaggcagaagatcatgtagaatcatagaatggcagaggttggaaaagactttagaaatgttttagctgaagcttttcattttatagaagggaaaacagagggccagagaggttaaccaggttgtccagagttacctctttggtaatgcaggagccaggaatagaaagagaatcttgtgattgctaatttagggctccttccacccctttccccactatcagatgtaaaaattcatgcttactcatgacagaggccacacataggttatattccataatgaataccttaatagaaaaatgggcagagaacaccttaataagaaaatggcagattataaaagaaaaatgaaaatgactgataaacatttttaaaaatgctcaggctcattagaatcaaaggattgcaaattacaataggataccacatcaaattgtcaagacaaaaaaatgtgaaataaacattcatatatgctattggtggtattttaaattggtaccgtttttctcaaaggcattttagtggtataaatggtagtctttgacccagcaatgttatttctaggagaaaataatgaaaggtgtgtgcattagatcatatacaaagtaatgtgatatggcattttttatcacaaaaatttagaagtgaagtaaatgtccaagaatgggagctacatcaatagaacgtattataatgctatagaacaataatacatgtggaaatgtttacaacatatgtttaagtgaataagttacaaaacaggatttataatgcaatcccaattttgtaaaactagaaaagattagaaaaatacataacaacacttagagtggtgatttcttagtggtaggaatttaagagttacttttgttttcttttttgaggttttctagtttccttattataataaacatacattacttttgtaatcagaaaaaaaagtattttttaagtagagatgtatgtaccttgaaaaaaagcaagatcttaaatgattgtgtatctgacatgaaagtccttcctttttttgcctgggagctagcagctatggtgggagggatgggaaacagtattataacttctgttagggtggcattttgatacccgaatttctggtaggaaagatctagaaggagctggcaaaagataaaacaagggctttccctctcaatgacccatgctgccaatcagttttagctctcttaggtttggcatacaacacttagtatagaaggtgtgacaatttccttcctgcttcctcctttctttccttttcttttcttttcttttttttgagacagagtctcactcttgtcacccaggctggagtgcaatggtgcaatctcggctcactgcaacctccaccttctgggttcaagcaattctcctgcctcagcctcctgagtagctgggactacaggcgtgtgccatcaggcccggctaatttttgtatttttagtagagatggggtttcactatgttggccatgctggtctcgaattcctgacctcagctgatccacccaccttggcctctcaaagtgccgggattacaggtgtgagccaccgtgcccagccctcattctttatttctactgctctatgtagttagatgtcagccctgggtggcagcagcaaagaacccaggagccatcactgctcaagattaactagttggagaccccttaacatatattttcagcatctagtaacagctaatctcacaggcagtcaatattgagataccgctgccttgtgagttttgggtagaaataaagcaagtaagaaatatagttccatcctgcttggagttttctatttagttagggactttgaagtccctaaatgtttatatactttttcctatttcatcccattacacatcttactttcctttgaaatcttctggaatgcttgactgcaagtatctgagaaaccgtgttccacctaacaacagttgctaggtaggatgtggctttcaggcctgctctttggggaccaatagaaaaaccaaaggctaccaccctttttccctctacgcaattgcctttgctaggctatagagagggcacatttcattttattaaaactctttgagtaatctgaccataattgggtctgattggagtggttatctgatttgctgggttaaataatgggccttaattgagtctgggttatttgtagagccagtgtggcttttgcctttgttgctccctcctctctcttctgtttcccaattaaccttcattcctctttccttgcagagtaaagaagtcggccagcagctccaagatgatttgatgaaggtcctgaacgagctctactcggtaaatcagatgggttgcttggctctttaacaagcagagggaagcagcatttggcagcttgcagccatagtacatcagcaacagaactgaactgaggttgaggacaagtgcatggtccccactgggggtgaccccacccatctcttttttcacactcgtcttttcaaaacggaatgagtcaaaaaatacttcctcaaaataagttttctcctcagctatgcaagctcaccctggctttatttggggcataattactagagaccagccaaagtctaggtcattggcacaatggaccctgttagcagcaaaccagggaccctgaactaatggcaaggaacgtagcctgcattgcactattaatatgtgcctgtcggaaagcctttattgttctaggtttttcatcagatcttggattgatgtatggctttgagactagaacaaatgctctagagggcagcacagagtcctaaatgtccccagtaagagggaccagtttgagcagagagagctttgcctggcttcctggagttttataaagccaaacctcagtgacgaggcaggctgcgggcttggagaagagaacacaatctgttctgagatgactggcgcttcaggcacatgatgcctgtggctggtgcgtgttaattcatgcgcagagaggtggtggtggtggttgttccccagccatgtttttctaattataatgaaaacaaacacacactcacacacatacacaccaaggaaattcctgttgttatacagggaatacttaagttatacagctaatgcctttcaggggccccttctccagcttggatgtgccagcctactatgtcattctccagggtttctccatcctgtttgaaggtgatactgatttctgatgtttacttgcttatttgctgcattttttcttttcttttcttcctttgtttttttttttaattcacagaacaggcagtggtgacatgcatgacaggcatttgggatcagatgttgctgatccagaagcctaggtgtggccattttgtcatggcaactgttaagcaagtaaatagggtagagtagtcatctgacttatctccagcgatgttcagtttgttttgaatttctactctgtgacacttctgctctgaagccaagcatagatagatggtacctttcgttcaactcccaagttttcatttctctcaaatgaagttaagaggttttaaaaatagaaacacatcgatgtgagccattttcagactggatgggtttcctgaaccttgtctttttaatgctttacttctgctcttttagatcaatttctaagcgccaagaagagctattactcctttctcctagcagagaattccctaagatagaaaatgacacatgtagtcattgtataaattcttttattttcctgtaagcatcttgaccctctactatttgcagctgtttctggggaggagtagtttggataaccaacaaaccttgccacttcttcagtgggactcaaggcagcagaagaagactactgtctaaggatctgttagcttttacccagggtcctatgtctcttcatatgctgtgctttaaaaaaaaaaaaataagtgaaagggcgtaagctgtgtttgagtgaggaagaaaaccttggaacttatttctctggtctgcagagggccgagctgctacctctgactgcagacttaagacagcccaatattcgccaactactttactggccattgtgaggccatggtcaacatagagcataacatcttcccattgatgttcaaactgagaattgcctgagtgtggtatcccctgccataaggtgagctggaatacaccttcataatctgttaaaggccaaaattaaaatgtgatgttttcctctagtaggcaatggaaagagggaaaaaaaagagtagaggcactaggaagtttcagagaagtcaaaacattctggtccaaatggagttttaagcagagggagttttaccccgagaggacatttggcaatgcctgaagacatttttgattgtcacaactggaggagtagaaggtgctactgacatctaatgatctagaggccaggggtgctgctaaaatcctacagtgcacagggcagctcccacaacaaagaattatctgacccacaatgtcaatacagagacattgacaatcttctgacccacaagattgagaaatgctggtctagtgactagagtctcctgaattaagcagcctagattctaccctgtcttgactactagctgtatgagcttgagggataccccaaacctctatgaccttggtgtctgcatacactccatgcactggtatttctatatcctagggggtggagtagttgggtgagttatacttcctgaaatattaggctatagctaaggatcaaataggtttccagagtctgtaggccattagaaagttcagtgagccaggctcatgcctgtaatcccagcactttgggaggctgaggcaggcagatcacgaggtcaggagatcgagaccatcctggctaacacggtgaaaccctgtctctactaaaaatacaaaaaaaattagctgggcatggtggcgggtgcctgtagtcccagctactggggaggctgaggcaggagaatggcgtgaacctgggaggcagagcttgcagtgagccgagatcgtgccactgcactccagcctgggcaacagagcgagactgtctcaaaaaaaaaaaaaagaaaaaggaaaaaaagagaaagttcagagaatagccgggcacagtggctcatgcccgtaatcccagcactttgggaggctgaggtgggcggatcatgaggtcaggagatcgagaccatcctggctaacacggtgaaaacccatctctactaaaaatgtattaaaaactagccaggcatggtggtgggcgcctatagtcccagctactcaggaggctgaggcaggagaatggcatgaacccaggaggcagagctagcagtgagccaagatcgtgccactgcactccagcctgggggacagagcaagactctgtctcaaaaaaaaaaaaaaaaaaaaaaaatagcagttcagagaatagaattatttcttctggagattaagataggtttaggactggtctgaataaggcaccatgggattacggtgactaactgtccctctttgcctagtactgaagagtttcctgggacatgaaattgtcagtgatgaaactggaaaagttctaggttaaaaagggttaattggtcaccttgcatgggagagtggttttatcaggtgggaagctgggactgttacatgctagctttgggaagctgcttgctgtatgcacacctttgaggagtcaagaagagaacaagggagagtttcttagaaggagctttcccattatttgcttgtcaggaaggcagggaagggcctctcatttcaatgacgttgtaggcaatagaagttatttggggtcactggaaaaaggaaaccaaggatataagaaacccacccagttttttcatgtccttcacatctgctcctaatgcccatgaatacctttttttaggggactagttatccaagggttggtaattttagtacctttgaaccttgatgatccaaggagcaggacccaggtgttcccaaataaagatgcctttgggcaccgggcccagaatgccgccatgagtggccagctgcccctctgcaccttcctcttttctgcctgaagggcctttgatttccctgacttggcattctgtgctggggcctgcttcccacagctgctattcagagagcaatcctagcgagcattcttctccacgtgttttccccccataatgagctggcttgtatgtaagccatggcataagtggttttcattttctgactgatgcaccgggaatgcctttgaagtcagaacacactgcttcccaaagaactctgggattctttgcctcagttgtactcagaggtcgtgtctggaaaaacccagcaaacccccacaggaaggagtgtacatggaggcactgaagccagtgtggattggctgagtatgaagagtcaaggaagctctagaattgagaaaaaagaggctttgggacactttggggctgttgttattccagaggccttatgcttctgtactccccctaaatttacatccccttggcttggagcagcggctgtgtgctggcagagctacttcagactggtatttagcacctgttcccttgaaacaatggcacttaatagtctctcaactctgcttgcctatttgactctggcactaggcactagggagacaagaacaaataagagatgtttctgacctcaaggcgtttagttttaatagggagagacagaaaagtaaagcatcaagtgaaaaatgaagtgacaagaactcatttacatgtctgcacagaggacagggatgaagtcaggctccttgaagagatacttgaattgaatctttattgccaagaactcttttcttgttctctacatgttcccttttttgttgcatccaacttttgtttcatgatgcagtatcgttttatttctcatttatctctccagggctattatggatatattgttttcaaacttttcttcttgttgtataatatttcttctaaattgctagttttggtcttggtctttcatattagacatttcctttaaatgcctggtcattcttagctgcctattcacattttaaagtgaggcactaaaagattctatgtcagctgtggccttcacagtagggtgttctaactgggctgtgtccttgtggaagccccaactttagtatttctaggtctcttatcttggatggtcagattgccgagagatcacacttttgatctcccactcatgtctgggagctgagttgtgaagaggcctagaccatctcaaaatttaacatagacttcagctaatcctcctgttgaagttcagtatacccctatcctcagctgaaccttgtatcccctagtccatggaccctctctaacagaataaacctctcatctagtcttccactacaatgggagggggatcttggggcctcactgttctcagacttcctttttttttttttttttttttttttttgagatggagtcttgctctgttgcccaggctggagtgcagtggcgtgatctcggctcactgcaagctccacctcccaggttcatgccattctcctgcctcagcctcccgagtagctgggactacaggcacccgccaccacgcccagttaatttatttttgtatttttagtagaggcggggtttcatcgtgttagccaggatggtctcaatctcctgacctcgtgatccgcccgcctgggcctcccaaagtgctgggattacaggcatgagccgccatgcccggcctgttctcagactttcaatagcttattttgtgtttagctctaccttcatcccactgctacttatttctcttcgggcttctgtgatataaatctggctgcttcctggctcactctagttttggtttaggactcaagtagatgagttactgtttgcctacctgcttttcggcttcagcttccattctttttgtttttctcaatttatacctaaatgataatcattttagaaccttttttttcctattattttagtgtggctgtcagagggagcagagctaaatatgtgacttcagtgtttagtttttcaaagtaaagtggaatgttctttgcagaactgagaatttagacttttcagtttttccccatagtttgcatttgcctatctatatatagatagaagtatgtatatgtatatctttatgtatacatatctatatatacatatatgtgtagctatatgtctaagacatagatatatagatatacatacatttacatatgtatatgtacatagatatatatatctaagtcctatcttggctttctctaagtcctatcttgactataaatatatatttataaatatatatttaacatgtatatctgtatctatatacatttctaagtcctgtcttgactttcctattttttcaattgttttggcatcacttatttaagcttcagcttctaggtacctcagttttctcttgagctggaaggcactaataaagcttctccagtatttacccagaagagagattcagtgtcattcagtcatttgggcaaccactttgtaaaactaccattgtgtatatgacatatttctccactgtgagaagaaaacacaaaagaagtagagcttagcgtgaagaatgtatagtttcttaggcaaagtagcgttttactctcttttaacaagaaagttctttaagttttttaggggaaagtaacattgtaaattgttgatttttgttacttcatttgttgacttggtagcgctattctttgaccccttttttatctcatgtttattcataacgttttctctttatcatgcaccttcatgaaataggaaatcactttaaaaaagaaaaaaagcactcacttttgtaacttctcactaagcttttgaatcccatggtcagattcaggtgaaaaaagagaaaaaaaagaggagcctcctatctacacttcttcagctgagataacagatgcctcttttccacttcttagttaacctggaaagctgggggtctgtttgaattacttagaaaggcttttaaacgccattagttgttaagtattttttcttctgtatagaaaatatgaagagtattatcctggtaaaatttacgggaagtagtgttaggttcagaatgaggtgaaactgatttaaaacattctgcattcaaaatgagacataatttagactctaatgtactttgattttgtcagtgtcccagtattctttattctttcatctgcctctagctgatcgtaggggctagattagtatacccacaaagtctttctaagctagattttctcagcgtcagcaccattgacatttgggccagataattagttgttgtgggggctgtcctgtgcatgggatgttcagcagcatccctgacctctaactactagatgccagtagcaatccccaagttgtgacaatcaaaaatatttccagacactgccacatttcccctgggggccaaaatagccccaggttgagacacttctctaactcaggttcatacatggaaccagtttctcttttcaggaatatcttgaccatatttaacctttcctcccaaccagttcagctccagtcctatccagaggagagtcggtgttgcttaatggctaagaatgtggtctttggagtctgacagacctgggtttgaatcctgattccaccatttactcattgtatgaccttgggtatgatagttaatctctctgagccttatttccttatctttagaaatagaaataataacagtgtctttcacagagttattgtaagaattaaatgaggtaatgtacgtaaagcccatggtacacaatgtttattaagtggtagatattaataataatattgtacctttgcactcctgtgttacacacacacatgcacacacacacacacacacacacacatgcacacacacacccaacttctactctctaattctccatctcaaagaaatcttatggcatcacactttcagcactcgtgaactccctgtgtggaaacagaaagttcccacagagtagagcaggcactaggtggctggaagtagtatgtttagtaggattggaaacaagcttgagttctaggcttcctggcctccctgttaagagaaaggattggactcctagatggttgctttgatggaaaatcatccttcaccttttatactacttccctcctgtggcaattccagttatacttgatatggattttattccttcccagactcttacctgaattgttttgaaggcttacagtcttcatagggttgttgtctagattgtggaattgtcctaaggatgaaatgagaaaatgtgttgtgtggtacttggcataaagccaggaatatactaagtgctcagtaaatgataactggcattgcagttgctgtgagagggtgtttgatctggataaagcagaacagacagatccccagaatgccaggccggtaaaaggagcttttggaagcttttcctcttccctattttatatctgaaaggtaacagaaagcataggctactccataggctgcactgccctcttcggggttcctgaccagcccagaaaggctttgcccttggggcctgagagtggtggtgttgtttcccatctactcagtattatgaggtgactaagtgatagaaatcacctggccaatattaaagagaaatgattacaaatgataatgaatagaaataaataatacatgatggatagacattaagttatttcaataagaggaaatgttggctcagttcacatattgctttcctgtgctttggagtggtctttaatctgtgtttgctgaaccaaacacttctggatttttcccttaggggtgtgaggatattgcttcatgggggagagctccagctgagtctgttagtctgtaaagcagagaaatgacccccttggcttgacctctgggggtgggggtgggcgatgtcttgcaggtgatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaaggtatgtaggctcccacagctgtagatgctgggaagcaacattcggtaaggcatggctgataggaatttcccagtagtcactgggaagagcagacgaggaagctctgggttcttttagtgcctaatgactgaaaatgaggccttgctctgtgccctggcaggaatactaggtattggaagaactgggcacgtgggatccaagtttctagcctctagcagaaaaccaagaaacagcagtcacctttcccaatccattttccaaatagagctcaatatcctattgctttggaggggttgggggtgactgtaaacccaggatttggtttcaggtatcaggtgttcaggggcaagagtagtggtacctccttcagagtggcattgcaagaatgaagaatgatatttgaagatagaatcaaagtggggcacgcatcttaagtagggagcctcattaacctttcctgaattgatctacattgtgcccttgaatctcattaaacagaattagaacccaatttaaggcagatgcgcatagggagtagcaacacaattgtagttcttgaatacactgtacttttatcttttagagaacaagccccccttaaaaaaaaaaaggtaaaagtgaacttctgtttccttttcagcgtcaagccaagtacacggagaataagctgaaggccatcaaagcccggaatgagtacttgctggctttggaggcaaccaatgcatctgtcttcaagtactacatccatgacctatctgaccttattgatgtaagtgcttaaagccaagggcctgagggcacctcttttctggtttcagaatactcgtcagacattccccgatactattgttcaggaatctggtgcattttgagaacaattaggaagatagcagccatgatccatcagggtgcttgccaagcaccaagtgaaacacttcacacttattcaatcctaactggaattctgggaggaaggcattattatctatatttttacagattaacagagagtttagatgacttagtcagagtcagttaacaaatgacagaggcaaaatttgcacctaggcctgatgactcaacccaggctcataaccactacactcgtctatctgccaggaaatactttcttccttttttttttttttttttttttttttttgagatagagtcttgctctgtcccccaggctggagtgcagtggtgcaatcttggctcactgcaacctccatctcccaggttcaagcaattgtcctacctcagcctccccagtaactgggactacaggcatgcatcaccatgcccagctaatttttgtatttttagtagagatggggtttcaccatgttagtgaagctgatctggaactcctcacctcaggtgacctgacctcaggtgatccacctgcctcgacttcccaaagtgctaggattacaggtgtgggccctgcacccgacctaggaaatactttattacatcagcttctcttgcacagaagtgagtggcaagaacttaactaaagagttacaatgccatcccttatatttgtatagcatttaaggtttctcagtgttaactcatttgactctcacatcaccattatgggtaagcattgctgtctccagttgctagataaggaagctcaaggtccagaggactacgagactcacttgtccaaggttatgctgcaaattagggtcctgtcaggaaggtatccagctccccctgacatctggcccattttttaaaatatgtgatgcaaaggggattgaggaaagcggctaataggcacatgtgttttgcaaggggcaagcgcagggataagctttttgttttttgcctgtgagttattcttggccttgtttttcctgctgcttccccttacagttgggtcttacaagccctctcacctacagactccaatctggcccaggtcctgagccacacctaagtgaagctatgtaattacaccctttctcacctctccttccagtcatcaaagtgaggcatctggagccagccaatttagcatcccagtctctggggcttcaagtgtatctcatctcggaggcctgccatttgtttcagggtcttgttggcagcagttgggctttgcaaaactctggcccgaccactcttgctttcctgccttggtttctccacaagcaaacctgccacacctcacaacatcatatgggatttgggtccgagtcttgctgttatatcaccacctgggtcatctaggcttgtcactgaattgttctgaaacccagctttgtttctcacccactcccaagctcctctagctaactgaagaactggactaattccctggtattaaaatctggcctcacgtaagagttgcttggggaacttctctaaaatacagattcctgtctccctttagccgaggatttttgattcagtagatttcagccacttaatgccctaggtgtcattgtctcactgggttagtagagccttgctccctgttctggtacctctttgttctctctgcttattgatgacaatctgaacactgtccttcaatggaggtcaaagccctaaacaagatcctttctcctcctcaggggaagagctcctcattgttgggagagaggcctgttctcagcataaggaagagaatccattctttcttatgcacaatttctgctatttatctcgcatttggtaaaaattcagactgtgctgtctgccacaccactgctattggttagccctcttctctttttttgtactcaaggcaacttccctacctttttcaccgaaatactgatctcaggggaagggaggggttactgctgtatcagccacaacctttgcaatccatagattctccatcaggtataaccaagtgttttaaaatcagtccaagaagtgaggtattttgtaccttattttcatcatttaaaaaaaaaaaaacgtctgctaagagcctaatttcacaggatgtggtgtgacatgccattgaaaaagaggctgccttagtacttggcagggtgtgggtctagatcactgggatcaaaaggctacataggtagtaataaagtttctcatgtttctttttttttttttttgagaaggagtctctctctgtcgcccaggctggagtacggtggtgcgatctcggctcactgcaagctccgcctcccaggttcacgccattctcctgcctcagcctcccgagtagctgggactacaggcacctgccaccacgcccagctaattttttgtatttttttagtagagacaggttttcactgtgttagccaggatggtctcgatctcctgacctcgtgatccgcctgcctcagcctcgtttctttgctgctgttttggttgtgtcttgttttagtttgttggttggttgggtttttgttgtttttcctgggatatggacacattcattattttttttaaagttgtattattctgctctataaatgttcagtaaatatttatttagggagaagccacgtgctcagtattggggtaaaaatggattatagtagttctcaccctagaggtagtcataggctgtaagacaacatttttcaaaccattggtcagatcccttaagaaagccaggaaatcacttttattggtttaacctgtgttttcagatgactagatgagactagaataagaaagaaaatattagagtacatcacattggtaagattatgtgaaacttttatgttagatatgtatgtacacacttgtacatcctatgggggagtgtgtgacaatagaagatgtgtttcttattgtgagttgggagtcaaaaaagtgtttgtgagccattgtactatgaacagaggaagatctcagtctcatctgttaagttctgtgagagcaggaaccaagagttttctttaccttagtagcctccagtgcttaatatatagctgagcacatagtgtgtttactgaaggaagaaaggaatagaaagaggaggaagatgatcatctaagctaagatcggtttttctttttgtacctttcaatatggttttgaagtataatttacatacagtaactaaacttaagtgttacagtttcaagagttttgacaaatttgtacatctttgtaacctatgtcaagatatagaataaatattttgataagagatatctttccattgcctcagaaagtttctcttgtctcttcccagccaatcccccaccccaaggcaaccactgttatgatttctttcaccataaattagttttgcccattgtagaacttcacaaagatgggattatccttttttgtgtctggcatcttttgtcagcatgatgtttttgaatttcatccatgttgtttgcatgtatcggtagtgtctttctttttcttgctgacctatgagataaaaagggccaaaaggatgcagttagagcaggactaagtgaggagcctgggatattggcatcctgatcttaacattattcattacttgctttaagacatgggatgaatcctgttgcagtccattgccatctgtgtcatgtacagccttctgcctccttcttagtggttctgaagccaaatgtgtgcataaggcattgaggataagtgaaaagaagttatttttgttgatgccattacattgaccaaggactagcctccgacttctttttatagtatagtgcaagatttaaacttcagactgtaggaatccacgtgaggcatctgccacactggggaaaccttgacttcaggccaaaaagacgttctgagctcatttgatggcatctaagaacgtaggctcactggaatgtaattttcctcccccatactcttctggctctctcaacccaggagcagatggatgaatgaagaacagggcattgtcctcatgcatagctggagtgttgtaagtgccgtgtacatgtatggaaggtctgtgacaccatgtgcacccaagtcggacatgagggaacttggctgtttcagtaagaaatgtcattaagggcagttatttttctcttttgtgtgaacttgaagtgggtgttgtgaaacacccatttttcctttccaggccttgtggagtctctgggtgaagatatcagctgggaaagggttaatgagctatcaactcaagtcatcatacatctggatgggctgtcattaacttcttacaaaaatttgatttcccctgagagatttttcatcaaacatttatataacccagaaatggccaggggagtccagcgtggccacagaactcatcagaagccatggaaagcctgctttgtccccactgtgagcaaaataatgtgcttcctgtacttactgggattcttcttggaacaggatgaaatattcaaatctcatttacctaaccttgccagatattgcttcttcgctgaaggctcggtttctggctgtttcccctacaggtatatagatagtcaagactctggagaacctcttccgaatctgcctggttggctagaggtgtagaggagccaggggcacattgtgactcagaccctcactcattggcacaaagaagctacagaatagttatataaacagaggcagtgtgccagcctgggaaaactcccagcctccctttggccatagagtaagcaaaacaaatggcttcactggccccatctacccacttgacttaggtcagtattcagcctaaatgttttatttcctgagaggctggaatctgtatttgtggtatcaatcagtcaactgaaatttattaaatgcctgctgtgagcaaggcctaatgctgagggatgtaaagaagagtgagaagctagtctggttggggtgatatgacatggcaagtcatagaatgaagaagcgtattccttgtcatatgaaagctgtagattagtgtgtttctaagtagaggccagggtcactggagtctaggattgcagggttggctggcttcccagaggctaagaatttaatctggatcttgaagatctggtccaattccaacaggtgagaggcataggaaacatttaaggaaaaggacattctgggagctgaagggcagaggtcagtggatttggagctatattagtatttttttaaagtgtctacatggtaccaaatatctgtaaatatattgcctgttagcctacaacaaactgtgtggctggtgttatcctcatttgaggcccagaaggattaagtagcttgcttatggccatatagctgatttgaagactaatactctaccctaaacagagagtatttcattggattagagcagatgaatctgaagaagaaaataaagggagttgatgttggatgggtagattgaagacagattacagtttgttctggctattgaaccttgctcaaattatttaacttcactgaacctcagctttcaagcctggaaaattaagattataccaacctcattggggttattatgaggattaaaatgtagaatgtatataaagcacttagcacatggactgacgtatagtaagcatacttagtgaaatagaagcattttttaaatttcaaaactgaggaaggtggattttaccttggggaaaaaaaatgagaggtattttaggttcttcaacaggaaagtgccataattaaagtcacagtttaggacagtgaagcagacggtgagggtatgaataggggtagaggtagtaagaatggagaggaaagggaaattaccaaaaacaggtaaaagttttttgaagggtaacttttctctcccagattctaccccctgcccacaccccctccacccacactcatacactctgtgggccgtgttacttctgttcattagacttataggcatagagctcatcaacagggtctacatagagctagtcaggaaggtttacaggttcaagggcagcctggtgagaccagcagcatctcccagagagcccatgcccgtgcagagtcctaatgagccgcttttgtctagcttccatttgctcttccctcccaactgaatttaatgtctttccatcctctgcctctagttaagttgtaactgctgttattccactgcagccaggcagctgccagggcctgttggcactgaacccagagcccaacccaactgatgttctcactgagcttcttgtcagatgccaggaaagaggaggcacatcatatgccttttcttccccaatagtagctgcttccaatgtgatcatgatgagaggaaaaggctgtggggagagttaatttgatgcttgcttgtgcaatgaaatggcaatcaggcagatggccttactctatgcatagattcttctttgaggtttcttctcaggacccggacctcagagctgcttaagcaatagagaagatgatggatggccaaggaattgggatctctgggtcttttgggagggatggggaatattatcacagagttacagaatgccattgctgaagagggccttagggattacatttagtccaaggattttcagacttttctctaacagaagaattctttcttcaaaccaaaccttacatagaatccctaaatattaaatagaaaaaagagcagggttggcttggttgaaggaggaatagaagactccaagtcctagtagttgggttgtccttttactcacttctcaagggcagcttcagtgccagctctggtctactgcttgaaagccactagcctggccaaatctgttcattttactatggaagaaacaggtccagagaaggggagtggcttttccaaggttgcttgattctgcgccagtgctttttttatacagttgcctctttttgcattttgttgtaaaaaatcagaatcctttacatggcatgaatttttccagtaacacttttgcgtagagctttttagtcttataaatgctatttctgtagtgcaggggcatctgttgtcagatgccaggaaggaggaggcatgtcagaaaccctagtctgcagctaaggcctgtcctaggatgttgggcattggtggggatgatgacccacagagtcagctccccattctctccttctcccatctagagttgagcttgcatacattagctgctgttgcaatactcctgctttcagaaccctgaaatggcctggcttggttgctatatagtgatttaaccacagtaaccctcagtgagtggcaggttgtatttttattgttgaattttgttataatgacaaccccagataaacctgaaaatgaaagaggattctctttaactctcaattcttctcatgtttatgaagtagcgcttaattaaataatgtcattttatccttatgaatcttcttcctcctaaccgcctcacagccctctagggtgtgtttaactgttgaattgggagtcaagaactgagaactctcacccagaccttggaagtcggaatgtcagccctctttctactgcacagccaagcctattgatgtggtcagatctgccctctggaccaccttccttttctgccaagccttggggctgtccatggtgtgctcatgtgccttctccttcccacagcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggtgaggccctttccctatacccccaccctcaaggggcttgagtggacttgtctagattaattacacagaaggcacattattctggggtgggagaggcctgggcccggctttttgtcaggtgggtgaggcacattccacttattgagcaaacagttagtgagtgcctgctgtcagacactcgggcttgggtgcagacatgggggattaaagccctcagggagcttacagtctggggaataaggtcgctaaggcttgaggagggttcaaactatgcatagagaggggtatccaaaggggcccagcaggatcaaagaaggtgaaaaacagcaggtatattctaaaaactaccaacagttcaggatggtgaaaggaaagtgagggaggggggcgctcccagtggtgaggctagaagaaatgagagctgaggtggggccacatcctagaggctttagtggggaagcgagggctaggcagggaatgctgtgatcttttggcatttggcagagttctgaataatcttattctcctgaaattagaagactgtgatgaagtgtatagtttgggtattgaataaaaaagaatgggtacctgcaggaaggaaaggagctaagatgctatcccaaaggcctgatgctggttgcccagacaggggagcatgaacatgggggccttgttttggactcttagcctccagtgactagaataaaaagggcctaaaaaagctaaagtgagaggcaggagaagctcctcggttttcattgttctgaatcttttggttccacttgtgtggttgtgtgtacaagtcagagtgaacctcattcctgtggataagagccaccatttctcctactggtgaaattagaaggaggttgtatagggcttatgcaatagaaaagatcaagatggacctttgggtatagttggctttaggaggaggaattttaccaagatactgttttgctgtctctgtactacttcctgtgtgttaactccattctcagacaggccattctcccatggaggcaaggtgactgcatttccagccttccctggtaggttgaaatctagtggaaagagtctctgcctccctcctcaaagcccccataaagtttgtgtgtctcattggttttgattgggtaaagtgcttatgcctgggtccatgcaaagcacgtggcctgagttgtggagtgggaggttcccctcgccgagggcagttagaccaaagctaccaaaaaaaggaggagtggacgccggggaccaaaaaacagcaacatgtgtgctcctcaggaatgatgcttcccttaagattagcatccagactctagaaatccccactccagaatgacagctgtggcagtggaaccagaggatttgctgtcatcagttggcctctatggagagtgagacgctgtcctggagatagaaatgtggagttggtttccttcctttccttcctggggaaaatcaaaccatttacagttcatttccattgctgtggcttaggaaatgtcagtgtctgaacagatggagaagtgagatggcagcatgtgcaattagaattgggggaaggggtgtcaccaagcctcaggaagccccattcctcacctgccctggcttctggtcaaacttgccttccaagcaccttctccagctgtcactgaggttccttcccagggatcagtggaacttggggaccagctgagtggagtgatacattttctggtgttagtgactgagttgccttctgagccaaacagcttgtctccataaaggaggaatccagatgctgggtgctcaagccccctcctccccctgtcagagccttatttccatactccagagtgcagctgaagtgtattaccttgcaccctggtagcggaccactgccaaagcatgcatcatcatcagctctgctacttcttaaaggaacaggcttggaggtggtttttccctccatgattcctctctgctaggtctgggttactttaaaaatcaatagctcactcttctgccagggccctccctttatgtaatatagctgatcagtggctgagccaggcaggggccaggaccagtcctggagcttgtgaaggttccgcattctagcctagccttcatatgagtgaaaataaaaagagatgagagggtgggtcattcttggcctctgcagccagtctatccccatcagtgtgggttgtctgcagattgtggaggcaacaggagggagctgcctggaagtcgttgaactagggccaaagattgggtagcattttgaccggaagccttaaaattggccagggtcccacactaactggtgttctggggtgcacagcacatgaattgatgccaagtgctctcagatgtactaggaggaggtgcttggctccatttttggtgccctcagaggctgtgggactctggatgcctgactggtgacatcaggcagccagagaatttcactcttggcgctaaccggttctggccactgagctttctccattgtgtctgcttatccaagagttagagtgaagtcagctctctgtggatctgagagttggctcaggccagcctctcagctgggggaagaggtcaagtcagttgggagcttaaaagccaatggaggaaaaggtcaagtcccagccccctccatttgaagaaaggttttttcttttcaagcaagggaatggtccgtgggcatgtgaatgtgcccactctttgctgaggaggaaggagaccatttctatccagatgtctctctgcagacaagaggctaaaggacgaacggtaacaaggtgacaggagctgtctccacatgggtcctgcctcccaactctctcagccttctgctcctcatctgtcatccaggggactgtggatgacctcatcccataaccacatctccaatgggagacagtggaacagccattccttcacacaggggaaagctaattggcaataatccttgcgggaaggtcagactcctctcttacagatctagggaaggcctggggtaaaatgatggctctttggaaaatgccaagctccttcagattccataccccctcgggccctctagcataggcaacgaacttgttcctggcttcacgctttctcattgaatcaaagctctcatgcatggcctggatttgtaaacacatgctggctgccagcagtggcaagttagcctcctgacccacttctctcctgctttcactctggtgtatgaagggggatgagggaggggccagagaggtggccacttggacctttggcaggaaatcttcactgtgccaaagcattgtgtttctggagccggagctgcctgaggcactcttctccagcctcctcagccttccatggagctgcagaccctacatagacctacccctgccgggctccaaacagatccccctacccattcctttcatgtactgtttggtcctggaagaggctcacacaagttggctttgggttttgcttcaacatagaaaccacgagccttataccttgaatatgggtagtttcattgccagtaatgggaactctggaactgccaaagggactgtatcctctttctgacctggtgttgctttcttttgttaggcttcccagctctgtgcccagcagcctgtccagagtgagctggtacagagatgccaacaactgcagtctcgcttatccactctaaagattgaaaacgaagaggtgagtttcttccttaggaggctcaaagccacactcttagtttccctgttgaaacttttgctgctgcccgtctgggagcaggtggaaggagcatgcagagaatgtccgggcggccgcaaacatttcctagccaaatgtaggcttggactttccccctctgctacatcctgcccttgaactccaggaagttgctcttgcattgccaaaggttgtgctctattttgagcttttgcgaaatgctttttttcccctctacacatttaatcaaaatggcacttggcagctgtgtgaacaatattgtgtctctgaaaccacctcctcatgcctagctttttccagcatgttcaaacaaacagaggcctttgactttgacacttcaaacatctccatcctcttaggaaagggtgagtttcttctgggctcagtgtatttgctttcaaaaagcggttcaaaagggcgggtgatccagctttctgttgagctcagatggcttcttaccttgtgtctcagtaagtcttactttctgcaggaagatcaggaagaagtagggataggtcacttagtttgcaaatgagcaaacaagttcatcagtttgttgaaggtcatgaaacagaacctggggctttgcagtactaggcccatcacacattttaattagctgtttgtatgagggggttggtttagatttattttattctctttcccttaaaacttctattataatgttgttatataatattataataatgctaatattaaattttaaaagtaaacattaaaagatctgggtcaagtacatagcatgaagggttgtagtggcttttaggttttcactgtagagagtagcatgctgtagcagagtccatgtgatgtttacctcccacttagcactgtccagtgggaagcagagctgcacactctgatggcatcctgtggccttccccagcccactctcttcaagcttctccatcacctgctgtttaacaacccacccttcatgcatcctgttggcccttgtcgtggcaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacagtaagggagtgctatggcttttaaagagcgtcagcatgcactgcagcactcaagggagatttggaactcagagtccttgttaagtgtctgaaggacaggcgttgaatatcttagatacgaatgtgggcatactcagagaccatccctacacttaaaggtgcaaacattaaaagttgtatatgtctaacagggatccgcccaagagaaaggatgctcccaagtatacaactaagaagattttcttttttaagaaatttttaactagctagtaggctttcactggaaagtttccttctcaggcacaggggatcctgaaaggggaacttcatcttttagttcttggagagtacatacaaatattcataataacacatattttgtttataaaaatctataatctcttctaggtgatatgatgacattattttataacttttattgttgggaaactattttttctaattattgctaaaacttaaaggatgggtaatatgcagcattactattttgcacataattccaaaacatcgtattttcttattcatgtatctctagtcttcttttagacagttggacccttttttctttttcttttttttttttttttttaagtattgttaacaatcctttggaagtcactactggtctttgtgtgctgctttttaataattgagttattttgagcttgccaagtaggatctattgcctggactaaaatttatttcctaatcttctgatgaccaagaaaggaaaaattaagtttgcagatgtgagatgaaatatagccagtgaatatgcatactgattctgaatgaaaggaattaacttttcagtcaagaaacagtctgcatgcagtaaattgaatttttcctgcaactggaatgatttgtttaattcttctttgaacactgccctttctccagtaagaacactaatgatttgctaatattttttaaagaaatctgtttttttaattagttaagctcagacttcctcttattttttatcctagagaaaactgctaaaagggaatgatatatcagtactattcttctaaaacaactttttaaaaatgattatacaaagccaaatatgctcattatataaaatttagaaggaaaaagaaggaaataaaaattttccataattctaccagctagagataatggtgttagaatatattcctttctaatctgttttctatgcatgcacaaacacatatgtgagcacatatttataattttattctaaaaaataggatactgctgtacatattgttttacaatctaagtcatataattataatattctttaagcatatttatgagtaaaatattaaaacctatacaaaaaaataatagaatggcattttagctcattcattgatttttgtaaaatatttaacacactccctggtttgtagttagcgttcaataaatgctaaaaatttatcttcaccatcatcattaatttatttattaatcattattaaattattcattgatcattttttgaggatttactattgccagacactgtgctacaagctgggaatgctgacagtataagataaagagggaaatgatgggggatgggtcatgtaaagggagaactttcatttttacttcatatatatctaagcagttataataggttgatttttgtaatttaaaaaatgtaaaaatgcatacatgcactagtgcatgaatggcagccaggatgagtggaattggagaagcatcacacacacagtgacttttgtgtttgatcttgaagaatgagcgaaccaggcagggagtcggggaggagaatcgcattccttgaggaaagagcagcatgtgggaaaacataaatgcacgcaataacctggctcacatgttaagagaactttctgactataatgagggatgtgttgctgccccaagcttcattatctaaggagtttgttgaacactctctagaggcttttaataataggattgtttagctggtctgtctggactgcttagatataacactatttaaatgacccaatctcattacattgtgaagatttccattttttaggttacgtaagaaattttggacctaaaaatcttgcattttaagacagtctttgtcagaattactttttggctctaaatgaattctgtaacatttgttttctaaattgacctttagtaaaagcaggaatggccatattcaaactggtaacctcgcaaatcctgcccaccctttcactttctgtctcaatacattgatgtcctctaacccatttcctgtcttatgtggctctagtgccacttatcaaaattgtgtgcaaatttccttggctaacagtaacagtttttgtctgggcttgtctagcagtggaattctgcctgagttcatcatttttgtgactggtacttgaagtgcatcagatgattaatttcatgataagagggctttttggggtggtgaaatagacatttatggaaaatgggatacccacattaagcagggtgactacctgtttaccatacaacccacacaaagccaatacaactatagatgtgctttctttagtctgttgcctctgcaaacattgcccgtgtgtttctctatgcccttcaaaaacatcagagcagcacatcctggaagatcctatcttttgtaagtttaagaagcagcctcttgtcacagcttgactcctaggtagtgtgcctagtgaccaagagggctgctaagaaagctttctgaccacttgtggctgtcattggactgatttgcccagatgacatcaattgggaatttgaggcatgacctataaagatcagttgcttgcaagagtctcaggaaaataattgtggagttaagaaacttgaagcgatttttaaaaattacctaacccaaccttctcatttgaaaaattaaaaaataaataggccagatatggcggctcatgcctgtaatcccagcgctgtgggagcctgaagcgggtgggtctcttgaggccaggagttcaagaccagcctggacaacatggtgaaaccctgtctctactaaaaacacaaaaattagctgggtgtggtggcaggcgcctgtaatcccagctactcaggaggctaaggtgggaggattacttgaaccggggaggcataggttgtagtgagccaagatcgtgtcactgcactccagcctgggtgacagagtaagactctgcctaaaaaaaaaaaagaaagattaaaaaataaataaatctgctgggcgtggtggctcacgcctgtaatcccagcactttgggaggccgaggcgggcggatcacctgaggtcgggagtttgagaccagcctgatcaacatggagaaacctcgtctctactaaaaacacaaaaaaattagctgggcgtggtggcgcatgcctgtaatcccagctactcaggaggctgaggcaggagaatcacttgaacccgggaagcggaggttgcagtgagccgagatcgtgccattgcactccagcctggggcaacaagagtgaaactccatctcaatcgatcaatcaatcaatcagtaaatccagagaggatgggtagctcacaaaagctggacccaccactctggttacagggtctctggccacaggctgcttctctacaccctgtggaagaagcagaggtgaagggaagggctcaggaacagctcagcaatttttgcctcttatttgccctcagtggtgacatgtttcctgatcttcttggctttgtgtttatcgcttatcttttataacacatagttcatcaatgtctactttttacccgttgccttttttattgtgattgttaaaaatcaatacttttaaaagatgcaaagatttgaaaagggtatacaggaaaacgtactataaagtttcttttcattcctgactcctatttcccctcccctctgctggtgattgaaaccagtttcttctgtgtccttccagagatactctatgcatggacaacaactgacgtatctgtaaataccctttaatatgataaattacattagaaatgtaatgaaagaaaatggaagtagatatagaagtattccacttatacagttcttcacttttttaacgttctttatcttggatcttatttttatgttagtcccaaaagatctgcgtcctttttaaatggctggatagaattccactgtatgaatgtgccatcatttgtttaacaaattccctcctcataggcagtgatgctcgctgtttagccaaggtttaccaaagctttataaggctggcattttcctaagtatttcctttgttttttggaaaccaagcctcggctcttgttgcccaggctggagtgcaatggtgcaatctgggctcactgcaacctccacctctcaggttcaagcagttctcctgcctcagcctcccaagtagctgggattgcaggcacacgccaccacgcctggctaattttttgtatttttagtagagacggggtttcactatgttggccaggctggtctcaaactcctgacctcgtgatccgcccaccttggcctcccaaagtgctgggattacaggcgtgagccaccatgcccagcctaagtatttccttttatagggagttggagaattaggttcttttatgggggatagaacagtgaaggggttaaggatcatggccgataaagtaacaaagctaaacagtctgaattcttagggacaggtttggggaaggtaataggagaggaggcaatgccttggccactggggcactgagtgacactagacttggaacttgtggtctgagatctttttatcttggtattctcttgcaggcccttggtaaacgtgtgctagtgagtacaaatgagtgaatgcccctgtgctgtcaattaaactggggagacatgctccatttaaagtttactctattatgtattctatctgacagctgtttcctattttaaaaattgacggggaggaggggaaatgtcagcatgcctgcatggtggggaaacagccactatagtgacatctgtgtatctctgagcatgggctgggtaggtgtactcactcctcctgccttgctgcagtggatacttagggtcttgggttcacgcagattaaatccaaggcataagcaacatccagtgagttttatacccccatggtaagagtgtatttaaagggaagaggtttttaaaaatgaaatttgaaaagcattctagtgcctcttactacttttttaaggcccaaaaccttctgctttcattctgcttttattttagcacaaagcaaagatgcttagggaagggatgcttttaggttcactgaggaggtgattcaggtataaaggaacacctttctgagtgcctgctctatgccaggccctgtgctattaacagtaatgcttattatccaatttcattctcaccaactttgtgaaaaaaatagtattctcatttttcggatggaaaaactaagactcagggggttaaatgatttgcccaaggttaggagagttagtaagtggtaggactagaatattccaactcatgctttttcattttaatgcaactaaaacgtctatcaaggagggaatgtgcagaaagaaaagttattatgttaatacttttcaataaacaaaactcactgctgacagttaatatccaattaggaattattaggaaatcaattaatgagatcataaaaactgaattgaagtttcacaatggcactaaacaaaatgcccaatagactctttgcctcccttcctactttttgaagaaattctcagttttgattattttaagtgtgaaagttgttgggggtgggcactggtcagactgtgttttaggaacttgattttattttggtgaatacctagaataaaatattacctgttcttttgctccttcattgaggaaaaccccaggtagccactttgattttgggtgtttggtgaaggaaggaaaaagaactacctaatattggaacatgccctaagtaaggagagtgatcctcattgcccaaggaagggattttgagattggagattataagcagcccttttcctggcccccctgatctccagaagtcattaaaagccacctattcttcccttgcattcttcagcggtctcagctcctttctctgtgttgtctgtccaacagcaacagaaaccttctaactcacttccaccaattaaagacaaggtcacttatccccaacgagtctctcatatggataagtgctgacttgtgggtgggataggggagtgataaataaaataacgtgcctgcagactctgagatgcctttacctttccatacctggcttacctggatggaaaactcccaactgtggtttccacgccagtattagggatacagttcataccttgacacagttatgatccttcaggatttaatgaaacccgaagaggtaatccatcatacatctttaccagattgttatttattttaatggttcatcaagtgatagccagagttaactaatgaattgtgaacatgaatttaaaaaatgatttctggaatcacaagtagtgagaggaaggaatttgtatccatctcctttgagaactgtggctgttttctgagcagtctggtcttgttttgaaggttacagcttcttggtgaattttcctcattaggaaacctttagagtctcctgggataaccttccaaagagagaggcttttgaggcttgcattgttggcaatggatatttcctgaaggctttccacctctgggccctaaagtactgttccaaacccacaattaggcattggttggggatttggatattaccccgggaagaatgacagcaggtgagctggcatctggagcagatggaaaagggaaggtgataacagagcctctttccttgcagaagttcttgtgcaaaagcataaaaggacagagggaacagatcatgaataaggcagtagaaatgatttggtgtaagatttggttttggcttgttttatttttaatttagagagtacgggcacactaggggcttggtttgtaactgctgaggaagggtctacccagaggagagtgagactgctcattcatttattcatcatgcatttattgagtatctgctatctgctaggcgtggtagtatcagggatgcaaaggataatgaatgacatggtctctgaccatagagaggaggcagtctgaagaaaaagacacatgagtaataaaccctctgtgacagggctgtatgagaagtgctgtcatggagatttgcatggtacacacaggaccatctgggtgaacatgggagggctagggactgcatcccagagaaagcagatttttcttttgtttttaaacaagagagagaatcagatgcaagctcttagttaaaagttcacactgtacagaaaagtatagagtaaaagtaactcacatttgttcacttttcttttctttttctttcttttttttttttttttgagacagagtcttgctctgtcgctcaggctggagtgcagtggtgcaatcttggctcgctgcaagctccgcctcccaggttcaagcaattctcccgcctcagcctctcgagtagctgggattacaggcactcaccaccaccatgcccggctaatttttgtatttttttgttagagatggggtttcaccatgttggccaggctggtctcaaactcctgtcctcaagtgatccatctgtctcagcctccaaaagtgctgggattataggcctgagccactgcacctggctctgttcaccttctctttctatcactcttaatcctaagtggcaatccatgaaatcaaaggtttgatgtataattatatgttttacttaatatacattaaaagacagacagaactattaccatttaaaatggtgcatccacctatctacctcagtgatctcatatatcaccagtaattcacggatcacactttgggaaacctggccatttgacttctgagttcagacttaggcagatagcccctgatctggaggatgaaccactgcagcaggaggtgatcaaggcaaactaagacccccaagaaaggctgtggaggagagcggaaaagatactgtgttaaaagtccaaaggccttagattgggcctgacactaccacttgctagcttgcaatgatcagcaatttatttgatacctcccctcccctgagataatcttatctgtaataaggaaataatatcttccctatgtgccatacagttatttattgttagagtcgaatgagagaatatgcggtgaagtgctctaaaacctgctatgttgctgcatgcataaagcattaatactacaaaatttagttctgcttctctccttctcctgctctgtaccatgatggatggggcattttgtcgtaatggttaagagcacatgctgtattgtcaaactgcctgtatttggatactaactttaccactcactaactgtttgaccttgagcaacttaattaaactctcgaaacctcagtgctctcatgtgtaaaatggaaatgatgatgatgatgatagttcctagggttgttttgaagattcagtgaattgtctggggacatacggtctctcactgggcagacgagggttgagagagaacaaatctgaaagtgcagcacagcaatcatattttgactgtgagagcaggtgggatcacatttccaaaacttcatcttgtatttagacctggatgtgtgtatgcaagtcggggatgtcagccccttccgctgagtgctcagaaatccgaagctttccataaagactccatgcagaatagagaaggaagctgttgaggatatggctcaaagatgctccacatcctgggcttgcagctgaggcagggactgagcctgccattggcactgctcctggtgtgatggaatgtccccccctcctcccaccgaggggccagggcagggtgggatgtcagtggaggtgacagatagcaggtgtgtgtcctcacaccaagaagaccagggctcaataagttcatctaccctccctgctcttcctcagtgaaactgcaggagaggggctctaggaaacaatttctttatactggccatcatagaactcccagaaaaaacctggagaaggatattaatccaccatgaaaatcaacagctgcccatatgatcagtgccttaaagaaattaaaaaattgactggtggaaattgggtcagaaaccaaatgacctctatataggggaattgtccagctgagcatctgtgatttttttcttcttcttcaggagtctgattgctctttttcctcctcctctcttacagaaaatgaaagagtacctggagggcaggaacctcatcaccaagttacaagccaagcatgaccttctgcagaaaaccctgggagaaagtgagtgtgggaaccctctgctagaggcttgacagtgaggccagctggagctttcttgctgagcacacgcctccatcctcagccaagtggacccgatcttgttgtatgaatgcctttcttttcttggcttgttggatgtggaagcacacaccccaaatgactgcttgagtaatggggaaaggccaatgcttaatgaagcactaacgtgtatcatctagttgtttaaatggagcgtgcctgctctccacccagtccctccaccctcgcctcctctgccacgactagggtagagaggctgaggggttatttattctccagacactttgttaaaactcctagctcctctgaggcagcactgagactggagcaagaaggtagggagctgtgagatgagatacgcagctgctctgagaggagagaatcctcaaatgcaggagggatggacagactgctgctttctatagcttccagaaagagcatcagtttccttctgctttgaaagctcctaatgctgtttaagtggcagccctctctcgtgtggctatgctgaggccttggtgctgaatggactgtcttgtctcatagaatgattttaaccagaccctggaaagtagcaaggcagagaactggaccggcactctggactttctctcctcaactgtcaaacagaaggtggaggttgaaagagaagcttccccagggttttttggcaccctgcccagatttcctgcccaactctcagcatcctatgattaatgggattcccaggttggggatgcctctgaatgccgcccccccctccctgccccactaatctaatctcctcacttaaagataggagggagtggaagggagaagctgcagggaatatgtgctaacatcagttacaggcaagcctgtacttacacagagatctgacattttaaaataaattcttgagcactctttagacaaactgcaaagtttaggaaagtgtgcaatactccttggctcattggccccaggaattggagcctcacttcttattataccagaacctcctacccaccttttttgccctgtccttttcctgccttggatgatttcccagatgattaatttttttctctaatcttttatctaatgacttcttttttttttttttttttgagatggagtcttgctatgtcacccaggctggagtggagtggtgccatctcggctcactgccaactccacctcctagattaaagggattctcccacctcagcctccccagtaactgggattacaggcacgtgccaccacgcctgggtaagttttgtattttcagttgagatggggttttgccatgttggccaggctggtctcaatctcctgacctcaggtgatccacccacctcagcttcccaaagtgctgggattacaagcgtgagccaccatgcctggctgatcttatgactttttttttttttttttttttgagatggagtcttgctctgtcacccaggctggagtgcagtggtgtgatcttggcttattgcaaactccacctcccaggttaaagcaattctaccacctcagcctcctgaatagctgggattacaggtgcccaccaccatgcctggctaatttttttgtattcttagtagggacgaggtttcaccatctgggccaggctggtctcaaactcctgacctcaggtgatctgccggcctcggcctcccaaagtgctgggattacaggtgtgagccaccgggcccagcacaatcttatggcttttaagacattttcttttatgtgaagaaagctggttagataatttctattcttcttcctcaccaccgaaaggactcagactaaacaagtttgggcattgagggccaaactttgcttatagaaaatctttactcttgggttatcacatcactccatggagaatcaagacagtctaagcatagtccataagtaagacagagagcagggccttggggccatacaaatgcattcatatgcgctcacatttgtgtgtgtgagtgaatgggtttactcacacatttatgcaccaaatgtgctactatggagggatgaaggctgatcattagtgctgcaaattgtcttaatctaaagatgacaagttctagcaataaagaaaaaaaaaagctataaatctttctgtgtgcaagtcatcacgtccctgccttctgaatgtttttgtcaccatgatgcaggagccccttgttcttgccgtagagggataattgatgtgtatgaatattccagaatggaaatggaacagatgtagaaaataatggctcagaataatatttttgcacataagagctgagcctttggtaacgagagacagttaggggtaggggatggcgttgctcaagatgagctgaactgtaagcaacaattaccaacctttaaaggcaagaaaatgccctgccctccctccgccagcccttggagttgcctttgcaagagcttggatagggaggagtgtgggagctgatttttacttcccccagctcagcacctgctagggtttgcccctggtttaaataatgcagatctaaaacagattgagcttcattaactgtggtcctaaagaaagcaatatatattacatcatttcccatgtagacatgcatatatatttttttaaaacatgagaatacttctcatgaacttgaagattttcagtttcatttttttaaaagctagcaatgacccattaaactcctaaggcccactgttagattgagaaccatgatttgctagcagtatcaacattgtatctcccatctcccttgccacctcagtcaaacctaacaggagaatttactatgaatctaaagctagaatatccatatcttctctgttctctcccgcaaacaactcctcttgttctctcagcctccaactctctgtgtgtgtgtgtgtgtgtgtgtgtgtgtgtgtgtgtgtgtgtgtactcaggagcaagtaaacttggccttccaccccaccacacacacatccaacataagagaagctgaatttcatctctgggagggcttctaataatttattctattaagtatgatctgtgctgctattgttccactacctccatctctatgttcccattgggaagcagaattggccctaaggtttagggggactgacctggactgggaatcagcatcagaaacagtttttgcccagaaagagggtcttggtgctttcttttctttctctctgtctctgtctctctctgtctctctctctctctcctctcttttgccacacactgttatactgtggctgtctaggggagataggcatggtagttactaggagtgggtctccctccttcacctcttctcctttaacataatgctttttgcctttgtgtttccaacaggtcagcggacagattgcagtctagccaggtgagtgtggcctgggacaggcctgggaagtgatagaggcttggtgggtagagcaatcttactctgggagagagccaaggagttgagttgtaaaggcattgaatgactttacaaagcaatggcctggggcggggtttgtttacttccctttgccttactgaccccatctgatctcagatagaaatggggttttctgggactttgagaaggagctaagcagaactgagtaaaaggggttatcatttgctgaaattgtcccagagaccccctaacgccactgaattgcaagtaacataaacattcaactgtagaggattctggtaacctaaccttagctgctagacttcaacataggggctctggggagtctctgacccagagaaagaagatcaggagatggcatttgattttttttttttttaatgcccagaaaagaaggcagcccctaattagtagtgactgttgctggataatgaaatattacattgcattggctcgccaaagagtattggtagaaatatttgcctgatgtacaagtatgcacccctcccaatctttccccaccttccccttcctcctccaccccagccaaatattttccctctcagtcatggtgctgctatgagaaaatttgtgagctgtcggagagcaaggtattcattcatccagcagttctcagatgcctagaaatgtgctgatttaactagagaaggggctttaatgggttggactccttagagaccctgggttagcccattatatcaaccacttatatctgccaaaacacataataattatgaggccatttacaattataggttcattatttagagatagcttcatttggctttcattgttttgtcattgtgaattacaataaagatcccattaatataccagtcttgatgactggagggaaccaggataatgggattctctggaacacatctttttggtgttagagtcttactgtaagttcacctgagctcctgagtctgtggaaggctctgtaggactgaaaagagctgagttgaatttcccggtgctgagttattttgctgtgagaccttaggccgctcttttcccctctctgaactctggtttcctcttatagaagaccagagcactccactagattcaaggtgtcctaggattccaaaggggttcctcaggagtggcctggtggcaggggcagagcgatgaccagcaaccaggctctggtcccatccttcactcagagcaggacagccctggcctccttggtttgggtgttatgcctctgagtcagattccctttgagaagaggcttctgaggctaaacacagattggaaaacattgacctagaggattctcaaggttgtttccaaactagatgttctacactctaaacccagaaaaattgttccctgtaaagatagcgatctttaaggatttcctagagaaacaaaacaaaaagcatcctttggtgtttcccagtgtctcctagcaggcaaaaaaatcttcttattgtctagcccaaaaatattttactaaaaattgaaccagtcctctcctattctaattttgagtagtggtagacattaaaagcagggacgtctgtgcttttgtgaaaaaaaagagctttcgtaggctttattgtggaagtaatttatcaagtttcttagccatttctgggactgaactgagtaatgtcacatgtttcattggctaccacacagattttttttaattattaaaaactttacttctgggtttaagagtgattgtttatctcattcgtcccaattttctctttttctcccttgttgctggattggtccaatctgattcggcgggattggtcacaggcgcagctcaactgtgaggaaacaggtaagggcccaagcggggccaggctggtctggcctgaaaatatagtccatcccacaggcatttattgagcgccactgtgtgcaggacagacacctctgacttcatgcctgcatttggaatgtatcatttagtcatagtatgtttaatatggtggcaatgtcattgatttaactagttggagtggccatagtctttttgacttgtccctctcctttctagtcatttatcctcttgcatactaggggtttggtttcattggtgcagattgttccagaactgcccatggcatccttttccaagaccacaaaagaggcttgacacttcctacatttgtgctaacatatcagtaactcacagcacctaattagctagaccagacaatctcgctttaagttggcagattttgtttgattgtttccggtggcgtagtcattctagatggattcctaagacatgctaacaatgagaagattaagtctggtctaggaacgataggcaagggccgttcaactctgcaatttggtgcatgatcttcagtgttgtgttaaaatctgccactgggcagccagctctcattacccatattaggagggctcttagagagcagtggcatggataatccacatcaatggataatctaaacagcacttgtgcttgtttaaaaaaaattaattgaagtattttttgcagtagcaaaattgacttcctaattatactttatggcaaatactgaaatgattttatgtcccctaagctcataccagctatgcagtagacagcagggagggcgggtggagagagctcagaaatgtctttgtgtctgctcaggggaaagctaatccaggctttaaaaaatcattttgggtaattctcagtggctctagccacagggagataatcgaataaagagggcgcatggtttttatggtgtcggcagcaccggcatttcttcagctcatctgactgctctgacagggtggaccattaagctggggaacttggatgatacaggcctcgcttgtctcagctttgctgtcactattttccccttctctactttgaatctcgtcttaatgagtatgccatcagatgcaattacacattttttaaattataaaaatttaattgcaagtctcctccctctttttcctctatttctttcttcctcctctttcttccataatttcatttaaaactagagaggaatggagtgactcctagagataatttagtgcatttaaaattaataggtgcatatcttgcagagggagcaagccattttccctttaacactaagaaaagaaatgagcttgaagtttgttcttttcagttccttggctgaaaccaggcatcttgcttatagctggagcatgtttgcaaggggtttgcagctccactgtggctgcaggagtgccagagacatcagtttggcaggtgatatgtgcccttggttgggctcactgttggaggggaacagcacccatctggtttgcatcctgctgcacataagcagttgcaggcaaagtgtgtttgcctggtgctagatttgcgtaggagttacaagatataccaaaatccccaatccaataaagaccttgttttcattctgctgccccagtttctctctagcagttcatatctactagtggatcagcaagaagttttcctaagatggtcaggaagataaaatagatagtaagttacttggaaggtgagtaatcttatataagtaacaaggaaataattgtttgtttatggcaaatcaggcaaacaagaggaagaagctagtagtttttgtttttgagggtctttaatgggttccggtcatttttgaccctgtcaaagactaggtttaaaccatcccagaccttttttaaaaaggagacagtctcactgctgcttccagaccttccctgctccctgtaacctcagcattatttctctcctggccatgacttcatatcttctttgttggcctttctccattcctctaaattgaagcatttctccagggctctgtcctctcacgatgtctctctatattctttcctttgtcactcttgttcccttagatgaatctttctcttcttccctaagcattcttttgttctataatgctgtccttttgagtccaatgagtaattcctcagtgatcgactagacattcatacttgaaagttgtgatagcaccttctaccttcagcatcagtctcaccgtcccccatcacattttgatttgcgtagcccctcccttcacttctctgtttgtgttcggggggactccattcttcacagtctctgaggccccaaatcttacctttgatgcttttttcatcattactcacatataatctgttgtcaagatttgtattttctcccttggtaaaaatgaaaattaacaaatgtagtacaaataagtacctaacaaaaactctaaccctcttactcatgtgaaattatgccagataatgcatattcacagattttctggccacctttctgattttttttttttcttttttgagacagggtctggctgtgccaggctggagtgcagtggcacaatcttggctccctgtaacctccacctcctaggctcaagcagtgcacccaccatagcctcctgagtagctgggactacaggtgcacaccaccacgcctggctaatttatgtatttttttttttttttttttttttatagagactgagtttcaccatgttgcgcaggctggtctcgaattcctgagctcaagtgatccacctgcctcggcctcccaaagtgctgggattataggcgtgagccaccacgcccggccctttctgattgttttctcctgcaaattactggaccactgctttactatgttttccaacttaggccctacctttctccctctacttttggtttaaagttcccttaatctgattggatgagaatttggcctgattccttaaaggccccttctaaccctaagatttcattaccaaaaaataaaaaagtgtatgaaggaattaagctgacaaggatttctaacattggaggagggaagaagacagagagaaaggaagagacgaatagtacataaaaatgtagacactgctcagtcagtgctcacgcctttagtcccagcactttgggaggcccagatgggcggatcacctgaggtcaggagttcgagaccagcctggccaacatggtaaaaccccgtctctaccaaaaacagaaaaattagccagccatggtagtgggcacctgtaatcccagctactcatgagtctgaggcaggagaatcacttgaacctgggaagcggaggttccagtgagccgagatcatgccattgtactccagcctgggtgacaagagagagactctgtcccaaaataaattaagataaaataaaataaactcagttaactctatgcaagggcagtggtgaagtgcaggtcttcgtggcaccacaggagtgcacagacacatcccagggaaattaatttactcattgctcagaaacattataaggagagaggaggatggcaggagcgttcaaagcctttgtgactttgtccattttgtgctcctactggactcttagactccactggagcagtggggactagaaaaatgcctgtgcagtaggacaggtcatctttagcccacccttacctgccacaggttatccattgggggctgcatgtgagtgctgctggtaaccacggacatgcaggttaatatttttcttgccctgtttcctgccaaccctttgtacttgcctttaactaccactgatattccatttcctgcaggccaaattttgtactcacacaatttgttgaagccagtagcctgtaagctttccagctttcctctctctaggtcataatatataaacctaggaccaacaaaactatgcaaacgctcatatcactaacttcattatcactgctgctactattttttaataatttatattaatacacaataattgtacacacttatggggtacatgtaatattttgatacatgcatacaatttgtaataaccaaatcaggttaattagggtatctgtcatctcacatatgtatcattttttggtgtgtatgtattgggaacattccaaatcttctatctgttttgaaatatccaataaattattattaactattattatcctactgtgctatcaaacattagaacttatttcttctatctaactgtatttttatacccattaactaacctcactttttttttgttttgttttgttttgttttttgagacagggtctcgttctgttgcgcaggctggactgcagtggtgtgatctcagctcactgcaacctctgcctcctcaattcaagcagttctcatgcctcgacctcccaagtagctgggattacaggcgcgcaccacaacgcctggcttatttttgtatttttagtagagacagagtttcgccatgttggccaggctggtctcgaactcctgacctcaggtgatctgcctgcctcagcctcccaaagtgctgggattacaggcgtgagccactgcaccctgcccaacctcacttctttttttttttttttttgagatggagtttcactcttgtcgcccaggctggggtgcaatggtgcaatcttgcctcactgcaacctccacctcctggattgaagcaattctcctgcctcagcctcccgagtagctgggattacaggcatctgctgccatgcccagctaatttttgtatttttagtagagacaaagttttaccatgttggccaggctagtcttgaactcctgacctcaggtgagccacctcacctggcccaacctcacttcttgacccctcactccccgctacccttcccagtctccagaaaccgtcattctactctctgccttcatgcaatcaaattttttagcttatagatacaagtgagaatatgcagtatttatctttctgtgcctggctaattttacttaacacagtgtcctccagttccatctatattgctgcaagtgacagaattttattcttttttatggctgaataatatttcattgtgtatatataccacattttacccattcatctattgatggacacttaggttgcttccatatctcagctattgtgaataatgcagcaataaacctgagagtgcagttacactgatacttcaatatactgatttcttttcttttggatctatagccagcagtgggcctgctggatcatatggtagatctacttttagtttcttgaggagcttccatactgtttttttgcggtagctgttctaatttatattcctgccagcagtgtacaagcattcccctttctctgcatccttgccagcatttgttattttttggctttttgataattgccattttaattgtggtgagattatttaaaaatttgcatttcttatgattagtgacattgagcattttttcacatacctgttggccatttgtatgtcttcttttgagaatgcctattcaaatcatttgcccattttttaatcagatagtttggttttttgctattgagttgtttgagttccttatatattctagttattaatcccttatcaggtggatagtttgcagatatcttctcccattctttaggttgtctcttcactctgttgatcgtttcctttgctctgcaaaagctttgtagcttgagataatcccatttgtctgtttttgcttttgttgcctatgcttttgaggtcttactcaaaaaatctttgcccagaccagtacccttgaagcattgccccaatggttttttttttagtcatttcatagttcaggtcttacattgaagtctttaatccattttgatttgtttttctatatggtgagagataggatctagtttcattcttctgctgctattatttgtaaatgagaaatgtaataacagaagtctgtaaacataaaaagactccccccagattgagcttttctggcattttcatagtggaacccagtttcttccttagaatagggaagagaagacaaagattcttcccctgagatcaccctagcctaaccagccagtcagtgatgccgacaagaggacagacactggctgctgtagctggaaagctggaggaagcagatgggtttgggggtcatgaagatgagcatttgggtcgctgcgaccgtcctgacaccagctccaacttggcacatacagtactccctttggcatcatccctggttcccagaaagcttgagaggtagaggctaagccagcttttctctcagcctgacttttttgtgagacccagctgcttgcctaatagtggccaaaccctatggctacagtggcaaattcagagccaggggagggatccacgcagacctgtcaaacgggcagaagctacacagacccatcgcacttgacagtctggtctctgtcctgaacatctaaagccctttctagttaagttcggtcccctctccctgatctctttcttccacacagctgaattattgtacattcagctgcattataaaaccctactggtttaggccaggcacgatggttcatacctgtaatcccagtgctttgggaggctaaggcaggaggattacttgaggctaggagtttgagaccagcctgggcaacatagcaagaccctctatgtaaaataaaaacgtgctgggtgtggtctgggtacctgtagttccagctactcaggaggctgaggcaggaggatcacttgagactatttgctcaaggttacattgagctatgatcgcaccactgcactccagcctaggctacagagggaaaccctgtctctaaaaacaataaattaatttaaaatataaaataggccgggcgtggtgactcacgcctgtaatcgcagcactttgggaggccgagacaggcggatcacgaggtcaggagatcgagaccgtcctggctaacacaatgaaaccctgtctctactaaaaatacaaaaaaattagctgggcatagtggcaggtgcctgtattcccagctactcgggaagctgaggcaggagaaaggcatgaacctgggaggcagagcttgcagtgacctgagatcgcaccactgcactctgtctggcctgggcgactgattgagactctgtctcaaaaaaaaaaaaaaaaaagaaaaagaaattgtatatataaaataaaaccctactagttttgagtaatacttggtatgcacacctggcaatgtttgctgaatgcctagggtgcagtatgggtagtggcaaagtgttaggtctccgagggagattgcctgggtttgaatcctggttttgccacttgccagctgtgtgaccatagcagctacttaacctcactaagccttcatttcttcatttttcttttctttttcttttttgagacagggtcccgctccatcacccaggctggagtgcagtggcttgatcttggctcagtgcaacctctgtcctctgggctcaagcagtcctcccacctcagcctcgcaagtagctgggaccacaggtgtgcaacaccatgccaggctatttttagtagagacagagtctgttgcccaggctggtctcacactcttgatctcaagtgatctgctggcctcggcctctcaaagtgctgggattacaggtgtgagcgaccgcacctggcctcactttttcattttaatgagtataataataataatatgtactccataggattgttaccagcactagtccatctaaaggacttagtacatggcctcacacctctttaaattcctctataaatggtaggcactaatgttcatgtgttaataggaaatattactctccttgcctccagtcccctccccagtctgtagaaggcaaattgaggcccaaaaaagttcagtgacatgagccagactgtgaagcaaaacaacagagcaaagattgacatctgggaggcctgcttctttgcttagtacctgttagtccccactatttagagttagtttttcttttctatcttacctttataccaaacaaaccctctttctgaagctcccattggttcattctgctaccttcaactgagaataattgagcacctcttatgtgagagcatcatggccaaccctggacacccaggaattgacataggatctgctcttgtgaagtttgagctgtagtggtgacaagtgccaacaaatattcacatccacacattggagtcacagtcagggttgaggagaacatacccccagcaggagcagctcatgcaaagccacgaggcaaaggaggactttgcagaacagaaacgtggccagcatagctgtagcagaagctaggggaaagaacaggcagtggaactggaggcacaggcagtattcctggcatgcaaggccgtgtaagagagtaatgagaggtctttgaaagagtttaaataatgaaatgtgcccttttaagattacctaattactatgtgaaggaagagaaatgcgggtcagaagatggcaaggatgggaattgaggtattggtggattgaactaggttgggggcagttgagatagagagaagcgaatggatttgagagatatttagaaggcagacatgacagaatattaattaattaggtggtggagaaggtggtgagaaactggtttggggcagaagatgatcagttttgtttaggacatgctaactttaaggcatctgtgtagcattccatgtgggtggttgtatttttgtgctctggaacttggaggacaggccaggtgcttctttgtagaccggctggtgatccgctaagacagttctgcacggtttggcccgttttctctgaccctgggctatccctgtttgaatattctaatgttgtgtttccctttggcttttcaggactccagccaggcaattcctctggtggtggaaagctgtatccggtttatcagcagacacggtaagcaggatgacagccttgtccatatttgtgcaaagattgggaagaacttccaggaattctttgtagagtaagaatagagattgacttcccatcctggcattctcagaaaaggaataaattcttacttgtccacataacttttgctacctcaaaatagccacacctagacattgaaagaaatgcatcatatattttgacacaaaatgcctcagccacttatcacgcagcatttttttagcttgagagtaagtttgaaattgcagctgttatgtaaatacagctgctattatgtggtaacagtagtttcaccattactcacagtctttgcaagtgtgggtatctcccactgtacagcctgaccattttgtcactttctgtaccagactagtttgaaaacaactcctttcccaatgttgcagtgattcctaataatcagtttttgttctggtttggtctcactggatacagcatggccaagggctgagttagtagctggtcttaaagttgtatccaacttttgagaatctgcagaggcaggctgcttctcagcctaggtgaaatcatactctcttctacttggatgaagctgaatcttataaacaccattcctcaccagctactggtctcattggacagaatttagcgatcgaaataattgccagagaattgatttcccagggattagagtgtttataaaggacagaactagtgctatgaaaatttctaggaactgagcatcagaaattgtttttagatgctgttctttctgtgataggaaaaggggcagagtgacctttctggagctaaggaggtagataaaatattgcttgtctaaattcagaggcagctattctctctccctctccttgtctttttctctccctgtaaactgggacattgctcaggttcatttttggaatagtaattattatagcatggttacaattgatctcattctaatcagctataatttttaaattttatccctattcatttaaagtaacagcattgtatatcagtattgaacagtcaacaaatttatcaagtccctgatcaatgctgggtaccatgcattgccatgcaggaaaacagaaacaggaataatatactcttcctgtctttaagtggttttgtgatgcagttgggagaaataagtaagcaagtgataagttaaataaaaagggataagctgtggtaattcagaatagagtataagaaatttcacaagatagtaatgattaacagtcaaacagtttgcaaagaaaagtccaaacggagttcaggggaggatgaattatttgtgcctaagagacaataggaagaagaaagtctgagccactgttcattagcatacatttcattcattgaacgaatacatattagttgcttattatatcccaacaaaaagtttctgccttcataaaccttacattccactgaaaggtggataagcaaatgaccaattgatcagccagtaaatacagtatgtcaggtattggtgaatgtcatgaagaaaagtaaagcagggtgaggggatggagaaggaagagggaacactgtttgaagctggttcagggaaaaggcctctcctaaagtgacattagggcagagttgtgagggagtaagccttgtggatatctggggaagagtatcttggggagcgggaacaagtgcagagatccttgccatatgcaggaagccagcgtagctggagcagagcaaatgaaaaaggaagcggcaggagatgaagctggaagccagactcttagggcctcatgtgctaggattggattttattctgaggaagatgggaagccactggagaattttgaacagggagtcatctttttaaaggatccctgatgctctatggagctaagactgtaagaaggagacaggaagcaactgcagtagcctgaggaagacatgatggcggcctagaccagggtgttagctgtggtatttgctgaaaagtgggcaggttccagatattgtggcatgaatgtacctgtttctgccccttacagccacagtgcgtgagtgcttcaccattactgtggtgaagctctggggaaacaggcacatttatatgttactaatgggaatgcaaactgatacaactctttggaagggaatttggcagtatctaacaaaacttcatatgcacttacgatccagcagatcctaggaattctagaaatttgccatgaagttacatctccaacaatacaaaaatgcatgcgcacaaggttatttgtgacagcattgtttgtagttgcaaagtattagaaacaacctaaatgcccatacatagaggagtggttgaagaaactatgggacattcattcaatggagtactatataagaatgagtaagatttccttgaactaatatggagagattcccaggatatgttgttaagtgaaaaaaacaaaatgtgaaagagtctatatcatgtagaatactacagatgctcctcggcctctaatggggttacgtacggataaatccatagtaagttgaaaatgtactcaatatacctagcctagggaacatcagagcttagcctagcctgccttaaatgtgctcagaacatgtacattggcctacagttgtgcaaaatcatctggcaacactatacactgtagagtatgtgttgtttaccctggtaatcacgtggctgactgggagctgtggctctttgttgccgccaagcattataagagaatatcgtactatattttgctagcacaagaaaagatcaacattggaagtatttctcctgaatgcatatcattttggtaccatcataaagtcaaaaaatcataagtcaaactattgcaagtcagggactatatatatagatattcttttgcatttcattaccttttatataagagagaagaagatataagaatatccacgtatcttctcatttctgcaaaaagaaatgcaggaaggatgaatctaggaactaatatttaattggttacttataggggatggatggaaaaaacgtgaaaagaatggggcaatgggaaatggtaaggagtggcatttctcttaccttagtgtagttttgacttttagaacaacattagtgtttcctgtactcaaaagataaataaacaagccaagcatggtggctcatgcctgtaatccaagcactttgggaggctgaggtgggcagatcacttgaggccaggagttcaagaccagcctggccaacatggcgaaaccctgtctctactaaaaatacaaaaaaattagctgggtgtggtgttgggcacctgtaatcccatctactcgggaggctgaggcacaagaatcactcaaacccaggagatggaggttgtgatgagaccacaccactgcactccagcctgagtgatagggtgagaccctgtctcaaaaaaaaaaaaaagataaataaataaataaaggcagagtatgggtacaacccaaaatggaatgcagacagtaacatataaacctaactgtattacaagtgaataacgtaaccacaatgaagagaatgaggaagaaaataacctaagtaatttgtcttgactgtaatataaatctgaagataaaaagatctctaaacaaatattttacagtaattagtaattttttatcacacaaatatggattagcaattctaaaagtattttatatatattctaggatcaagcaaatatattgtggattttttaacaattgagcacatagtagctgctcaaaaaacatctgttccactaaattgatttttcccaaataggggcttaaggtgctcatgaactccctaaaaaaccatagtaaaaatttttgtgtataggcatctaatgaggatagagctcataacctgtgtcagtcttgaaagagtctgtggcccactgaatgctggggattttcacatcctaactatcctcaaatcccatgggaggtagacattatagtccccattatatagatgagaaagctcagtggtgggtgagggtgattcaggaaggcttaaaggaagagaagcgatttgaggaacaattgaaactgaatcatgatggaaaaaaacaaaaaaacaaaccgccattttcatgaggaagggagcaagataacgtgaacatgagatggctgctgtagaaatcatttgaagaattctccaggagaacaacttttggcaatggttggatcccgtgcacaatggaaggttttgtgccatttccaaatagcttagtccaagtctgatgagttttatactttcatgttcatgtgaactgagaaaaaatttaaaagatcatggatgtgtcactttggttatgtaaggattcgcctgcattataataaaaagccaactggtttttccctttactttctggaaaccagccacttattaatgtttctgcttctagaatctagagattctgtctgttgagcaagaacacatagtagtccctccaaaacataagttctcaggaggaaacagagaccagacctaaagagagctccatgtgttccaggcctgctgcctgatttccaatgagctctcctctcatttcttcttgtcctggacccccaggccaaggctgcttttccttggtgtcctaacctaccaaaaagtatcaagatgatgacgctctttcaagaatttgtgcaatggcttcaccaactagaacatagtgagtagcctggtttccgagatgacatttgcttataccatgttgtgacatgtggctgtttctctcaaagcacttgttgtttacatactatctttaaacaacattatctggcttttacatcccatttgtaactagtattatagtcctattacactggtactaatgaggttttaacattgcctgccactctgtgaggaatattctggagattcctttataggagcagacaacttaaggcctattacaagccaggtaactatatttcctctgcttactttttaatgttgtttcagttggattcaaaatatcagtcccggcctatgtggtttacctccaaaggtctaactgatagaattcatctgcctcctcactgagaaaccctcaaacagtgggcaaaatgtagcattagtccattttgttttcctaaaataaaatttgagatttctccagcatgtcaaggtttttgaaggattgtgccgtaacagagggattttgacagaatgcttaagattgagacccagggatcctgagaaaagctgagcggtcctgatgcaatcagagatgctagtccagtccaacccctggggctggcactgatgacacacttgctggatttctcacccgttttgcagttgtgtgtgtggtgctgtctgtaaagccatgtccatgctcagactgaccaatgtggttccagcctctgcacttgcactccagtagactccagaagcctggtgttgaggactgagtatgattgcagccacaaggcctgagtttgagtcatggccctggttcttacttcctgtataacttaaggctgactatcactcatcaatcccctcatccagagaatgagattgttgccaacctttaccttgttgtgacattattatttctgaggaccaagtaatttatttctgtgaaagcattgattagcagcagtcactatgccagcatttttttcatgatttttttctctaacaaaaccaagaaattcttgtgcacattatcgtagtataacattcatgcatgtttgtctttagagtaaagctgtagtcaggaaccagtgcctagcacaatgtctggcaatactatctgttgactgatcacttcatagcaagcttgttcaacctgtggcccatgggctgcagcacaaattcgtaaactttcttacaatattacgagattttggggggattttttttttatcatcagctatcattagaatattttatgtgtggcccaagacaatttttcttccaatgtggtccagggaagccaaaagattggatgctcctgacttatagtttcatgttctctctttttcatgagtattgaaagcattgcccccttgaacaatcaaaccgtgttaaaacagctaaagcaatattataatctcagaccttatgaaactcctctgatgagaactaatgccttgacctatttcccattcttttttttttttttctttgagatagagtccactctgtcacccaggctggagggcagtggtgtgatcatagctcattgtagcttctaacttccaggttcaagtgaacctcctacctgagcctcctgagtagctgggactacaggcatgctataagcactgtgcctggctactttaaaacattttttagagacagggtctcatgttgcccaggctggtcacaaactcctggcctcaagcagtcctgctgcctcagcttcctgagtacatttttctattcttgaccctagatgatttaaaaaagtaccaatgggtcacttctttgctttacagatgggaaaagagaggcaaaacaagggaaggaatctgcctcatagtcgcccttggagtcaaaggagtctctaacttggtgctttctagtgaaaatgaatgcctcgaaattattccagtgacttttccaacatccttgcacatgtttttctcctttggcctaaagaagagagacagcgtgcttaaatacatgctggctgggggagacagatattcaactaagcttggcactatgcttgtgaatttgctttttcttcttcttgatcacttttctgtgtatttccaggactacagcatgaaggaattttccgggtgtcaggatcccaggtggaagtgaatgacatcaaaaatgcctttgagagaggtaaggaaacagtcttgaagataaaaccaaatatttgccagccccctggggtattggctccaccctttcttctctaagaggtccccagaggtcaggaagccaacttccctgtctcttcagggggtacctgctgtcttgtacacattcccctgtagatatgcagagaaataccagggcacatcccagtttccttcttctttcgtagccctacccatcctgcctctttcacgccgatgatctgccaaaacccaagaagttaactatgatatctgggcggtttatggcttcatccggaacccttggtagcagttaatatcaaggctaatgcgcttgttcattgtagcccatttattattttgtgggctattaaggtaatgggcaagctttggcaatttccgtcactgtaatggatatatatagtgtcaatttgaggttggccctatcattaaatctaattacatctgatatgaaattttccatagggagctctggcatgattgttctgtaagtaggtgttcttggttgcaggccaggagacgtgagagccagtctcaggagctggcctccttggcctcatttttctccccgcaggggctcagtcccagcctggtttcatgattcttgtgagatacagttgctgtgtcccatcctcagcccatagggaatgtccctgagccaggctggcacaagagagtttatattggtggactcatctgccgtgctttggtcctggagcccctgaaatggagcagtctttgctttatctgttccctggtctgtcccactcatggccaccatgccgggcagaaagctgatggattgggaccaggacatgcatggttcaccccttccccacgttcgtcctgtgtgtttttgcctctctcactctctttccttttcgtgggggttgcttatcctcaggagaggaccccctggctggggaccagaacgaccatgacatggattccatagctggtgtcctgaagctttacttccgggggctggaacaccctctcttccccaaggacatctttcatgacctgatggcctgcgtcagtaagtaccattctggcttcagattggcttctgggctacagcaccggtagcaagagagaaaaagtttccacagggtctgtgtgttctcataagcttttcaatgaagtttttcttttccccagtgaaatttctcctcagcctcactccttcatcccctggtgggaggggaggaggaaagacttttcagtaagaatctaggaccccccaagtcagtactcctggcctttttttttttcttctgattcatctctgggctttatctttttttagtaaaatacctttattttcaattatgtatttgaagcttatacattagtgcttgtgcttttcatggtacaagggggaaaagcataagcgttgcaaatatttcatgcttgttgcattaaacaagacatggcttacctgctaaatgtattaatatgtgttctaggaacaaaagccctctgcacatttaaaagtagtaataggatattttcccaaagagaaaggtatattctctgctttatcctcttaggagttctctgcctcttactctaaaatttgggtcttgaaaagctattcctagccatttggtttagcttgtggtactggaacaccctctcatttgtttgccagggaaaacaatcaatggaaacttggattaatacaggtcagcctggaagcaggccctgtctgactgatggctccagaggctggagggagtggtacctttgaatggagaaaagatccttcttcctaggttgaccagatcttcatacctgctgagtttccagtttcactcagtatctgccctgagtacttgtccctctctgttatcctgagaaatgcccagggcatttgggaagctggctctctggtttgttttgttgacttctgtttgtgggagtctagtggaagtgagttatgtgggtgattaagaatgtgattcccttgggtcatgtctttgtctttttccgggactgggcctaggtgaagtatcttaagctgaactggggttgccaagacagttcaatatcccttggctgcccagttcttccctagagatacactcttcttcctaatccagtacttcccatctctttttcatataaaggcactcatagaaaatggcagtgtttacatggcacactgtggaagtgagaggctgcctatgatggaggacctgtaattgacctataattaacctctccacagcacaagaaaacctttcaggtctccttcccaatatcactacatacccaggggcctgctacctcttgcctcaggccactttttactcattcatagtgcagataagggagggagaagataagccacacttgtccagaggatgagatggcatgtgtggagtgagcaggacaggcctcttgcacagcctctcttcccaccgagaagtaggccctttgaggctttgtgttgagcagttacagcaggttggcggcagctccctgtcagtggttgtttgaataagagggtggtagatcctgtggggaacatttctaaccccatttcctgtgcccaaatccaaatccaaacttgttattaataacaatgagattacaacaaccctagttcagtttaatattaataatgtgtaataacgagtttggatttggatttggcacagttccctgtgcccaagaagtatacaccttacatccggcaatggtaaatgtctggagcccagcaggtgccctcttctaacagccctactccaaggagcaacagggatgacactcctgtcactgcaccagtgctgtgcgtgggcttgatctgatgctgtccgtgttgcccctgctggtagtagggacttctgatcattactgcctgggatcccagtcatagtggaggataacacatggctttcttcttttcagcaatggacaacctgcaggagagagctctgcacatccggaaagtcctcctagtcctgcccaaaaccactctgattatcatgagatacctctttgccttcctcaatcagtgagtagccttcccagtgaacagctggatcaggctttggcttgggcactggaagttcctctatggacctatgcctattcatccatcccaacaaaatatttattgagcacctactgtgtgctagccacagtgctagacttatttaatacatcgttaaataaaagatgaaagccttgatataatttagctcctgttccagggaaggaaacagccaataacagatatatcaggtagaataagtgcttagaagaaaaataaaaaagagtaaagagaggggaaagagtaaaggggtctgaatgaaaggagggagaagcactgtagttgaggtggacagcagaggcctgcctgagaagacagtgtacaagcagcagcccagaggaggagaaaagagtgccacggggccatttaaaaccccagagtcatggtaatagcgagtttggatttggatttgggaagcaattagaagattttctttttttttttttgagacggagtcttgctctgtctccaggctggagtacagtggagcgatcttggcttactgcaacctctgcctcctaggttcaagcgattctcctgcctcagcctcctgagtagctgggacccaggcgcatgccaccacgcccagctaatttttgtatttttagtagacatggggtttcaccacgttggccaagatggtcaccatctcttgacctcgtgatgtgcccacctcagcctcccaaagtgctgggattacaggcgtgagccaccgcacccggcatgttactatctgatttgtgtattttatttttttaaaaactgccaactgctttgtggagaagttactggaaagggtcatgaagagaaacagggagaccctatcccaaggttaccatctggtctggccagaggtgttagtggctgagtctggagagcggtgaggaggggtcaggtttgtgatacattttgaacatagcattaacaggatttgcccatggattatacatagaatatggagagagaaatcttaaattgttggcatgagcgacagggacatagggtggtcatttatggagttggagaagacaaggtgtggagaaaggaatcaagacaatgtgttgatgtggtcatggtcatttgaggcacttgtgagatgtccaagtggagattttgaacaattggacctaggaatccaacccttaagggagaaaccaggagtggagctgccagtgcaggagttgcccatgtactggtggtatttagctaatcacccagggaacggatgtgtctacaacaaaggtctgaggagcagagggggccgcgggtgtggatggggcatttcttctcgtccaagcagcatgtccttgtgtggagcaagctttggagtccccacatgacaggaaaggcaccaagcaaggacatgtgattcttcccctctgaggcacctctgtcttttcactttggttttgctgcagtttcgccctcaacagcctagaccaaaggttataaatgggcaccctgagagccagataaagccgaagatgtgttctcttcaggtgtctattgtgtcttgagaacaatgaaatcatacttacatttggggaaatttcactttttaaaaacctagatttctagcttcttttgaaaaattattagatctggtgatactgactctgcagtccctggtggcagcaattccctgtggagtaagggctgtactccctagatggggcaggcactccccaattcaccacagtccccagccctccccgttgtcccccaatcctgaggctgaattcagttgctatttatcatcactcttgttttgtggttttcatagagaacaaaaatgtttctctggatccatgaatctatcagagtaggggaaacaaaaggtaaaccaagggacccaggtgtttttgcacatatttctttgtgaaaatgaggagccttctacaaggttagtctctgcttaaaaggaatacaactttagagaccatttcataagtgtcagcttgcttccaagtttgtggtcaacctggccttataggtatctgggttagtggccccagcttgagaccttttctggggcacccacactatcatgtagcccccttgctggcccttcagagctacagagggtccttgttccccatcttgtctcttccatgcggttgtgtctgctctattcattggccaggccctgactcagcaccaccactgcctttgggttgaacaccccagtgagtcacacagcgtgttcatgtgcagcctggaaactctgctaattactctcgagttagtcccttcagggctaccagtcattgtctcccctcagagaccaatacctgccctcaacatgagcctcgtctgtgcccccagagctgggagcatgacagtggtgagcaaatggggatgaggggaaaacagggagggctgggggactatatgtgacagtacagtggggagaaacaatagaataagcatccatgcagggttgctgcttgcagagatggcagccactattgaagacagcataggaattgcaccaattcaaattattcattttgttttgcttttattgggtttttttctgattgaaacgagattgatttgctcatcaaagtgttaacattaaaaaaatgcagcattaataaagtgttttctaaaataataaatagaatgcaggacacaaatgataaagcagaccacctccacaggaagacagcagctgacaggtgtgcacttccggacaggggtagcaatagttggcaggtagctcccgatgcagactctgcctgggcccagaccatcaggaccctttttcttcattgctgtgagtcctggatgtatgtgtactttatttctggctactgtttgttcttggattggacacattgtcaatctcaaggaaccaaaaaagctaatatctcagtttctgtgggtctggaatccaagtacagcttagcaggggccctctggagaggtaattgcatatcattaaaaagttaaaaatccagaaaagtgcatgctaaaaagtaagtttcccaacaccaatcctggcgccccaaaaagcctctgttcctaaccacaatgctgaacctttttatgaagcacaaaagatgagttcaaatcagttaggagaattcactaataatatgaactgaaactgtagaaatacagtagaactctttgaggacatggcatgagtgactacaagtcgacaccaaaaattttaaagcagagagttgttactaatgttatccattttaggtatttctttgtttttattttgttgttgtttgtttgtttttgtttgtttgtttttgagatggagttttgctcttgtcccccaagctggagtgcaatggcacaatctctgcttacggcaacctctgcctcccaggttcaagcgattctcctgcctcagtctcccgagtagctgggattacaggtgcatacctccacgccagactaatttttttgtatttgtagtagagacagggtttcaccatgttggccaagctggtctcaaactcctgacctcaggtgatccacccacctcgacctcacaaagtgctgggattacaggcatgagcctgtaattacaccgcgcctggcctagatatttctttaaaaataaaaatccagttttttatactcttacactagacacagccttcagggacttcaaagattattaacaccatgacattttacacaaaactgtgtgcatttatatgcgcacatatgtgaatttttctggggagagaatccctagtttttgtcaagttattgaaggaacttgtgtcccctaaatagttaagaaccactgctttaggacaggcgcagtagctcacacctgtaatcccagcacgttgggtggccaaggcgggtggatcacctgaggtcaggagtttgagaccagcctggccaacatggcgaaaccctctctctactaaaaatataaaaattagccaggcgtggtggtgcacgcctgtggtcccagctacttgggaggctgaggcaggagaatcacttgaacccaggaggcagaggcctcagtgagccaagattgtaccactgtaacccagacaggcgactccgtctcaaaaaaaaaaaaaagaaccactgcttcagcccctaaacttagatgttcccactgtatattggaaaagaaaaatggattttcatctgtattttgatgggagcaagaaaatagacctagaatcatgagaccacagtccacaaagatgtgtcctcttcaagctcctggtcattgtagccacctatgaattgaacagttcttaccttagcaggcttcccaacattcttcatcttccacagagctttgactcaggactctcaggactagagtttgtttccctttgaccatcaggcttcccagacactactggttttcttttatgttaccaaaacattgtcagatcactctaaagtatcaaggccttcctcctctttgtccctccatgacaccaggaactggccagccttggattagctacagcttaagcctgcagcacctcatgcctcagttgtttgctctgaggttaccaaggtaattatcctcctgtccctccccagttttaatttgactaggaagtagacttagaaacttcccctagtcttttctaaatctctgctctctttgaactcaggatccggggaaggattatacacttttaagaactcctgtgaagcaatccaatgagatttgtaacctcccccgttgctggcctctcctgcatttgattccaggctctagagaacagtgattctcaactcttttctcccatcacgtccataataccactcttcaagtcctgcagtgattcgcaaacagacagggggtacatctccaggaggggagagaaccactgagtcagagggtaatgggctttgtaatgtgaggctggatgaggggtacactacagaaacaaactctgcaatcagttctgaagaacagctactcagatggagacagctgagtctcaggcctcgtttcccaacagaggacctttggttccttctcagaatcaaatcctgcccatgcctataagggagactcctcagcagagctcacagctctgcaggctgtgttggggaggtatccagagctggcccagccctcaatgcctggacgggcaaggcccaatgggactcatcaggtgcagtggctcattgaaggccttgggtccttggccaaggttggaggtgtggctggaacagctgctggctgagaaggggagagttcccagaataaataaatacccgagaatgaagtcagcctgcatccagaggaagcccgagcagaagccaaatggcatgctgaccttttcctgaaaaaatcctgaatgtaataatatagaaggagattatgaacacgaaaaacaattgcatttgctgttctaggaagaaattcactggcttgatggaatacaaaagctaatcagttggctatttgttaataagtctagaggctagaaaggaatatccctaataatttgattattttgttatgcaagaaggtacacaatgcacagtgcctgtgcctctgaccatatctttaccagggcagcctgagggtccccgtctgccctggcagcttagtatgttggtgtgtagcagccatattcagctctgcagagtgacatgttctcaaggtcatgtggcctttgatagataagatccggggatagggatgaggatggggtggtaagtagaatttgaaatgggagctggaaagagagaagggatcagagctgcaagcaagtacctctagtttgcatttcctgagctcctgaatgaccattctggttgtcagttttctccccagcttactttctggaaagtctctgacacccagaaaggcaggtggcaatttgtggaccttctgcttttgctcttggcagcgcctcctgtgattgtgttttctgggcattcatgcgagagctttccagcttgccccctttcccttctcctccagtttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactggtaggggggcttgggacgggaggaggggagggattcactagcacacactggcatgggagccagatggccacacgaaaaccaaagggaaacacccagatcctcccaactcctcactcccaggctgctagggtctggggatgctataggcagcccccacctcggccccacccacagactaaatgccacttcttgccacctccctttttgatgagttctgagtggcaagggactattctgaaagatattgacaacattaattgtgatactaatctctaagaaaggactttttataaagttgcatctagaagtgatctttattcatcaacagtgtctcttgggcttctactctgtgctctgtattctgagaaaaaccatcctgggtcccagggaattcccttccttttgggaagagtttagataaaaggcataatttcctgaccgtgagtttgtaagctggcacttcagaatgattttagaaatttgtgaagagaaagaagggtaagccttgtttttggcaggttagggacagtcctcccctgaagcagcattccattctgtggggccaggttttccatgacctagcttcggaacagagatctaaaaggaatccctgggatatatgtttgctagacccctctgtttgacaaagaacaaatcactatttctattttatggatgaagtagctgcaacccagaaaggccagtgacagtattttaggccactctagtgatgggaatttaaccccaatctcatctctttgtacagggtacagtccgttaccccatgccacccgccatggtaccatttacagcgtcgttttttcactaaacacaaagacaactgcctctctcttttaatccctaacgtcccttacctccccctcctcctccccctcccttcttcccctaaatagtatttcagcctgagctgaaagcacaagccagcccaaatcggattctgtctgaattcaacatctggaaccaattcggccagccccattgctatcgactgaggtaggggaggacaggggaggttgtttacttaattagaggccaattggtccacgcttctccctgacccccacagaacagcctcttgcccaaggagtgaagaaagtggcatttgtgttctgtgaacttagtaataccagtgacatccctgggttcatccctctctgctgtactgcagatttcagtgtctgggtccaagctggaggaacctatgctggccagctgggagagaaagctttttgtcaccgacagatggttggtggtgactggggaggttgttggtcactttaggtctcagcctactggatgatgagctccagggagctgtccttgtgcatgtgacttagagctttggttttcccccttgcatgagtggtgaaaagctgtagaatagcattcccttccttctaaagtcaggcagaacctccgccctcacttctcaaacatcaaaccactgcaggctctggtccagtgcccggggcacagagacccctacagccctggcccctgagtcccagcccagtgggtcagagtcctggaggggtgtggctcacggggacaggtgccttcctccagtttcctccaagatattctcccaacctaccccctgtttcttgtgcactcaacatttattagcagcctctggaaaaaccacaagattagtcagggaacattactaccgcagactgtgtgggaggctagaagcacctgaggaacaagagtcagcaaccttgggttgagagggaccttctaaccgctggattcacacccacctggaaggctcatggcctctcctctcccttctttgggaagtgagagaagtgccagccccgggagctaaggcagtaaggaggtgagtgagggtggtagaaggggagatagagcactaagaagagaatggagaatgatcaggagacccaaacagccatggaaaggagagcaccaggccacatggcctccccacagctgtggagaggagagacaaatccatttcaccacactttccagtcctgaaactggaaccggttttctaggactaccggctgggtggcatggtggactgctcctgagacctcaggtatttttgggtctggtgggtgcacaagagcaaaggctggggatggagtgtgtttcaagagaatcataggattttagggctagaagagacctcagaaagcatcctcttgcctttctcataaagcagtggttttcaaagtgaggtccctggaccaacagcatctgtgtcacaaaggactggttagaaatgcacgttatttggctccacccagacccagtgacacaggaactctgaagatggggcgctgttttttaacaagccttccatggctcgctgaagtttagaactgttgccttactggctggctgtgtaaataaacttgaagccctgagggaaagtttgcctttgaacctctcccccgccacccccaccatctcaaaggtttccagaacattacaaaattcatcagattcatcagatggtttttagccctagaaaacagtgagaaattgtgcctacattttttgacaaagaggaatctccgtttatattcttctagaatgttctctggagcctgggaaacctccttggaagtgacttgctctacacaggacgagttctgaactggtcacccagtctttgaggaacttcccaggagtgtaggatccatcccatggggaaagaggcttgagggttccaaggtggaaactgtgcggccaggctgccaggctgagtgggtgatggtgctttcacacaactgcctggaaagcctcacctgttactgcctactaccagaggaagaactttagaaatgaacagtttctctacttttcaggaagtaagaacttcctggtgcccatcctcatgagttctgaagtccatgagccaggagatcaggaatagaaatgactttcctagtaacctctctatcatttctcgattccttacactggatgatttttttttttttttttttttttttagacaggatcttgctctgtcacccaggccagagtgcagtggcacgatcatggctcactgcagcctcgacttcccaggcttaaccaatcctcccacctcagcctccagagtagctagaaccacagcatgcacactggcttttttttttttttctttttttgtagagacagggtctcattaagttgcccaggctggtcccaaactcctagactcaaatgatcctcccaaagtcctgggattacaggtgtgagccattgtgcctgacctaccctgaatgattttaaatttcatgaattatttcaagaacttgacccagcttctctcccctgccctccaacccataattggatcctgccctgtagcccatagcagattattcctcccctacttttgtttcccaccctctcctatgactcaccttccactttttcaccagttcacagtctgaactgcaaagcaacctagaggcatcaagcaaaatgagaaagaaggaaagcaagtactatttattaaacacccactctgtgccaaacttgtgactaaattactttattaaatcctcacacagctgaggatatagatctttatcttcagtatatagatgaggcagctgaggcttaaggagattaaataacttgcccaggatcacacagctaccaagtatcagagctggttttcgaatccagttttatctgatgccgaaacccagtgtttcccttccaccctgcttcccctttgaaaaccaggaatgaattcacatagagaatcagaccttgaggagttgagttgttctctattttctaaagaatttagtttataccttcaaaagggcttccctttgtcttgagatattctaagttccaagtagtctcaagtggtttttgtagcaggagctagactggaaaaactctagagctttgtatttcattataagcatttgtctattgtgtgcagttaggatatagagagcataagatggattcagtgccctcgcgccagggaggctgtatgaaggggaagacaagaattgtatgagcacatgttaatgtccctgtcactcttgcttctgttgcagtgatagccctcatggagagactacctcggttgaagactcaacccaggatgtgaccgcagagcaccacacgagcgatgacggtacgaggccctgcttcctggtcagtggggacgccaggggtgaggcagaaggaagcgattatatatcctgtgcatctgatgaacctgtctgcccagcggtcccctgagggcaggcagagagctccctgtctcaatttcatttccttccttccttggagaggtagcccaccttctcaaatagaatcgctcgtattaaaccagaggtgaggaactaggcctttcatagcccttcaaccttcttgctccacctcccagctccttgtctggcctgagtgcagcatgatgttggtcccttatcatagcctagactcctgccagacagctggagaacaaagtgaaggaaagtacatttgaaaaacagtaagcaattgggtgtggtggctcacacctgtaatcccagcactgggaggcccaggcgggaggatcacttgagttcaagaattcaagaccagcctaggcaacacagccagaccctgtctcttaaaaaaaaaaaaaatagcctggcatggtggtgtgcagcatccctgtagtgccagctacttgggaggctgaggtaggaagatcccttaagcccaggagttcaaggctgcaacaagctatgattgtactacagtactccagcctgggtgagagagtgagaccctgtctaaaaaaaaaaaaaaaaaaaaaaaaagtaagcctggggtgggaaatagcagagctggttgcccggaacccaatagaagcaagccagagggagtgggaatgaggatgcagaaaccacatgctttcacgcctaccgactggaaaaactgaccctttccaaagtacagacatgcgagtgccgagcagcctggtgggcgtgcatcaaggggaggaatgctcagctgtcatcctcaggcccctcagcagtgcccatgctttatgagggtctgtccagccagcacatttcccccgcttccaacagctccacacctcctctggatcacatgggctctggaagtctcagcagctgacaaggggcctcagaattttctgggcacaagaatgaaatggcaacagtctgtggagttttccctgttccctgccttgctgggaattctgcaattctaggccagctttcaaaggagaaaaaaaaaaaataggactgcttatttagatcctgatgtcataaggatccatatgatcatttgctacattcgaggaggggagtaggtgaactaggaaaatgagtagtgggttagagcctacctcgtggccagctctgctagagtctttatatatgttatctcttaatctgtagtgaaaaagatatggccgctattttacagttgagaaaatgcaggtcagggaggtcgagtaacgtacccgaggctgtagagaactaactgaggtgggtatatttagacaggccttctctgaccagcctcctatagtgaaatctccaacccctcctgtgcaggagcagacccaccagctagggccatctaggcatggtcttatttttaagcagcctttctctctgcttcccagaatagccgactttcatctcaggttccagctttctgggagccttctctttgctctttgatctctacctgcagcctagcacagacgaagataatgataacaataagtcgtgcacacataccacttactatgggcgggacactgttctaagcacttttacaaattgtaattcattgactcttcataacaacttcatgaaaaagacacgattattaatctccatgttacagatgaggagacagaagcccacacaaaaataaagatagattgcattcgtagaccccttttacttttttagattactttcatgtgcatttttttcataggttggtcacaaaatatattttcatattttgctccttggaaagttgattgggcaagttattttctctttatagagagacagaaagctcacattctacttactagggggaatggataacataaaatatttagaatacatgtatgtattctaaaaaatgtatgatacattttctacaattactggaattattatataattagaaaagaaataatgcttaaaaatatagtatggcaagtttgatgatagacgtcaaggcatgaagatctttggaaacaccaaagaagttactgtagaaagcaggggatgcggtcgggcgcgtggctcacgcctgtaatcccagcactttgggaggccgaggcaggcagatcacgaggtcaggagatcaagaccatcctggctaacatggtgaaaccccgtctattaataatacaaaaaattagctgggcgtggtggcacacgtctgtagtcccagctacttgggaggctgaggcaggagaatcgcgtaaacccgggaggcagaggttgcagtgagccaagatcgagccactgcactccagcctgagcgacagagtaagactccatcccaaaaaaaaaaaaaaaaaaaaaaaaaaagggatgcttgagttgtgttttgatgtgcttcatcaggcagataagagagaagaagattcctggtggagggaacagtgtgagcaaaggcaggtaaaaggtgataccagtgctttcaggataatggtatagtctgcgtgagaattacttgctttatagatcatccatggcttcgttttcccactaagtaatttcctaccactgtaagttcagctaattcagcttttccacccagtttcctgagtctgcaggtcccaagaacatgtgtttacttcttttccacccttctcagaatgtgagcccatcgaggccattgccaagtttgactacgtgggccggacagcccgagagctgtcctttaagaagggagcatccctgctgctttaccagcgggcttccgacgactggtgggaaggccggcacaatggcatcgacggactcatcccccatcagtacatcgtggtccaagacacgtacgttgggcccatggcatctttgggggtggtccccagctgctctatgggaatgagacttcatttctggagccataggactatgagggaggccaacccctcgggggtccagtgcagtcctgaggctcacacagttccttgaagagcagcccccccaccccccgccccactccctgcactcagtggagaatttttttaaatctctccactatctgtgccccctgcaaatcaccccctaatccagtcattttagaaacctgccagccagccagcactcatccatatttatacctgatgagtgataacaaggggtttttatttgaccacctatatttcttttctcgaaagatcaggctgggaaaacatttttgttactctcttttttttttaaacaactatgctcaccccaacctgttgagccactcttccacttgcaaattaaaatgactggttttctaggagaaatccggcttaagcagccttatggaagtgacctagttcatttaaccgagatgaggttgatatagggtaagatgggggaaggagggaaaaggatgtcaaggaacaaaggaaacctgaactggtcccagagagatctcatctgataggctgttggttgattctcacactttgaagcagttgtcccgtgggcccacccaagcctgccccctgtccgtttgccctgtctctgtccccagctcccctcccttggatacgatgctgtcagtgtttttagtccttcccttaatattattttttaaaggttgatatcctgagtgagtctgcaccctcccagcctcttcccggctcgttctgcagggaaatcctccctctgttgatagcatcgcaaacctggtggcaatctgtgcgtggacaggaccctcccaaatttagcattatgacttcaccacaggatcaagagaagatgaattgtgggggagaaggggctttctttgtcatcagtagccagaggggccaggagagcagtggagagacctgggaccggcttggatgctctgagcggggctagaggcgctacgacagtgtgtggcggtgtcctgccacgacgccgccgtctccagagccaccacacagttgactgtccttacccggcagtgctcaggacctcagccgataaaccacaacctggacttgccgcctccttctccaggaggccgccccagcacggcctccccaggaagcagcatggggtagaaggcagatgcctcgaatccaggtgtcccctagccacgctttcctgaggagctgaggagcccgcagaactcagcggattatttatttttatttaaacgacccttcaaaggcccttaggtttccttgcctctgctcacagaactagtccagccaggtgtcgctgctgcctcagagctgtgtggggtcgcgtgtatgtcggggggccatcttgccgatttaacgctgctttttgtgttgttgttgttttccctcctccctgcctgcctgccccttctcccccagcgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaagtaagctctgcttttcattttctgctcccctgaatgacttgcaacacccagcctcaccctctggcctaacccccatctccattcctgtgctgcacgtagggctcccagctcccccagcctaacagtttgcatgtggtcattgctgctgcaaggcggacagggctgaggatgctgctacaagcctcggggcaggtccaggtctccagctagctgccctcgtgctgtggaagggtgctttactgtgtgttcccgcagtgtctgtccacccagacctttgtggcagtcttacagctaaaactttgaccaaagctttggtcactttatgcaacctggttttgtactgtttctcagaggtgccttcttttttccaatccatactcaaataatagtctttgatgtctgtcttccttgacccgtgttcgtgcaaagattcagagtctgtgtgtggcttctactaggctgatgttacaccaggtgggtttattgagatatcatgtgtctgttcctccccctgtcctgcattcactcctgtggaggaaaggaggccacgatgtccctaaggaaagctttgtcctgagctcttcattcattggctaacccctagctcccttttcttctgccctttcacaccaggagaaataattttccattttgttcctattgctttggccttttgtattattctacccccttagtccctttgcagatccccactcctgctcagcaggctcttacctctgacccccagctttcattgtggctgttagcaacatcctggggtttaaactccacccacgcccgatctggctgtctagagggattctacgcctgcgtgctgccgcctccccaagaggcattcaggttattggagaactaatctcatctcaaggggccagacaccaagtcccaaagcctacagacctctttccgccaggccctgaaacctggccccgtgccagcaggatgacaagccccagggcgctcctgatgaatatggattggagatgatgtacagtttttattcccctctggcttttgaggaatgaaatgatttgcactttgaaaacctgttaaccgtagcctctggacactgagactggaaggagaataaaggatgcttgttgtttttaaactataccaggtttcccagatctcttggcttttttccacccagacggtagcagggggagtggttggggcacgtggctcttttccatctctttcaccctcaagttagtaaagtcgtttattcagatcacttactcagtgtagttataatttaattcagaccagttaaaaaaaaattgagaagtttctgtttccctccagcacactgccctgctgggagggcaagccaatatcaagtaactgtgggctaatcacatttttttccttatttacaattctgtgttaaattgtaaccctacaatcaaaaggtcgtgatcctataattaactcagaaaccaaggcggggttggtggaggaagagttagataattagttaagtacatatttttaagccatcatatatttgatgccatttgtgcatagaaattgtagagagtaataactgaaatggtaaacagaagaagaaaaaaaaagagtatctgtagacagttaaggtggttcccttgaactccttgtttgctggtgtcaggagtcttgggatggggttcttggaggacaagcctcatcacctggtgggtgggtgagcggtggccccggggcatgtctggcccttagaagtgagtcggcctttgagtcttacctcctgccccccacgccactcctcctcccaaattccttgagtttcccgagtgcccaggttctctttcgcccctgggcgctcacgcctgctgtctcctcacctggtcacctcctcatctcccttcaagactcagtccgaagacttagctctttggggaagccattctgacatccctgacttccccaggctgagtgaggtgcccttatgctgcattccaaagacactttgaataccttttggtactcacgcttcactcagatcccccaccagattgagctccttgaacccaggaactatatcttccttttctttacatccccagggcctagcctgggacatggcacaccacagccaccccataaatctgtcttctcagcagtttcagcccatgagtcagctatcctcaagcagaaaaaggaaatcagcaaagagctattagggtgtggcacttccatttaattctacacatttattaagtatctactgttgtgccaagcactgctggtgtttattcagagataaaaaagacgaggtccctgatctcagagctcacagtctggcaaggtaaagaccctatggacaggtaactgacaggtagcatcagatgctctgaaggtacagaggagggaggggtccattcttcctgcaactggagttagtggtgcagtggtgccagtgcagttggagttagtggtgccagggaaatccttgcagagagggggttcatttcagcagggccttagaagactctgagaacatcctttttccactcgagagcggctgagtcacaagcctaaaactgccgagtggacagactcacggagtgactgatacatgccaggtcctgggccaggccctgcaggcagaaagatgaggaagacctcagcagtgaacaggactaggactggcttagagcactgtccccacctcacagaccagctccttatcttcagagtctaaccccttccctccttccacctcaactcctgcctcagcccccatctctcttagattcaagatcagagctgttcagcagccatccaaatcagaagtttcattgcctcttagattagaccttttcagatctgattccaagacaaaatgaaattatccagcagcaggcaacacccatgtaactgggattctgccaagccattttgtctgagagccctaagtggtctgaaacaaattcgcccagatccagggttcagcccagtgctgggtgacttgggagtcatgtagaggtatttccacactaagaaaacgcacaaactgggccccaactctgcagtgttgctgcctcttgaaaactattctgctccatgcctacagaataagcaacaacagcctcttgccagagcccaaaacagttacagtctgtttggaaaaagagtcatgctaaaatttagaaaagttaactatcctcttaccagcaatcttgacctctttggtgatggtgagacttcttctcctagctggggccttaggtttctgttcatggcaggtcacagaaggggcctttccatgaatctctttcccattagaaaccttcgcttaatcagacattttttctgacagcaacttacatcttgacaacacaaagcccgtgaccaccaagtaagtatccatttctccttcacccagcttgggggtggcaagggaatgaagacatggagaatgcaagagaagatgaagccgaggagagaacgagttctgtgtccctctccttccgaagtccctgggtgccaacatctgccccctcccacttatcctagcttccttggagccagggctccctgatcacactgccctttctgtttgtgattgaaggcaaaggaagcgtccagaatctgggagcatccggaaaacttttcggagtgacagccatgggctgagcagttccctgactgactcctcctccccaggggtgggggctagctgccgcccatcctcccagcccatcatgagccagagcctccccaaagaagggccagataagtgttccatcagtgggcacgggagcctcaactccatcagccgccactcatccctgaagaatcggctggatagtccacagatccggaagactgccacagcgggaaggtcaaaaagcttcaataaccatcggcccatggaccctgaggtcattgctcaggtaactgtgggctcctggacagacagcatgagtctacattcatcactaccacttagtgccacccacctaattatgacaggacttgaaacagaatgattattttgtatgtgatatactgagtatatgtccactctggacatgtggacccaataagacagcttaataagtggtctgcctgtccctctctccccaggaagaacctaaagacagaataaaagaagcctagcttcttgctcatacactggctattaggaaggctgttgtaatttttaaagccggtattaagagtattttgaaagcccaagttttgagtctaaagaccttggtagactttagtgaaactgcccgactgttgaggatcaggtgtaatcctggccacatgtttatattgctgtgcccatcaccatcatcccgattcctaaggctagtctctggtaccgaatgggtagatgatcaattaagaacctgcacctggttttaaagacctaaaaaatactctggctgcagagagctctggtaaccaaaaggatttgcagcccaagcctccagaggctatggagatgagctccctggttgcagggtcttccttctgtgtatgcaccgcactgatgactctctgttttccatgaaatattagagatccaaccccacctctaaaaatccgactaccggggccactccaagcagttcactcagacgtctctcccaactatataattttcattagaccaggtaggaactaagggcttattgttgccttcttatctcaactgagttgagattctccttaccccatcttccagggggtgatagaggctgggcatggtctctcttggcttaattgtggttctctgcttacggagatgtacctggcaagcccagtattgagctacaggcctgagatgtcttgctttgctagccttctattctgtgcctctatttaagctcttggctgcaatctaccttgcgctacgggaatcctcccagctccctccttggccaggtgttaataggaatgtcaggaaaggtagacagctgggacagactagctgtagagtgcgactgaggagggagatggagttcttcctgagcattttaaaggtttgagaatgtcatagggatgagtgaaactgaatcactgtgaacagaaagcatgcatcggtctgtacgacaaagaaaccttaaccaaaggccttcgcttggaatgtgtaaaatctttccatgtgaacctaatcccaagaagaaatcctgtggtagtttgggggtgccagacacaggtttatggggagggagcggggagctgggaagtctcactggaaggcagctggcttgcatacaaaggttctttggttctgccttgagtccctgggctaggactgctgttggctaaagatctagagtgttccattgatttgcaggcaattgattcacctatgtgggctttggctccccttcctggtcattctttggtccccttggtggtgatggctggaaggaaatggtttcaaattggacactgccctgagttggggaggaggggcggggggaggcgtattgggctcctgaaactttcctcagcccctgaggaggaaggactaaccctcttcacctttggccttgaagtccaagagaataaagatcatacatcatctctaccactttttaaaaaagtgtttattatgtacaatttcaaacctacccaaaagcagacagaactggataacaaatccccatgtactcatcaccaaactcctggccattcttactttgtccgtgtttctcttccccactagattatatgtcacttcgtcgataagtatttcaatatctatctctaaaacctagggtctctaaaaaaatatcaattactttttctaaaggaaaaaaaaaatctcatgacagtgaaaatccctccgtccccctttccctacttcctgagcattcatatgttcaaagatttaggccaagtacaataatctggacatcttacggtcattttcttcatgccttggcctgtgttgttgaaaccggctccttggggaattctcccctcatttgcctcacctcctcctttttcctgttttgcaggatattgaggcaacaatgaactcggccctgaatgagctacgggaactagaacggcagagcagtgtcaaacacacccctgacgtggttctggacaccttggagcccctcaaaacctccccagtggtggcccccacgtcagagccctccagccctctgcacacccagctcctcaaggaccccgagcccgccttccagcgcagcgccagtactgctggggacatcgcctgcgccttccggcctgtcaagtctgtcaagatggctgccccggtcaaaccaccagccacacggcccaagcccactgtcttccccaaaacaaatgccactagccctggtgtcaactcatcaacttccccacagtctactgacaagtcttgtactgtctgagggataataatttaattgttctagacaaggggactatagggactgactgttattaaaatcttcctatttaactagcttggggacttcagttgaaaattaggttctaagttgttcttgcaggaattagcctccccgtctcccaaaaccttgagaatgaagcccttggtatcgcctctcccttcccactgccctctgcttcccccagtcgtcgtaattcagccagctgcagtccgtaccgttcttaggttagccagagacaggttttcattatcaggtcactgtgaaatctggtaaggcagtcctgaggacatgggctcaagtctcagtcccctcagaccacggtgatgccttgaccagatggttggctactgccatccagctttcagtggcatcttgttttgggaactgattatagagaatcatatatagtccagtcttcattttacatacacacacatattttacacacacacacattttacacacacacacacacacacacacatatgtttttctagtctctggcatgtgtagcctctcctggtcatagaccagtctctttgtaagttattgtggcagttcacacagtagccaccaggggtctctgtttccattacaaactttgttctgtctgggccagagaacctagcctttgaaatctctccatcatatgaaacataacgggatgggacaatcccgtaacctgtttggggttgggggctttctctctgtgttctttccattgatgtgaattggtcattggtgtttgctcttgcctctcctccatcccctagaagtacacccccgtcttattaaggagcttttaaagtttttctgaatgtatagacatttctcgggttcctacctttgtctctgatggaccattttccatttaagacattttcctgtataagacagttttatagctggttccttttagggtaaagagtcttaagagagttttattgtgtctatggcaggtttgggaaaggtaagaaatgggtcctttttcctcctaatgtttttggcacttaaaacataaaattcattatcctattaaaaaattaaattcagctttgctaatccagaaattgttcccaaatgaaaacttgttttaagtccaccccttagtttccttattttacaaggtctctcttcagggaccaacaggggcttagagagccttagttagattaaagggagaccctacctcttaaaaccagttttcatttatgcaaacaaggacaattaagggaaccctgaccccacaggctctcaagtcttcccaaggccagaatcgaaagaaaattaaaatttgaatgctgaatattctggctctactctggccttttttctggttcccttccaaaatgcacaaatcatacccttgtctgctccaattcagtctccaaacctggtgcctgtgctcctggcccccctagcatcatgctatcccaggagtatcaggaccagacacatccacagccaggctcatgggtctcagacagcaacttgagttaaagctgaaactcatccttcttctctgtgttttctggtttaaaagctgcacttatattttagccttattattttctgtagttccggagagatggtgggttgccattctggtaggaaaatctgagttttcttatctttgacctagaagagattctttttggaccaacctgcgaaattggtagttaggtctatggaaagtggtaggattttttttttttaatcctgtgcaaaggaaaagaggtgctttgtgggaaatcactaatgagaaggctaacctgcagcaccagagaaacctttccaagtgctaggcaggagaactgaagaactctttcagtgaagtgagtcagcctagaagaggcaacccacagtcttgatttttgttgctgtttcctgacctgttcttgcctgtcacctgggcctacacaggtcccgagccaacggggctttcatacccaaggatctgtttccttgctgaaaatgaaaccctatctttcactttacattcctttcaatccaactgatcaaaactggtacccacacttgccctttctccctctctccagcacactcccctctaagaaagtaaaagcaaagctttcttaatggcaacactttgggcctgttctgttgctcctgccttatttctctttcaaccctgtacatgactcgtgttcaccatccccttgatcagtgtccatccgcgctaatttgcatcatgaactgaacagtgtgtgagtggtcacctactaaacccagctctgggggcagagctgtcttccccatctctggtgctcctaacacctgtgagatggtcctgtcgagaggactaggaaccgataggaggagagtccttctcggcagagctcactgcaaacaactggaattgaggttgcacactgtgatttttacaccgaaaagccaaaaggagctggccatccagggcctagggagaccagccttcctcagctatgcttgccgaaaccagcatgatgcttcaaagagccctgctccacccctcatggcatggatccttttcctggtgtggactctgaagggtcagtcttcggggaagagaggtggggtggggctactagcatcccaatttagaaaacagaggagtttgtagccagcagcctgtaaactggaaacactggtctcagccaacctcctcagggcgccctggcttctccccaaggagatgaggagcggtgatgccagcaccgggatgcgcagagcactggaagggctggtgcagatctacttcccatgcagaagagaagtcacatcttccagggaatcgcaatgttgtggcgtctgacttgtatgtcacatttgtgtaaaatggtatattctttaaaatagtgttgataactggaatattgtatgtatgcttggagatgctttgtgtgaacctaagactgtcactcaacagatgttggattggggaaaatccaaagcacaacttcaaaataaaatacatttttaggtttcgatgctgca

SEQ ID NO: 2063 - DNA, 121585 bp, Homo sapiens; identical to SEQ ID NO: 2062

SEQ ID NO: 2064 - DNA, 113307 bp, Homo sapiens
ggaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaaggtacagagatatttctagtcacagaggttcttgggtggagcaatgacacaatttttaaaatcctattagatattatgttgattacctgggtgacaaaattatctgtacaccagacccccatgacatgcaatttacccatgtaacaaacttgcacatataccccccttgaacctaaaataaaagttggaaagaaaaaataaaagaaagaatatcttattggcccacttcataggctttccactagtcattccctaccacatacttgcggagaaaaaaaatatttgaattggcattcctttcttcctttctgagctgaattaatagtagccttgggaaaggaaccatttgcaaggtataaacccagggctggtactataattcataatctgcatctattaacaaaaactgtgttttgggaagttttcttaaagtgatttgtgaagctgttgagcttaaggggccaacactgtcattttatgttttcctattctagttcatttagcaaactcatatacgtttatgtttttagtttagttttcttcccagggtcttatcttggccaaggtagactcaaaagtgtggttattcttatcgtggtatgtctttgtctttgggtctctgaatgctttcggaactcaattgttatcgtacttccttgggtataggttgaacaatttgacaaaggaaaactcaaaataatcatgataatcttaaggagccaattcaccttacctgtcaacgatggaactagcctcttgaaaatccaggaagctcttttctaagctgtctcagcttgagctcaaagtggaatcatttattcatgaggttgggttacagacagcggtgaaggccccaaccattgtatatgatatgccatgtctaccattcaagcattgacatccccggaagactttccagaaggcaaataatcttcctaaaagttataggtagaaaaagattatagagggctatttagaattcatcagtttccaggtgacaaaatccattattaaaatttgaaagtatgagagaaaagactggtaaacaggattgtagtcgatacagtcaaagctcttgatcagctttccagttctcaggaatttttccagatttcactagatctggaattaataccccattttttttctgtaattaccagcctgatcaaataactgatttggaatcttccatctacctaattgcatccgtgaaggtgctttccctgtgtcttagagacagaatattgagggtacaatcatctgacgacgaaaagaaggcagagaaagataactcctcccagagctcactggcttttattagtagcccggctgtgctgtggttggggccacacctcattttggagtgagggtacttctcaccatctcctccatggtttccagcatcagcttcagcttggttgtcattaatttgaattattctgcaatacttggtgatgcatgtgtgtgactaaaattaaaacctatttaggtgaaattttgacagctcgtctctatgaccttgacagccacttagactatctcaagaaggaaagggcttgactgatagtttcctcctccgttttctttgttcatctgagaaaacaacttttataagatctgttcacctagctagacttcacccagtctctcagctccctttttaccaagccttagaaggttagagaaaaaccaggctagataatttaatagcctctccagatctcagagatgcttatactgaaggcagccagatagcaaagtcacgagtgttcctggctcttcaagtgccctatgcacatttcaccaaaggtaggtacatggcatgtatacaaggtgtggggcatatgacatccatgaagaaaattcgtctgtgaatgatattcctagccatgggctcagggttgacttccttaagccgtgtattactatgctagagcgtgaggaagaacttatttctcataggactgtttatatattacatttcactgaagaaaagtatgcctattataatttaatagctatatgcattttcacaaactgaattcacacttgtgtaaccagcacccagatcaagaaacagaacatttctgtaccctagaaaccccctcatattcccttctagtcatctccccaccctaaatccccaaggataacaactgtcttgacttttaacagcagagattagctttgcttggtttcatactttatataagtagaattgcacagtatgtactcttttttgtttggtttctttcaatattatgtttgtgagatttattcatactgttgtgtatagttgcagatcgtaggaatttctcttgatctttgtaactttggatcaattaaattgtagttgattagagacatgcccagggttgttgaatggccaatgattactatcccacagggtgaataatctcttttctccctcccttggggcattcccatgtaggcagaaaactcttaaattaggagctggttggcagatcataaaaatagattgagccaagcaccatggatcattcctgtaatcccaacaactcaggaggtcaaggtgggaaaatgcttgaggccagaagttcaagaacaacctgggcaacataacaagaccttgtctctaaaaaaattttaaaagttagctgagcatggtggcctgtgcctgtagccacagctacttgggatgctgaggtgggagtattgcatgagcccaggtgtttgaggatgcagtgagccgtgatcatgccactgcactccagcctgggcaacagaacgagaccctgatagtttgaggatgcagtgagctgtaatcatgccactgcactccagcctgggcaacagagagagaccctgatggtttgaggatgcagtgagctgtaatcatgccactgcactccagcctgggcaacagagagagaccctgactcctaaaaaaaaaaaattgattcattctcttttggctgggtaaagagcctctctgctttctagtaatgggcaaacaaacattcttcataccacaccccagttttttaacctcttttgtttagagtgtcgttgcacatgaattagaatcctactggttaagatatagtatcagataagagtcctaaggaatgtcctcagccattctgtagttacatgaatcttcccggggatttgctttgtgctatcagaggagatgccttttccaagtgaccctttctcttgggcctagctctgctcttaactctgagaccttggacaatgacttctttctgtgcctcagttccctaaactttaaaaaaagagtgtggtctatgtgatctccatggtgccttccaaattcaggataccacagttctgtgacgataaggggatcctacactgggggcttccttctggttgttaggttacctttgttaaattgtgataggtaaattgtaatcccacagataaggacaaacaaaagtggatataggtgtggagagggctagcttaagcaaatgaagaccagatttcttgaagaatgaagcattatttcaggtgctgatatctacagtgtcagcaatgaagaaataccaaattgggatccaaatacataaaatagatatgttttaccagtaaatttggttccagtggcaaaaggacccatttctctggggacataggcttagaaaagataccttaatttgtggtatggctgtacacacctgtgctttatgtgaatttgggtctgtttgtcactagcaaaagtcatttttaaaaatctttttttaatctataaaacttaatgattcactgcaaaaattatgataatagaagtcattatattttgaacctctatgtgccaggtattgtgttaagcactttatatgtattatctcctttaatccttaccataattttataaagtagttactattgtcatcatcgctgttttatgaaggaagaaactatggcttaaagagattaagcaggccaggcacagtggctcaagcctgtaatcccagccctttgggaggttgaggtgggaggatcgcttgaagcaaggagttcaagaccagcctgggcaacatagcaagactctgtctctacctccctcccccacttaaaaaaaattagctaggcatggtggtacacacctgtaggcctagctacccaggaggctgagacgggaaggatcacttgagcccagaaatttgaggctgcagtgatctataatcatgccactgtactctagcctgagtaacagagccagaccctgtctgtttaaaaaaaaaaaaacaacaaaaaaacaaaaaacaaaacagagggctgagagcggtggctcacgcctgtaatcgcagcgctttgggaggccaaggtgggcagatcacctgaggtcaggagttcaagaccagcttggccaacatggtgaaaccccgtctctacaaaaacacaaaaattagccaggcaagatggccagtgcctgtaatcccagctactcaagagattgaagcaggagaatctcttgaacccgggaagtggaggttgcagtgagcagagatcatgctgttgcacttcagtctaggcaacagagcaagacttcgtctcagaaaaaaagaagagagagagagattaagaaaaatgaaatgaagctaatgtttaactccagtcacctggctctagaatccaacgttttcatctacatactgtattaggattctctaagtatgttgtacagagaagagaaaatcctggattttctctgtttcattgaattcagatatttcacttagttatagaattaacctaatttttcttttgcacataaaccttcaaagggtatggagatgttgaacatcaacattggattgtttttcctacctggggttggggcaagcagctggaagttgggaatgaaatagggcagcatgtttatactccccaggggcaaaatatctgtgccccctgtaagagggaaacaaggactcattaaatgtgagaattggccccaaatctggctcacagctaatttagctaatttagggatgtcagggtggctgcacaattggcccctctatgctattgaacccccttaagggaggctccttgctagccctctggtttgtggtaatgtctgctggtacatattttacattttgcatgaagccatgttggagattcctttagctaaatataacatctggagaaagtagcctcctgttcacagcttaaaaacagactgactttgtctaggacgagagggaaaattgagcccgtttggtgctcctgacatctcctttcatgtaatgaaagctcagtctgtctaacctctgttggaaccagggtttgggcaaatattattgctgccaccttcatttgtttaatgcggtggcttcaaaaaccatgggcaaaaactgccaagtttgactcccatctccctgtggtctccatgaggggcatgttctaaagaagcccaccaagaacagaaataatttttcccacttgcttagtttaaactgaaataaacttgggtgtgctttttcctacaggagagaggataatcctgttttctctttttacttagctggaacacactaaaagtacctctgactttgctttctcaaatcactgtttctagcccttcacagctgctcacacttaagcttggaagctggtcagttcagacagtgctaaggctcagttgcatccttatttttacagcactgcagtgaactgtactcctgttttgctgttaggactcttaagtttctatggcaaaaatttaggttaaattgaaaaagccaagtcagattccctatagaccagtagctttcaactttgcctgggcatgaaagttacttggggagttttaaaaaaatctttgtgaccttgaataaacaaaggtttcttagaatataaaaagcatgaaccataaaattttataaaggataagtcagacttcatcaagtcttggacttttgttcctagaaagactttatttacaaaatgaaagacaagacgcagactgggagaaaatatttgtaatatgtatctgacatggacttatatcagattatagaataaagaactctgagaactcagtaataagacaaactacccaaatttttaaaaatggaaacaggttttaataaacatttcactaataaaaatatacaaatggctaatcaacacatgaaaatatgctcaatatcatcactcgtgatggaaacgcaagttaaaactgtaagaagatataccatacattcactaggatggttaaaattaaaacatctggcaataccaagtgttaaggaagttggccagaaccctcatatgttgctagtgagagtgtgaaagtggtacaaccactttggaaaatagtggcagtttcttatggcattaaatttgtacttgtcatatgacccagtaattccaggtatttataggcatctacccaagagaaataaaagcatatgtctaaacaaagacttgcacctgaatattcataaagcttttgtgataggctgagtaatgcctccctcaaaaaaaaaaaaaaaagaggtccatattctaacctttggaacctgtgaatgttaccttatgcatgtaatactttgcagatatgactaatttaaggatcttgtgatggggatattatgcttaattagctgggtgggctgtaaatgcaatcacaagtgtcctcataagaaggagattacagataaaagagaggaaggtcatgtgatagaagcagagggaaacagagtcatagagagaggatgctatgccactggctttgaatatggaggaagtggccatgagccagtgaatacagctctagatgctggaaaaggcaaggaaacggattcttcctgagagcctccggagcagaagcagccctgctgactcactggtttcagcccagtgaaattggttttggagttctgacctccagaactctaagagaacaaatgtatgttgttttaagccaccatgtttgcagtaatttgttacagctgccttaggtactttattcataatagcccaaactggaaacaacccaaatgtccatcaacaggtgagtggaaaaacatattgtagtgtatccatatatcaatactactcagcaataagaagggaaatgctgatacaatataaatgagctcaaaaaacattatgttgataaaaagaagccaagcacaatgagtacattctgtatgattctgtttctataaaattttagaaaaaacaaatctgatctatagtgatagagaatagatcattgattgccttggggccaggatggggatgaaggattgactgctaagggacacaagggagtttgtagggtttttatagcctacattatataacattttaaacaatgctttataacatttttataatgttacataatcttgaccatggtggtacattagacagactttatcatattatacacttaaaatgtgtacattttattatgtaaattatgcctcaataaagttgatctaatttaaaaaatactcatgccaagaccctaccccagcatgatttagtcagaatctctggagtagggcctgggtgattgttgcctacagctagggctgagaatcactgctgcactgttttccatcttggggaaactgcagagcacagagaatatctgatgccctaagatcctgtctatctgtatgtgagccatgtttgcctctgcaacagacagtgttaaagcatctaggctagtttctctaggcaacccattgtggtttcctactttattcttggagggtgatgaagggtgaagttagcttcagataaataaatctggtgacaaagggtgaatctggcttccttcacactgcaggaagtggggaatgcaagaagagtgctgaggaaggaatgtaagaggctcagttaatacttttctccagggccttggagatgttaaacatgtccttttgccattagtgaatcagtcacaagagaattgccacaacagtcagatttcttttggcactaaggaaatgaatctggtagttaaaaaggataaatgagatttaaaactaaaagcagtgcatgttacctatctgtttggtatccatttggactgagataggatttcctatggcgtgtcttgagtccagctgtttggcatgtgtgagaagagtggatgatgaaactgtgagagggcattttgggtggtgtgatggtcataaataagaagaggagaagtggtgacccacaatgctggtatagttgaatgtccctggtaagtgctgtggattgaatgaatggaggaaaagaatggttttccaaaggttgtgtccctgtgctctgcccccttaagaaagggtttaactctttgggagaaggagtagatgagtgatttaaccctccctcccttccccgtctaccatatccctcctgctcgtctgaactcagtatctgtgattggactgaatttcctccacattatagcatggtcactaacagcgtttgcacagtgctttacggacagctgttccagttgcccagtttatcttgttggtagcaaaaatctgttctaattaattgagctttattctctcatatctgatgaaaagatcctctttggagaaaagaatagaatgtgaagctgagcttatttgagtaggggatggaaggctgccagctacttcaaaggtatctctgctgataaggggcgtcaggtttgctgccaaagccaacaccgaggggagctttgcagctcgtgctgttgggggtgttttagctttggtttctgtgacactgggtcagcagcatctgtgtgctctcccttgaggctgctctctgggtggtccaggcttttatttagacttcggaaggtgcagctcaaagggaatgtgtgcatcaaagatgtctgtagtcttttgcttaggttagtttgtgtgtttgcctttttggtgttttagttcttaggtatctaccttttctaaaagagctcaaggtgctatatttagaactttcaaaagtataatagtacttcgatttgtataaatcaaaggattattaagggaatctgaagacgaggaatggaatatgggaaatggaatatgggaaagagaggtgcagtagacaaaaaataaaagtgtccatatgcaaccttgtattggaatactaccctaaattaggagattatacagtcaataagtattttagtgaatactgcatgcacagcattatgctgctaggtgcttaaaagagcttgaaaatcaaattgaggagtaagatttgcctcccaagggagcttggggtttttggtttatttaggtctctcaaaactttctgtgggatgatgatgatgacaaagtaataatagtaacctttcgtaaaattcacactgtgaatacctcccactgtagtaggccctagatgtgtattttctctgaacctttcatctatttttgcaaagtttttttcctaaactatttatgaaagtataaaatacttagagaaagtacacatattataaagtgtacagctcaatgaatttttacaaactgaatacagctatgtaatcagcacccagatgaagaaagaatgttactagtatcccatgaaccctccttctctccacttcaagtcattactctctgaagggtaaccattatcctgacttctaacacaatataagtatttgcccatttaaaaatttgtttgtgtaaatggaatcagataatttttttcaacaacttgaatatgtaattcacttgccttctggcctccattatttctgatgagaaatcagctgtggttcttagattcttattattgcttacttgtatgtaatatatcatctttttgtttgtttgtttgtttgttttaaagagatggagtctctgtcccccaggctggagtcctgttgcatgattacagctcactgtagactcaaacttctgtgctcaagcaaacccagtccttccatcttggcctcccaaagtggtgggattacaggcgtgagctgccatgcccagcccttctttatttggctgcttccaatatttattcattatctttggtttttagttctttgattatcataagagtgtaagcgtggttttcattgtattcctttggcttggttaaatataatatccagacaatccctgatctgtcaaatatctaatttgtagaaattgtaggaaaaatatcaattttttcctcaatttgagaaaaatttttggcaaatatttttttctgtcccatctctccttcctgttttgctttgttatcaattgcatgtatgttagactacttgattcagtcccacagcttgttaatattctgtccatttttttcaaatttttgttttctgtatgctttagtttagatgatttctaaagtttaccaatttggctgggcatggtggctcacacctgtaatcccagcactttgggaggccaaggtgggtggatcacttgaggtcaagagtttgagaccagcctggccaacatggtgaaaccccgtctctactaaaaatacaaaaattagctgggcatggtggtacgtgcctgtaatcccagctgctcaggaggctgaggcaggagaatcacttgaacccagaaggtggagtttgcaggaggctgaggcaggagaatcacttgaacccggaaggtggagtttgcaatgagctgagattgtgccactgcactccagcctgggagacagagcaagactccatctcaaaaaataaataaataaataaataaataattaaaacaaccaattctttcttttgttcacctaagatgctataaatgccatccaatgaattttttttatttcagatttttttttttttttttttgagatggagactcactttgtcacccaggttggagtacagtggtgtgatcatagctcaccgtaccctcagactcctgggctcaagtgatcctcccacctcagcttctcatgtgtctgatactacaggtgtgtaccatcatgcttggctaatttttttagagatggggtctcgctgtggtgcccaggctaggcttgaactctggggctcaaatgatccttccccttcagcctcccaattattgtatggatatttttaaaacatagttggcaattacttaaaaatccttgtttgctatttttaacattgacattatctgtgggtctgtttattgattttcctcttgacttttttttacatgcctactaatcttttattgcatattggacatcatagataatatgtcatagaaactctaggtgtacttatcttcctctgaagagtatgaagttttattctaggaggctattaaattactggttgatcaccttgatcttgtgggggcttggctttatacttcattacagtgggtatattttggttttgcccttcgtcttagaaaatactgtataattaaggcatggcctttctggggttttcatgggaagcccaagatgtttatcaagcccctctaacttggcaggctttgaatgccaaattctatcttccttacagtgggcagcacctaagacgaccaactatcctgtttgccttgggctgagggggttcctaggacatgagacttttagtttatctgttcaattgttgatggcatttggatagttttcagtttgaggctattatgtatgttataaataatgctgctatgaacattataatgggaagttattctttccaatgtatggttgaacctggtcacaagccaggctttaagaatagtgaattcaaaaccttttctctctctttctctctctctctccttctctccctcctctgtctctctccctcccccccttccttctcccctctgccttctcttccctctcctttctctcttccttttcctctttccttctccctctccttgtttcctccctcccttccttttctctattcttttgaataatcttttaaattttatagtagatgtatgttatagaaaatttaaaaatacagaaagcaaaaatatgatataaagaacagatttattgtacatactattttgtaatctactgttttagtcaagaccttctcctttacatttcaataaacttttgtctcatctaatacccaggccatgttaaagatttaattaattactcaaaaaatctctttgacaactagtttgtccaagccagtatctaatgcacacagttttatgtcccttaagtgtactttaatctagtattattttctttccatgaaactgatttgttgaaaaggccaagccagatgtcctgcaaaatctcccatcttctagatttgtttggttgtttacttgtgttgttaagcttctgcccgtatcccatatttcctgtaaattggaagttggttctaaaggtccaagtggattcaagtgacttagaatgcataataagtgatgttagtacttcatgtagcatcagagcaggaaatacataacatctagttagtctaccgatagtgatgctaatattggcaccctctagaatagggctgtgatagtctgacccttccattttctagttacattttttaaatcacatgatagaaacctgattgtaaggtgttattcatggtgccagcctacaaatattgggtgccagttcagtcattcgtctgataattttagtatcagttgataattttagacaagttactttttgtcatctttgtacctctcttacttgactataagatgcctctctgaggctgggcacagtggcttatgtctgtaaccccagcactttgggaggcggaggcaggtggatcacctgaggtcaggagtttgagaccagcctgaccaacatgctgaaaccctgtctctactaaaaatacagaaattagccaggcatcgtggtgtattcctgtaatctcagctactcaggaggcttagggaggagaatcgcttgaacctgggaggcagaggttgcagtgagccaagattgtgccattgcactccagcatgggtgacagagcaaaactccgactcaaaaaataaataaataaataaataaaataaaaatgcctcctgagaaaaggagaggattgttaatacagctcatcaggcaccatgcaaatagtagtttgtaaaaacgtattagtcttgggagaaaccacacacacgaatagtgtgcaagctgactaggtgtcaatttgttattattaagaatcacagcaataatttttttaaaaaaagcataattctaaatgaatgctaaccatgcctagggactgtgctaggtgttttacatgtattaacctatttaatctcatcacaacgacactttgagatgagtactggttttatcatccccatttgtagataagagcatgggcaaagggtttaagcaatttactgaagattatacagctggttgatgggagaaatgggattcaagcctaggcagttggcttcccctgatctcttcacatcatcatgctctgctgccttgcatgtaggaaggtggcagtcatattggtaagctaaagaaccagtgcttgtgcagggaattaatgactcatgcattctgcagtcatatgttgctgtgcttctgtcaggtcagaatttccattgtgctattctgattctgcttcttgcccagcttgtccagagagagagtagcacctttgattttagcctcccttgttgcaggacaggcttctgttgactcccctatttatctttgtcaagacttttcctttgaattcctccctgcttgtctgagcatgatttttatttaaagtgaggacaaaatttaagttttcctccttttgacacagcgtcttcagttttttttcattttcatcttctttccttacaatactggactttctctggtcttttagtttttctactagatcctacctttctttgcttttaagcccagcccttggggttttttgttttgttttctttttttttttcctttttctctgttctctacaaatcatttgggtctacatccagcttctcccagcatttactcaatatgaaacttccagttatagattaatttgaattctttgcactaattgtttaaaagaccataggaacctcagaccatccctcttcatggtctcaagagctcccagaatcatcctcttggtaagctaagtagttattagtaaggcccagggacaggactgagaagtaacatcttctattttttatttcagttttcctttaagttggaagcaaacaaacaaaaaacccttcagcttagggttttttcaattgttaaagtaatactgagcttcagttaaggctatgaaagaaaagaaaaaattttaaaaagtagtaacgtgtttttttcaagatattgtgggtaaaaacataataaaaagaaaataataattacttggaatcatgattaacattttgatgtatttccttccaatcttttttatacacatttttttaaaaatgagagttacattatatattaagcttagtgtaatttttttcatttaacatttggagaagcatttttatcatgtcattgcatcttcttttaaatgttgcctatatgatcatacagcagtctgtagtctggctgtcccttaggtttttcatatattccttatggttctttggctatgttgtctttttttttttttttttttttttggagatggagtttctttttttcaggctgaagtacagtggcgtgatcttggctcactgcaacctccgcctcccgggttcaagtgattctcgtgcctcagcctcccgagtagccgggattacaggcgtgggctaccacatccagctaagttttttgtgtttttttagtagaggtggggtttcaccatgttggccagactggtcttgaactcctgaactcaagtgatctgcctgccttggcctcccaaagtgctgggatttcaggcgtgagccaccacgaccagctggctgttgtcttgactctcccctggactatgttcttgtacatctagaagcaattaaaaatctcattgttgtctttttggaaatcacttgtttttaggatgactaggtagccaaggctttcatttggaaataccctacttccatttaatataaggtaaggagagagggtttttccccctgctgctttccctttttcttcctcttctgtcttgctcattgtcttagagcttagctgagaatcagtgctacgcctgagcttgggccctggctggctcagtggagttctttcaccatgctgagtttcactttcctcatctttacactaatgaaattactcataccctcactgttccttctcagaatgctataggcatcagtaaaacctgggaacaaagtgctctgcaaagttatgttatggtcagaaggtatctggttgtgttcatgcagaagagcgtgtgtcttgtgccttcgcccagctagggtggtctttgcaatctctaagctaatctttttttagcggtatattatcatataggctagaaaggaaatacagagaacaaactgggagatccagtctccaactttaatcatctcttctccaaagccaagataatccaagccttctgcccacataagcattgcatcccttcctgccttgcctcttcccatgaccttgtttttcttttgatgttcattttgagggtggagagtagaaaaagcattctctttttgctgctctcagagtcagtggtctttctggacctttaagttctcaggcaaggaaaaccacatagtctacctgagctttcagggactgaaggaaaaaaaaaagtattgctttactcaaattcaggaccacaaataaccactaccaacccattcagttgagtttaataatattattttattgtctgtaattgctcggtattcaagttggcagtataaaaggcctgcagagcaagcttaaaacatggttcaagatcttagatttcttacatctcaggtgaaagacagaccatagactcccaaagcaggttacaatttagatagcaatgtaatgagtcgtacagacaatttgttgtctataggatcttggaaaaaaaacagattcatgaaaagtgagtcaggagagcttcatagaggggaaagaattgggccgatgttcttttaattacctgctgccaggattctcaattagccatctgtttcttatcttacagaaatatcttttgaagatttccatattatctgattccaagttcctttcctgcctctttgtccccattagagatgtcactcatgaggacagtctgacagcagagacttccttttgaccagcaatgggagaaatatgtggaaatagcctgaagcctgagtatagaaggctttgaatgccagtccaaggagttcaaactacaggtcaaagagagccattgacaattttaggcagggcaatgaaatcttgaaaaccatgatttccagtggcattggcagcagtactcagtgtggtttagcatggaagaaactatataggagcctgctacaataattcagagggataatagaaacttggataatgacaatgggaactaaaagaattagatttaccagaaggcagaggaaagacattatagacaggactgagtggcctgacatgaggtgggaggaggtcattcaacttagtcattcagcagttcacttagtcattcagcagatatttacagtgtgcctcccatgttccaggcactgtgctaggcactggaatatagcagataacaaaaagttcttgccttcatggagcttatattctaatagttgaaacagataatacataaaaaagtaaatatataatatatcagatgatgataaaatgaaacagggcaaagaggatggggtacaagggatattgctctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgatattgctcttttatatagggtggtcagagacggcttcactgataaattggcattggaactgattcttggaggaaatgagggattttgctgtttagctctttgaggaaggtatttcaggcagagataatagtgcacatctaaggccatgagatgggaatgcgcttatctggtttgagaaacagtaaggagaccttgtacagagtaggcaagaggaagagtggtgggagatgtggtctggggcagcgagcaggtttcttcaggaagggccttggaggctactggaggactggagaggcatgatacagtctgacttctgtttaaatgggattattccagcttctgtgtgaagagagtgctttaggaggagtagggtggaagcagcaagggaagaccaattaagggagcttctataaataattagggcaggaaatcatagtggattgaaacagggtggagctgtggagatggtgagaagtggtcaaattctgggatatattttgaagatggagccaataggatttgctgcttgattgatatggtgtatgaaaaaaatagcagtcgaagatgaccccaagcattctggcctgaacaattcgaagttggaattgccatttattgagggaagtgtgtggaagagccactgattctagtcaagccctgtaattcatgaagaatctgagagccaatgagaagtaacttgccttagtttacccagttaggtagtagttgagatgtgactgaaactaccaggtcttctaaattctactcactgctctgtccagtacataccatatttctgacttcagctttagacatggtaaagggaaggtttagtgagggcaagagctagaagaagacttgaaaattaaccacacaaaagaccagttgaggtcatgaaagggtattcagagtaaagggtagttgaggcctagaaagaagactttgaagagctagcaaagaagagagaagaacaaattaaaatgggcaaaaggaaaatgagagtaatatggctcaaaggacttaagagagaagaagactcaatgatgagttctacgaaggggtcaggaagaatgggaactgaacaaatgtcattagatttgggttttagaatcttgggaaactgtggtgcctacaacttaacctcctttaaaattttaagcacttttcttgccgtttcagctaataaggagaaggaatataacagggtaagcctgagacagagaattaaaaacaaatttacttccaactcctgcattaccttcttgtgaatcctacacaagaatttgactttcccagactcccatatgcccatctataaactgaacaagaagcatacttcttgcccactttgcctcctggagatcctgtgaggataacaatgacaaaggataggaaactgctttggaagagaaatgctacataaatcaagatatccttttctagctgactttaagtttttaatttaagaaaaattcttgaaagagtcacaaaaaactttagagatacactaaatgcaggacgtgttgactgataaaatagatattcttcttggaaacaatggaaaatacttcagtatcattttgattaaatcttgcttaataactgttcattagactcatatcaaatcctgtcttggctttgttatttaatttaatttaattttgtagtcattgttacccaaccacaaaagaattacccctgtgcttaaggccacacagatttttcaaacattgatatatcagcattggtccttctgatgaaacacaagatgaggttttccctgctgagtgtcaggcagtctgtctcaagctgcaggctgaagccccagtggaatctaattccatccttccagtccccttcatacgaagagtgggaaatagtgggaatggaaattaattgtacctgctggcattattaaagttatcagtgcgtatcccctcttgggccaggaagattaaaaaggctgttgtaatcagagcacatgatttctgacacactggatgggcttcctccccaggttagatgtaaggaagtgatctgagcttgttgcctctggcctgataccacatagctcggggctatgcagtgtctgcctcatcctcccatcagccctggaggaaagccaggatcctgctctctgaatcagagatctcttagttggaaaatcaggccttctcacttaagactagtgtattctggctgcgcattcctcacaagatgtagtcaggttaggttagaccttagagtcacaccttgttcaggttcaacctgagtgaaataaggaattgaggtgctgctccctggtgattcagctcattttagcaagtgtttattaaatgctttccccaagcaccacaccaggcccagacaattctgcctgtacacatcctgtggtatttgttggttggaggaaagaggctcttgtagtttatgaattaaagaaaaaaaattcctgatctgggaatgagaatcttatcctacgtttcacactgactcacagcctaactttgactgtgaatgccgcctaactttgtaacctgtctaggacttagttttctaatctgtaagataatggtttggactaatctctctaagatttatctctgaaattctgtaattaagtgagggaatttctatgaaagtgcttggcaaaccattgggctattatgatagttctaagtggaaacagtatgtttcctcaatacacagtgaattgagttctgactctctggggcagatagatttctgactttctgggccatgtgttgagaatatgaagatggctgatgtggcccctgatattgaatacagtgtctagtgggagaaatagacatgcacataagctatgatgatacagtgtaataatgggttcttgggtggagggaaatatgaggtgaggtttgccttatgatgtcctttgtatcttaggaagaatgggagtgtaggagaggggagcataggggatttctgggagataaaaccatttatgcagaaagcaaggaagtataatagatgaaaagcgttccggaactacaggtggtgtgggtgaggatggctgcacacaggtcccttgtaggggagtggcaagcgatgaggctgaggaggtgggcagggccttgcctgccacatcaaagggcttataccctgaagccagtgaagcagaagcccctgtaatgttattgttttaacttcttattttgagataatttcagacttaaagaaagattgcaaagtagtccagaaattcctctgtacccttaacccaaattccccaaatgttaaaatcccatctttccaatatttgggggcgagatttttaaaaaatctcgtataagcacagtacaatgatcaaaatcaggaaattaacacggaggtaatactataatctctcaatcttactgaaatttcacttgttgccttgctaatgtccaattcaaatttctggttcagggttcagtttaggatcacacatgatgtcgaggtgaactgtcatcttagtatcctctaatctctgacagttcctctgtcttgctttgtctttcatggttttaaagagttctggtcagttattttgtagaatgttcctcaattttggtttgtttggtttcctcatggttggattcagtttaagcaattttggcaagaacaccgtagaagcgatgtcatatttttcttagtgcgttatatcaggaggcacttgccgttgatttgtccccattactgacggtgataattttaattactcggtgaggatgggtgtcccctttacagtgtaataaatgtcttgtgaagatactatgtaaatatcctatttctcctcatcttttgcttactaatttttagcatgcttgttaactgaaacaatcctactagcggattttaccaagagagtgccatggacagatttgccttttagaaagattactctgaaatgtttggatgtgagagagatgtgagaacagggaaaaagttactacagtagttcattcaagagcggggccctgatctaaggcagtgagaggaggagtagagaagacagaagagccatttaggctatgtttggaatcaataagcagggtttacattttgtgctatagatttaaatgctggaaaaattctgaaatggggggaaatatcacattttttatagattaacaggcatctatataacctctgggttgctcttcttttttttttttttttttttgagatggagttttgctcttgttgcccaggctggagtgcagtgcgcgatcttgactcactgtaatccccgcctcccaggttcaagtgattctcttgcctcagcctcccgagtagctgggattatagtatgtgccaccatgcctggctaatttttgtatatttagtagagacaggttttcactatgttggccaggctagtctcgaactcttgacctcaggtgatccacccgcctcggcctcccaaactgctgagattacaggcataagccactgcacccggccctgggttgctcttctaagaatagctgactttattaaacatattgtaggtttcattaaatgatgtttcacaaggtgttgcttctcctggaccaaattcctgttgttcagctgagagctatttctaatctccagtgtggatgtgctcatcatttggttataggatgtgagcaaatgagatggtgttctgcgtagcccagaggctgcttccattagccctttcccgaaacttttgccactttcaggcttagcagtatcctctcttgggttcagaatgcctgctctttgccctaatacaaaacctagagctgtaggccatgttcttatgatttgacagtatcagggaagcatttcttattgacttttccagagaaagagagaaaataagcaagccggcaacaagacagaggggaaaagggaagtggctcagttcttactttaagaaacaacatggaagatatgtttgttgatttgagggtggtgaatttttgcactatagctttgtgagggagctggaaagagcctttcagtttttcatgactgggagtttaatttggtttataacattacttaaagataactttgaaattggtctaagaacttagggttgttcctgaccccaggtcaatggcctacttgacctaggcgagaggagaaagagttaaggatagggagttgagctttttgctccaaaatctatagagggtacacccctcttatattctggagtcttactgggtttctgaaaatgcccttgtgggtcatgaaacaatagtcctttgaatatttttctgccgctgctgatgtgagctgcttaaactggcaggcagatgatggaaggaatggttacatgtcccaggcgggaggtcatgacagttggatctgtggttgacagaagaatttcaacacacattcaaatcagctcctaagatagattgtctgagttccctgggcctgcctcatgccctcctcaaatgcatttgactccttctggcccgtaatactcacacttcaaatgtttggcttggcgtccacaaatcaactcagggccggggtaggggtactgatgagcagtgatgccctctttgggagctaccacagcataggaaatgaacattagaccaggaatcaggtaacctggttggggacccagggctctagatggtttatttttttattttccttattggttaaattccctaccgcagttttgacattctcttctggatactgactgtggtctagagaaacagctaaggaaggcaaatctgaattaaaatctggttcttgggaaagaactgaagttttcagattttgcaaaattatggagagtgcagactaggagaaaaaggacaggcatagttgtgacaaggagctcttttttctagttctgcattctagaaacagtactgatgagtccaaaaatatagagataaaatttgtcttttttcttgctttaaaaaagaaatgcttctaaatgtctacatacttgcctaagaaaatatttctcaactcctccagaatatttagggttaactaaaaattataaaaacataccacagagctagtccactctttatgcctagggtttacccaaaaggtgtgcatgctctggcttggagaccctgaccccatctcaacttgctggtttcaagtctacatatttggctgcaaagccctaatgccaggaggaatgcggaactgatgagtccaccccatctacaagctagaaggacatcttgattaaattagtgtcaaggggggtggagagaaaggcacagtgacacaaagggtgttttgaggagccctgtagcgcctgtggagaatgaatgttctcgttaaatatggccgtgacctgcagctccacacatgccagagacacagctcaattgtccccaggatttggggggtggggacgatcatggggagaggacagcctggcatggaaaggcaggaatgcaggaaggcctgttgttgttttctttttgcgataactacagcaagcaattctttgatcatggtccttgtgtttgtgtttggaagggatcaagaagcgatttcctttcccctgggtgtttgaacctttgctctgctccttgcttctctgggtattaaggggactcctgaaagcccccattgtcttcagcctctttccacccccttccttggggctccccaagaagattgttgcctgaactctgtagggcaagaatgagaagcagtgcccccaagacagtgcctacccttgtcatttacccaccatcctcatctcatttatccttaagtcccaagaccaaagcaaagaacacatgggctgttgaaggcttccacaggactgccctggtcagtgggaaagcagtaatgctttctagctgggtaaccccttggctgagttccatctgcactgtggccagggtgcgtggtgagacatgcttttgccatttgccctttgaactgccaacaatcccaatgtagcaaatggatttaaagctgattgagttttagatttctttcctttaaccagaatattctagcagcttatttttatagttctgcttatatgattctctttttaacagatggaatcacaaccttttctgcagtatatatctgatgaatttaaaaactgatacatcaagaatattcttttgtatatgtctttcttgctgtgaaaatttatggcctttcttccccctatcttcgctctgtaattattaggtgcttactatatgcaaggtattgtataagattaggagaatacagataagacaaaatagcattgaaggagtttatgagttcaattccaacttcaccaattaatagttgttctcatggacaaattttttgacctctctaagctttagcgtctgtaagtactaagtgctttttgtgcagagagatgtagagaggtgaaatttgagctgggtttttagtgaatgaaaatgatttcagtaattaaagatgaaaaagtacggagtttgtgagcatggagggggagctggagtcaaaggatattccatatggaagaacaggcttcaggatgaaggagagcaccggaatgtgtgaggactcttcagagggtggtgagtaaaaatagtttggctaaatcagagtgttaatgaggagagcagcttgaaacaaagccgaaaagagcctcgaatgccaaacttggagtttgaacttcattctgagagcactagggaacgatggaagacctactcatagggaaatgataaaatattgctgctatttccgaaagactgggcctctaattccaggacagggtaataagagcctgagatgtggtagcagtgacaggaggaatgaaaagaaggagacagatgccagacatatcatgaaggagaaatgaacagcgtatggccacttattggaaagagaattcgaagtcagcgattacttctttcaatttttttatgctagtgccacttaggaaaagccagtgtgctgttacagaatttgaggtggctggtgaagctgacattttcacatatgtctcaggaactagatgcccaaatctttctcagaccccagatggccccatatagagcttttatacgtgccaatttttagaatttcttgtagagttcctccatttggtggtcaccagaggatctctgagattagtatctggattcttaatcattcagctaatttcagagatgtcctttatttgaggtagatttaacctcctttttctgtttgatggagtgtggtttttgaaaagtccctaaggaagtaacgtgaaaccatacttgaaacctcaggcttgcttctctcttgttttaccagaatgctttggttaccacgtcctgggaaatgaacaacttaaaacgtaagtgtggcaagccttcactatcaccagtatctgttcattgtatcaaacaaagcatatttccattcttattaggtttccagaattgcactgggcctggtgagggctacaaataaacataagataatctgttttcaaaatttaaacttagagttgtgcttctagaaatggaagcttttctagaagaaaattcagaccaatccttttgcttcatgggagctgctttccttgaagaggcttctgccattttagaaaatattactgagtgtcaaaaagctgagcagagtgtttaatagacttgtagggctagcaggacaaatatgggaatttaaggcccaggggcccaggatgggtagccttggtaaaattccccaggctttgagacaccaaagggatacaattaagaaggaaagataagccagaaatagactaaggcagtttcatagagactgaagcctggattcaaattatcttaacctctaattggattaaggtgatttaggatagccagtggctagaaacaaatttaaatcctctctagaggaagatactgtggaagatactatcatcctagacctaatatatctctcatcatttttcatcatgatgtttggcactcagttataaataattaggcctatgaggaaataagaactgtgaccaaaagctaagagaaacagctagacccacaggagatcctagtaatggtgttaacagatgcaaactttaaattaactatgtttaatatgtttatgaaattaaattataaaaacaaacctggaaataataaaaaaaattaactcaaaatggatcaaaggcataaatgcaagagccaaaactataaaactcttagaagaaaatataggtgtaagtcttcgtgatcttggattaggcaatgatttcttacatatgacaccaaagcacaagcgacaaaagaaaaaataaataaattgaacttcatcaaagtcagaaacctctgtgtttgagaggacactgtcaagaaaatgaaaagacagctatagaatgagaaaaggtattttcaaatcatatatctcatcaaggtctaattttcagaatatataaagaattcttagaactcagcaacaaaaagatgaccagtccagtttaaaaatgggcaaaagacttgaataggcatttctccacagaagttacacaaatggccaacaagcacatttttgacactgttatttattgggctactgcaaatcaaaaccacaatgaaacaccacttcacacccactaggatagctataattttaaaaaggaagaaagaaaaggaaagaagagttttggagagggtatggaggaatcagaaccctcatacattgctggtaagattgtgaaatggtgcagatgctatggaaaactgaaaattcctccaaaacttaagcatagaattaacctgtgacccatcaattccacatctaggtgtatacccaagagaattgaaaacatatgctcacacaagaacttatacacaaatgttcataacagcattattcaaaataaccaggctgggcacggtggctcacgcctgtaatcccagcactttgggaggctgaggtgggcagatcacgaggtccggagatcgagaccatcctggctaacatggtgaaaccctgcctctactaaaaatacaaaaaaattggccaggcgtgatggcaggcacctgtggtcccagctactggggaagctgaggcaggagaatggcgtgaacccaggaggcggagcttgcagtgagcagagatcgcaccactgcactccagcctgggcgacagagcgagactccatctcaaaataaataaataaataaataaataaataaccaaaaagtggaagcaacccaaatgttaatgaagtgatttatggaacaaacttaaagtatggcatacctatacaatttaaacaaaatgtgtcatgtccatacaatagagtagtatttagtcataaaaaagaaggaagtgctgatacatgctacaatatggatataccctgaaaacattgtaagtgaaagaagctaaacataaaaggccacatattatatgattccatttatagtaaatgtccagagtatgcaaatctatagagacagaaagtagattagtggttgctaggagctgggggaaggagagatggggagtgactactaacaggtttgagttttcttttggcatgattaaatattcgggacttagtggtggtggttgtacaaccttgcaaatatactaatagccactgaattgtgtaccctgtagtggtgaattgtacagtgtgtgaattatatctcaataatttaaaaaaatcaaacaaattttagtacaaaaaatgcagtaactaaaagagctcaatgtgtagatcaagtagcagattagatggtgctgaataaatagttaatgaactgaaacgtcagaaaacaatgcatactgaagctcagagagataaacagatggaaaatacagaaaagagcataagagacttatgggatagggtaagtaggcctaacatgcttctacttgaagtctcagaagaagagaacaaagagaatgggatagaagcaatatttgaagagataatggctgtgaatttccctaaactataaaagacttcaagccacagactgaagcattatgagccccaaacaggagaaatacaaagaaaatacaaacagctagaggtaaaaaagacgtattatcttcagtggagcaacagcatggttgacagctgacttctgaacaaaagcaatggaaagcagatgacagtggaatgaaagtgtagaaaggaatacccttcaaaaatgaaggtgaactaaagatgttttcagacaagaaaaatatgagaaaatatatcgccagcagacttgcactaaaagaaatactaaatggcattatttaggcagaaggaaaatgatcccaaatagaatcttagaagtgcagtaaagaatgaggagcaacagaaactatatataagaatatagattggccgggcacggtggctcatgcctgtaatcccagcactttgggaggccgagacgggcagatcacgaggtcaggagattgagaccatcctggataacatggtgaaaccccatctctactaaaaatacaaaaaaattagccaggcatagtggcgggcacctggagtcccagctacttgggaggctgaggcaggagaatggcgtgaatccgggaggcagagcttgcagtgagacgagatcatgccactacactccagcctgggcaactgagtgagactccgtctccaaaaaaaagaaaaaagaaaaaaaatatagatctaagtgaataatcactgttaaaaacaacactaataatcatctgtggggttttccttttttagatgtgtgggtgggagggacagagtcttgctctgctgcccagcctggactgcggtggcacaattatagctcactgcagccttgaactcctgggctcaaatgatcctcccacctcagcgtcccaagtataacagctgggacaagaggtgtgtgccaccatgcctggcttattttttattttttgtaaagagagggtctatctgttgcccagcctggtcttgaactcctggcttcaagtgatcttcctgccttggacttccaaagtgctgcggttacaggcatgagccaccacaccaggccaaccctgtggggttttaaatatgtataaaattaatataaatggcaacaatgaaatcaacaatagaatctgtgtctgggtgggggtagggaaatgggtttaaagatattttcagaaagtggtaaaagtagtaatttgtattaggtgttggcaattcaaggatatatgttgtaatttttggtaaccactcaaagaatagtattgtaccaatctaagaaagggacaaattcagttaataaaaaagtaactcaaaagaaggaaagaaaaattctggggagggcaaaactatagagatacagaacaaatcaatggcttccagtggttaagggtagcggagagtttgactctaaaggtgcaggatacaagaggtttttggtgggtgatggaactgttctgtgtcttaattgtggtgatggttagacaactctgtgcatttgccaaagcacatggaactgtatgccaacaagagtgaattttctgaatgttttgtaaatggaagaaaaaaagaaggtaggaaaggagaggaaagaggaaaatagaagaggcaggacaaatagaaagcaattagcaagttggtgggtttaaaccataatataaggtgtaaattgacttatgcaaattaaagacagatttttaaaaagcaaaactagagtgtatgttgcttgtaagagaacagatacactttaaatataaggataaagaaagatttaaagcaaagtgataggaaaagatagctacaataaaatcaggccaggtagattcctttctttctttctctctcctttctttctttctttctttctttctttctttctttctttctttctttctttctttctttctttctttcctttctttctttctttctttctttctttctttctttctttctttctttctttctttcttttctttctctctctctctctttctctctctctctctgcccccccacttctttctttctgtcctttttttttcttttttttttttttttttctgagtcttgctctgtcacccaggctggagggcagtagtgcaatctcagctcactgcaacctctgcctcccgggttcaagcagttctcccgcctcagcctcccagatagctgggattacaggcatgcgccaccatgcccagctaatttttgtatttttagtagagacagcgtttcaccatgtcagccaggctggtctcaaactcctgacctcaagtgatctgcccacctgggcctcaaaaggtgctaggattacaagcctgagccaccgtgcccaggcagtccaggtagatttcaatgcaaaaagtatttttcgttataaagagagacatttccaggctgggcatggtggctcactcctgtaatcacagcactttcggaggccgaggcaggcagatcacttgaggtcaggagttcgagatcatcccggccaaaatagtgaaactctgtctttactaaaatacaaaaaattatccaggcatggtggtgaacacctgtagtcccagctacttgggaggctgaggcaggggaatcacttgaacccaggaggcggaggttgcagtgagccgagatggcgccactgcactccagcctggtgatagagcgagactctgtctcaaaaaagaagagagagagacatttcctagtaaagactaagtttccaggaagaaatatatacttaataacataggcttaaaatatgtaaatcaaatgggacagaattaaaatgggaactagataaatcatcaccccaatgagagatttaacacacctgtctcagtgaatgattaaacaactagaccaaaaaagtcagtaaaaatacagaagagttgaaaaacaacaaacttgacctaaatgacatatatggatactgcgcctgacaactgcgggtagatacacattctttttttttttttttttttttttttgagacggagtttcgctctgtcacccaggctggagtgcagtggtgggatttcggctcactgcaagctccgcctcccgggttcacgccattctcctgcctcagcctcccgaatagctgggactacaggcgcccgccactacgcccggctaactttttttttgtatttttagtagagatggggtttcaccttggtctcgatctcctgacctcgtgatccgcccgcttcggcctcccaaagtgctgggattacaggcgtgagccaccgcgcccggccagatacacattcttttcaagtgtacgtggaacatttacaaagtttaaacctgaaatggggaggaaaaatcgaagagcttaggggagaaattagagctggagattggaaatctccatttccaaagtctaccttctttttctcacaattccatgatttttcagtaggagtggggtactggccaagagggaaggtatcctcccccaagaatattgatttttcttttttcaactgtatgtaggccatgactaatgggaatggctacccatgtgtttactgtggacaaagacaagaggcttcaaaccaccattgtagctgaagaaagctgatacaggctcaaatcttcatcccagtccctaggcaatgcattctaatttctgtcagtaaagggctctactcattctcccaaagttggctttgtgctcctcttaggtccaaccctggcacctgaggtgtcaagaaaatgctgtcttcataactcactggagcctcttcctctcgattctaaaggctactcccagtgttctaaaactacacagatctctcgatgaattggctttgctgctgggttcctctttcttaaaagtatttaatcagcgattttcccagtgccccaggcatttcctgtacgagtgctgctgactgttttacttcctaccaggctgccctcctcctcttggcattcacacttccaactttcagatgagctctattaactcctgttcttccagcctccgcctggctcagccatctgggagccacacaggcattctttccatcccccagctcatagatttccttattgtagaagggcatatgttttcaagtaccttatcattctggctctttcccccgattctctcccagttccaagccattgattgtttttcctccttagttcattttacagctgctgagagatttgtgctctcgtgctgcctgtttgcttttgtgtcttttgtcccttatgtcccagtctactcaaggatacccacagtcacctagataccatttctactctgtgcttttagtgtcctgcttgggaaatggggtgatcactcatcttcagaatgacctcaagaaatgctttggcatgagagatcagggcctgaagacattacgcccccactcaaatcattatccaaaagggtaaaagatggaaatttgccaagacaaagatcacagtggtagtttaagaaatgaaagcttagatttgattgtctgttttgttttaagggatgttgttttgagtttattttcttagtattaggataggtcattcaaagagattggaacaaccatggaagaacattcagattattataggactgtgtttcagactgggagagcagagggccgttagcctcttcctgaccccaccctgaactcccctgaactcccacccttgtcccgagtatgcctgtccctgacaagagactttggtcagggaccaaagtgagctttgttagtgagcattcacagagggtaggagctgagtccacaaagttcacatcatgccaaggaatggatttcctcccagggccactagcattacttgtgggttatcaagtgttactgctcacacattccagagcttctggaaaagccgtaaggaaatggctttcagaaagccatttctgtcctagaggagagaggtcctggatttcactgaaccagaacttgatgggtggttttggtattctgtgacctaggtagtggggagctccttcctttggatgtttcctttatgcccacagtcgaaccatatcctagttgtacagccaagaaggatcttttctgtttaatctatctggaggaatagaaggtaattgtatcctccttattttcattctgccacccctaccttcatcatttcttcctttctgctaagcactttttatcgtctttctttgtttcgttttgggagttttgtttttttgttttctttcctcaggaaagctgaattatttcttacagagtcatttagttcttactgaaactggggaagaaaaagattatgcaacagcaggcataaggaaaaacagagaacgttcttcccttcgggcccacagagcccattggaggaattcagctacaatcctgcctgggaagtagtttccaggaccttcgcaattccacatagcatctttaacatgtttgagagtacgtaaggaggcagcatagtgcggcggaaagaacactcaagtgagtgttgagggggctggattctaatattaatattagccaacatttattgaacaggctaggtgctagattctgtttaaagcactttatgtggattatctcactattcttattatcctattttacagatgtggaagctgaagcatagagggtttaaatataatttacccaaggtcatcaattggggagtagaagtaggattcaattcctgctccagagcctgcatgttcagctctcttttaatactgcatgtggtccttgataggctactgaccctggaaaagtcatttcaacttttagggctcattggtgaaccataaccaaagggagctcattgtggctaacctctgatggagtttccacttttaataatttatatgatgaaacgcagctatattgtttagttcttgtcattatgtgaaagcatagtatttaaactttgatctcattgattcagcaactgattattttatggccactgtgcacaaagcaatgggctgggtaccacagaggattcagaaaaatgcttaaaaagttaaaacctatctcttccattagctttagatggtttcatattgtagttgctttgagatttttttagactaagtttttcagataattaaacaggaatcaaattcaaaaactattcatattccagaagaggaatcctgaaacaagtattgggccttagactagtcaagtttctgacattttcttttaaaatataacttgtcactaggatagtttatatccattaactcctgagtgaaggagcttctggtgaaattgttttttatggtgcttacaagctcaaggggttctttaaaaatggaatgtgactgctttgggagtcactaatactgaagctggatcattataacctgaaatatccattagtaacttagaaagacaaactcaaagaaaaataatttactgtgtaatagctggattttttgaaatcagatttttttttttttttttttggcaagctagattcaatatctagcttgctgtggaattaggttatggtgtggaaacctcttggctgggacaggaaaaaaaattgatcttaaactaaaaaaactaacttaagatattccatttctagtaatacctttgagattggaagaattgcattctgatgggcccagacgttagattaatgtccatctttctcaacaggttgtaaacttttaaactttctgttttgcattcagaccacaagtgcctgacacttaatagatgttctataaatatttgctgatggactctttattgctcactccctaaaatccagccatttctcccttgccagcattcaataattgaacctgctttgaaacatctgatcagccacttcaagacggcaagttattttagctcctgtctaaataagttagtgggctccagtccttaaaccactattttctttattaattcctcaagtacagacttttgtatgtaaccagtctttttaaacctgtgtataatgactcattaatgagttgtaaaataaatgtagtgagttatgaccaatataaaaaaatagaaaaggccaggcacagtcgctcgagaatataatcccagctactctaagaggctgaggtggagggatctttaggccaggagtttgagaccagcctggggaaacatcacgagactccatatctgaaaacaatttttttaaaaattagccaagcatgcctgttaccagctacttgggaagctgaggcaggaggattgtttgaagccaggagtttgagaccagcctgagcaaactcagtgagatcccatctctacaaaaattaccaaaattaaccagcatgttggtacacatctgtcgtcccagctacatgggaagctgagggaggaggatcacgtgacagttgagcccaagagttcaaggctgcagtgagctatgatcaggccactgcattctagcctgggcaatagagcaagaccttgtatctaaaaagaaagaaagaaaagaaaaaagataaaagaataggaaatatcatagtggacagcacataagtagaggtgaagccagctggacttcctcggtggagtggggtcttggagaacttttctgtctagctagaggattgtaaatgcaccaatcagcactctgtaaaaacgcaccaatcagcgctctgtgtctagctaaaggattgtaaaggcaccaatcagcactctgtaaaaatgcaccaatcagcgctctgtgtctagctaaaggattataaatgcaccaatcagcactcttaagagctgtaacactcaccgcgaaggtccacagcttcattcttgaagtcagtgagaccaagaacccaccagaaggaaccaactccggacacataagtacttttattatagacacatattatgctgtattgcaataaaaaatgtattttttgaacatcctagtctacctatcttcagaaggcaaaagcacctctggtgtccctgttgtggtatctcctagcctacctctctataaaagttttgcaattaagtatatttgtgttttatacatccttgggcttctcatagtttaaggtcctaactggagttcagtctttctcagagccgtctcatggtatcctcactgatgaatgaatgctgaatagaaagagccctgcttgcatatatgcaggtagtatggtggaggggaaatctagaagtcatttctgagctctgacctgctggatcatcaccccctgaacccccagagcctcggcatacagcctcacactgtaccacctattttggtggcccaagttagctgagagagaggaccagacacagtgcccaccatcacctagcactggccctgctaccaaacagtcattccttttagccctctcctccccaccaaaagcatttcaggcaaagtgccagctcctgaaatgtggcctctttgaagtggttagtgaatgcccctgaaaccaccaccttatgtatggtggtgcttctgctgccagagcttaatacagggtcatgttcctttcctctgaaatctgtaacataaattcagttttaaactggattttttttttaacagttggtctctgaacaatctttagggtggggaggggatagtagtggttgttggggagatatgtgcccttgaaaactggattcttttttggaaaactgctgacacaggctaaatggcagagaactaaatggccctactgttcctacctgctgacaggctcagccttgggatggggctgaaatgagctctcgccacatggcagagacatgccttcctctttttattcttctttcttacaaatagggggtacttttgtgcctgtcaaaaaatacagctttgaaatgtagataaccaattaacaacagtcccacccccaacttggaaagcacatgagtgctgatctaaataactagagaatcggtaacaagtaacctccctattgagaacaggtctgaaacctctttcataattggtgttctttgggaaacgctaatagacaaacccatccaagctcaggaaatgtactgatttaaagaggtctaaggaagagtgaccagcccagtggccaggcatcccggatgcctaggatccttatgtttccgtacatatctgctgttacatcctttctgtgagcaaggaggctttggaacattacagtcttgtcttggggagatgagatgacacagtgcatttcagttctgtttccaatgctgttatctgttggaaaaaggaagctttcctacccattttgtcagcatacaactggtaggagctgttgcaatctcattgtcttctgatcagcccctcggcagcagtcagagtggaggccagtgaagcactctgaccaaatggttgtggtgagtttcaaaataagagatcccagcctgagcacaccatcacacttcccatccgatagaaccagcattgttaactgtaccacatctctattctaaatttaggcatctttttttttttccaggcaaagattactatgcaaacatttaagagaaaaactttgtccaaagtaattttttcccccaacttctatttggtttcctgcaatgttgagatgactcattctcttccaagaaattttaaagaaaagagatgcaggctgtatgttagtacacaaagactgctctgtaaattctttttcttccctgtctagaaaccccttgcctttttatagagaacggaaaagctctacagtcttcattgtcatgtactcggcctcatcaggttttgttgttcccaggaataaatgtcccccttgtctttgggtggggcccccttgtggcttaccagctctgtcaaccccactgcagtggccagcacggaagcccttcctggggccacgctttcccccaaaggcacacagttaaggtttctgaaacagagaacgaatggccttttatcatctgtgaaaggagagacactggcaatttcctgcctctggcctagtgtcagaatttctcctgattgctagaggctgtattgcacattttaagtgggctcgctacacatgtagtcccagcccaaccctcagccagagggagcagtaagtcagatcacttcagcagcctgttcaaataaacagggataatagttgagtggtcctcccaactaatcagtacatgaaaggaaacatctgcctgggcttaattgctgttgtttttggttacacttttccctccccttcttcccccatcccccactctggggctaggttatttaagtcatgggtaagcaacagggtagaggaataggagctttctcctttaacctctgccattcaaacataaggaggagttaagaaacgataggctggcagggggagatggcccggaggcaggagggcagggcggtgggaagtgatactcatggtcacttcctgaccctgttgctgactctggggctcagagtgagtcatgttgcctcacttcacctccttgggcctctgttgcttcagtggagctcagctttcctctcaatggaaaggacaggctggtatgtgagatcacagatgaaaggcattccctcttgtggcttcttccagcagttgaggtcattggatgagagaccctggaatgataaatttaagactggcaagatcccctgaacccgtccattttgtagagcatctgggtccccgaggagaacttgctcattatcttctagccaaccagccatacactaaagggagggatgtttgaagctaatatggactctagaagccaggcagaagatcatgtagaatcatagaatggcagaggttggaaaagactttagaaatgttttagctgaagcttttcattttatagaagggaaaacagagggccagagaggttaaccaggttgtccagagttacctctttggtaatgcaggagccaggaatagaaagagaatcttgtgattgctaatttagggctccttccacccctttccccactatcagatgtaaaaattcatgcttactcatgacagaggccacacataggttatattccataatgaataccttaatagaaaaatgggcagagaacaccttaataagaaaatggcagattataaaagaaaaatgaaaatgactgataaacatttttaaaaatgctcaggctcattagaatcaaaggattgcaaattacaataggataccacatcaaattgtcaagacaaaaaaatgtgaaataaacattcatatatgctattggtggtattttaaattggtaccgtttttctcaaaggcattttagtggtataaatggtagtctttgacccagcaatgttatttctaggagaaaataatgaaaggtgtgtgcattagatcatatacaaagtaatgtgatatggcattttttatcacaaaaatttagaagtgaagtaaatgtccaagaatgggagctacatcaatagaacgtattataatgctatagaacaataatacatgtggaaatgtttacaacatatgtttaagtgaataagttacaaaacaggatttataatgcaatcccaattttgtaaaactagaaaagattagaaaaatacataacaacacttagagtggtgatttcttagtggtaggaatttaagagttacttttgttttcttttttgaggttttctagtttccttattataataaacatacattacttttgtaatcagaaaaaaaagtattttttaagtagagatgtatgtaccttgaaaaaaagcaagatcttaaatgattgtgtatctgacatgaaagtccttcctttttttgcctgggagctagcagctatggtgggagggatgggaaacagtattataacttctgttagggtggcattttgatacccgaatttctggtaggaaagatctagaaggagctggcaaaagataaaacaagggctttccctctcaatgacccatgctgccaatcagttttagctctcttaggtttggcatacaacacttagtatagaaggtgtgacaatttccttcctgcttcctcctttctttccttttcttttcttttcttttttttgagacagagtctcactcttgtcacccaggctggagtgcaatggtgcaatctcggctcactgcaacctccaccttctgggttcaagcaattctcctgcctcagcctcctgagtagctgggactacaggcgtgtgccatcaggcccggctaatttttgtatttttagtagagatggggtttcactatgttggccatgctggtctcgaattcctgacctcagctgatccacccaccttggcctctcaaagtgccgggattacaggtgtgagccaccgtgcccagccctcattctttatttctactgctctatgtagttagatgtcagccctgggtggcagcagcaaagaacccaggagccatcactgctcaagattaactagttggagaccccttaacatatattttcagcatctagtaacagctaatctcacaggcagtcaatattgagataccgctgccttgtgagttttgggtagaaataaagcaagtaagaaatatagttccatcctgcttggagttttctatttagttagggactttgaagtccctaaatgtttatatactttttcctatttcatcccattacacatcttactttcctttgaaatcttctggaatgcttgactgcaagtatctgagaaaccgtgttccacctaacaacagttgctaggtaggatgtggctttcaggcctgctctttggggaccaatagaaaaaccaaaggctaccaccctttttccctctacgcaattgcctttgctaggctatagagagggcacatttcattttattaaaactctttgagtaatctgaccataattgggtctgattggagtggttatctgatttgctgggttaaataatgggccttaattgagtctgggttatttgtagagccagtgtggcttttgcctttgttgctccctcctctctcttctgtttcccaattaaccttcattcctctttccttgcagagtaaagaagtcggccagcagctccaagatgatttgatgaaggtcctgaacgagctctactcggtaaatcagatgggttgcttggctctttaacaagcagagggaagcagcatttggcagcttgcagccatagtacatcagcaacagaactgaactgaggttgaggacaagtgcatggtccccactgggggtgaccccacccatctcttttttcacactcgtcttttcaaaacggaatgagtcaaaaaatacttcctcaaaataagttttctcctcagctatgcaagctcaccctggctttatttggggcataattactagagaccagccaaagtctaggtcattggcacaatggaccctgttagcagcaaaccagggaccctgaactaatggcaaggaacgtagcctgcattgcactattaatatgtgcctgtcggaaagcctttattgttctaggtttttcatcagatcttggattgatgtatggctttgagactagaacaaatgctctagagggcagcacagagtcctaaatgtccccagtaagagggaccagtttgagcagagagagctttgcctggcttcctggagttttataaagccaaacctcagtgacgaggcaggctgcgggcttggagaagagaacacaatctgttctgagatgactggcgcttcaggcacatgatgcctgtggctggtgcgtgttaattcatgcgcagagaggtggtggtggtggttgttccccagccatgtttttctaattataatgaaaacaaacacacactcacacacatacacaccaaggaaattcctgttgttatacagggaatacttaagttatacagctaatgcctttcaggggccccttctccagcttggatgtgccagcctactatgtcattctccagggtttctccatcctgtttgaaggtgatactgatttctgatgtttacttgcttatttgctgcattttttcttttcttttcttcctttgtttttttttttaattcacagaacaggcagtggtgacatgcatgacaggcatttgggatcagatgttgctgatccagaagcctaggtgtggccattttgtcatggcaactgttaagcaagtaaatagggtagagtagtcatctgacttatctccagcgatgttcagtttgttttgaatttctactctgtgacacttctgctctgaagccaagcatagatagatggtacctttcgttcaactcccaagttttcatttctctcaaatgaagttaagaggttttaaaaatagaaacacatcgatgtgagccattttcagactggatgggtttcctgaaccttgtctttttaatgctttacttctgctcttttagatcaatttctaagcgccaagaagagctattactcctttctcctagcagagaattccctaagatagaaaatgacacatgtagtcattgtataaattcttttattttcctgtaagcatcttgaccctctactatttgcagctgtttctggggaggagtagtttggataaccaacaaaccttgccacttcttcagtgggactcaaggcagcagaagaagactactgtctaaggatctgttagcttttacccagggtcctatgtctcttcatatgctgtgctttaaaaaaaaaaaaataagtgaaagggcgtaagctgtgtttgagtgaggaagaaaaccttggaacttatttctctggtctgcagagggccgagctgctacctctgactgcagacttaagacagcccaatattcgccaactactttactggccattgtgaggccatggtcaacatagagcataacatcttcccattgatgttcaaactgagaattgcctgagtgtggtatcccctgccataaggtgagctggaatacaccttcataatctgttaaaggccaaaattaaaatgtgatgttttcctctagtaggcaatggaaagagggaaaaaaaagagtagaggcactaggaagtttcagagaagtcaaaacattctggtccaaatggagttttaagcagagggagttttaccccgagaggacatttggcaatgcctgaagacatttttgattgtcacaactggaggagtagaaggtgctactgacatctaatgatctagaggccaggggtgctgctaaaatcctacagtgcacagggcagctcccacaacaaagaattatctgacccacaatgtcaatacagagacattgacaatcttctgacccacaagattgagaaatgctggtctagtgactagagtctcctgaattaagcagcctagattctaccctgtcttgactactagctgtatgagcttgagggataccccaaacctctatgaccttggtgtctgcatacactccatgcactggtatttctatatcctagggggtggagtagttgggtgagttatacttcctgaaatattaggctatagctaaggatcaaataggtttccagagtctgtaggccattagaaagttcagtgagccaggctcatgcctgtaatcccagcactttgggaggctgaggcaggcagatcacgaggtcaggagatcgagaccatcctggctaacacggtgaaaccctgtctctactaaaaatacaaaaaaaattagctgggcatggtggcgggtgcctgtagtcccagctactggggaggctgaggcaggagaatggcgtgaacctgggaggcagagcttgcagtgagccgagatcgtgccactgcactccagcctgggcaacagagcgagactgtctcaaaaaaaaaaaaaagaaaaaggaaaaaaagagaaagttcagagaatagccgggcacagtggctcatgcccgtaatcccagcactttgggaggctgaggtgggcggatcatgaggtcaggagatcgagaccatcctggctaacacggtgaaaacccatctctactaaaaatgtattaaaaactagccaggcatggtggtgggcgcctatagtcccagctactcaggaggctgaggcaggagaatggcatgaacccaggaggcagagctagcagtgagccaagatcgtgccactgcactccagcctgggggacagagcaagactctgtctcaaaaaaaaaaaaaaaaaaaaaaaatagcagttcagagaatagaattatttcttctggagattaagataggtttaggactggtctgaataaggcaccatgggattacggtgactaactgtccctctttgcctagtactgaagagtttcctgggacatgaaattgtcagtgatgaaactggaaaagttctaggttaaaaagggttaattggtcaccttgcatgggagagtggttttatcaggtgggaagctgggactgttacatgctagctttgggaagctgcttgctgtatgcacacctttgaggagtcaagaagagaacaagggagagtttcttagaaggagctttcccattatttgcttgtcaggaaggcagggaagggcctctcatttcaatgacgttgtaggcaatagaagttatttggggtcactggaaaaaggaaaccaaggatataagaaacccacccagttttttcatgtccttcacatctgctcctaatgcccatgaatacctttttttaggggactagttatccaagggttggtaattttagtacctttgaaccttgatgatccaaggagcaggacccaggtgttcccaaataaagatgcctttgggcaccgggcccagaatgccgccatgagtggccagctgcccctctgcaccttcctcttttctgcctgaagggcctttgatttccctgacttggcattctgtgctggggcctgcttcccacagctgctattcagagagcaatcctagcgagcattcttctccacgtgttttccccccataatgagctggcttgtatgtaagccatggcataagtggttttcattttctgactgatgcaccgggaatgcctttgaagtcagaacacactgcttcccaaagaactctgggattctttgcctcagttgtactcagaggtcgtgtctggaaaaacccagcaaacccccacaggaaggagtgtacatggaggcactgaagccagtgtggattggctgagtatgaagagtcaaggaagctctagaattgagaaaaaagaggctttgggacactttggggctgttgttattccagaggccttatgcttctgtactccccctaaatttacatccccttggcttggagcagcggctgtgtgctggcagagctacttcagactggtatttagcacctgttcccttgaaacaatggcacttaatagtctctcaactctgcttgcctatttgactctggcactaggcactagggagacaagaacaaataagagatgtttctgacctcaaggcgtttagttttaatagggagagacagaaaagtaaagcatcaagtgaaaaatgaagtgacaagaactcatttacatgtctgcacagaggacagggatgaagtcaggctccttgaagagatacttgaattgaatctttattgccaagaactcttttcttgttctctacatgttcccttttttgttgcatccaacttttgtttcatgatgcagtatcgttttatttctcatttatctctccagggctattatggatatattgttttcaaacttttcttcttgttgtataatatttcttctaaattgctagttttggtcttggtctttcatattagacatttcctttaaatgcctggtcattcttagctgcctattcacattttaaagtgaggcactaaaagattctatgtcagctgtggccttcacagtagggtgttctaactgggctgtgtccttgtggaagccccaactttagtatttctaggtctcttatcttggatggtcagattgccgagagatcacacttttgatctcccactcatgtctgggagctgagttgtgaagaggcctagaccatctcaaaatttaacatagacttcagctaatcctcctgttgaagttcagtatacccctatcctcagctgaaccttgtatcccctagtccatggaccctctctaacagaataaacctctcatctagtcttccactacaatgggagggggatcttggggcctcactgttctcagacttcctttttttttttttttttttttttttttgagatggagtcttgctctgttgcccaggctggagtgcagtggcgtgatctcggctcactgcaagctccacctcccaggttcatgccattctcctgcctcagcctcccgagtagctgggactacaggcacccgccaccacgcccagttaatttatttttgtatttttagtagaggcggggtttcatcgtgttagccaggatggtctcaatctcctgacctcgtgatccgcccgcctgggcctcccaaagtgctgggattacaggcatgagccgccatgcccggcctgttctcagactttcaatagcttattttgtgtttagctctaccttcatcccactgctacttatttctcttcgggcttctgtgatataaatctggctgcttcctggctcactctagttttggtttaggactcaagtagatgagttactgtttgcctacctgcttttcggcttcagcttccattctttttgtttttctcaatttatacctaaatgataatcattttagaaccttttttttcctattattttagtgtggctgtcagagggagcagagctaaatatgtgacttcagtgtttagtttttcaaagtaaagtggaatgttctttgcagaactgagaatttagacttttcagtttttccccatagtttgcatttgcctatctatatatagatagaagtatgtatatgtatatctttatgtatacatatctatatatacatatatgtgtagctatatgtctaagacatagatatatagatatacatacatttacatatgtatatgtacatagatatatatatctaagtcctatcttggctttctctaagtcctatcttgactataaatatatatttataaatatatatttaacatgtatatctgtatctatatacatttctaagtcctgtcttgactttcctattttttcaattgttttggcatcacttatttaagcttcagcttctaggtacctcagttttctcttgagctggaaggcactaataaagcttctccagtatttacccagaagagagattcagtgtcattcagtcatttgggcaaccactttgtaaaactaccattgtgtatatgacatatttctccactgtgagaagaaaacacaaaagaagtagagcttagcgtgaagaatgtatagtttcttaggcaaagtagcgttttactctcttttaacaagaaagttctttaagttttttaggggaaagtaacattgtaaattgttgatttttgttacttcatttgttgacttggtagcgctattctttgaccccttttttatctcatgtttattcataacgttttctctttatcatgcaccttcatgaaataggaaatcactttaaaaaagaaaaaaagcactcacttttgtaacttctcactaagcttttgaatcccatggtcagattcaggtgaaaaaagagaaaaaaaagaggagcctcctatctacacttcttcagctgagataacagatgcctcttttccacttcttagttaacctggaaagctgggggtctgtttgaattacttagaaaggcttttaaacgccattagttgttaagtattttttcttctgtatagaaaatatgaagagtattatcctggtaaaatttacgggaagtagtgttaggttcagaatgaggtgaaactgatttaaaacattctgcattcaaaatgagacataatttagactctaatgtactttgattttgtcagtgtcccagtattctttattctttcatctgcctctagctgatcgtaggggctagattagtatacccacaaagtctttctaagctagattttctcagcgtcagcaccattgacatttgggccagataattagttgttgtgggggctgtcctgtgcatgggatgttcagcagcatccctgacctctaactactagatgccagtagcaatccccaagttgtgacaatcaaaaatatttccagacactgccacatttcccctgggggccaaaatagccccaggttgagacacttctctaactcaggttcatacatggaaccagtttctcttttcaggaatatcttgaccatatttaacctttcctcccaaccagttcagctccagtcctatccagaggagagtcggtgttgcttaatggctaagaatgtggtctttggagtctgacagacctgggtttgaatcctgattccaccatttactcattgtatgaccttgggtatgatagttaatctctctgagccttatttccttatctttagaaatagaaataataacagtgtctttcacagagttattgtaagaattaaatgaggtaatgtacgtaaagcccatggtacacaatgtttattaagtggtagatattaataataatattgtacctttgcactcctgtgttacacacacacatgcacacacacacacacacacacacacatgcacacacacacccaacttctactctctaattctccatctcaaagaaatcttatggcatcacactttcagcactcgtgaactccctgtgtggaaacagaaagttcccacagagtagagcaggcactaggtggctggaagtagtatgtttagtaggattggaaacaagcttgagttctaggcttcctggcctccctgttaagagaaaggattggactcctagatggttgctttgatggaaaatcatccttcaccttttatactacttccctcctgtggcaattccagttatacttgatatggattttattccttcccagactcttacctgaattgttttgaaggcttacagtcttcatagggttgttgtctagattgtggaattgtcctaaggatgaaatgagaaaatgtgttgtgtggtacttggcataaagccaggaatatactaagtgctcagtaaatgataactggcattgcagttgctgtgagagggtgtttgatctggataaagcagaacagacagatccccagaatgccaggccggtaaaaggagcttttggaagcttttcctcttccctattttatatctgaaaggtaacagaaagcataggctactccataggctgcactgccctcttcggggttcctgaccagcccagaaaggctttgcccttggggcctgagagtggtggtgttgtttcccatctactcagtattatgaggtgactaagtgatagaaatcacctggccaatattaaagagaaatgattacaaatgataatgaatagaaataaataatacatgatggatagacattaagttatttcaataagaggaaatgttggctcagttcacatattgctttcctgtgctttggagtggtctttaatctgtgtttgctgaaccaaacacttctggatttttcccttaggggtgtgaggatattgcttcatgggggagagctccagctgagtctgttagtctgtaaagcagagaaatgacccccttggcttgacctctgggggtgggggtgggcgatgtcttgcaggtgatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaaggtatgtaggctcccacagctgtagatgctgggaagcaacattcggtaaggcatggctgataggaatttcccagtagtcactgggaagagcagacgaggaagctctgggttcttttagtgcctaatgactgaaaatgaggccttgctctgtgccctggcaggaatactaggtattggaagaactgggcacgtgggatccaagtttctagcctctagcagaaaaccaagaaacagcagtcacctttcccaatccattttccaaatagagctcaatatcctattgctttggaggggttgggggtgactgtaaacccaggatttggtttcaggtatcaggtgttcaggggcaagagtagtggtacctccttcagagtggcattgcaagaatgaagaatgatatttgaagatagaatcaaagtggggcacgcatcttaagtagggagcctcattaacctttcctgaattgatctacattgtgcccttgaatctcattaaacagaattagaacccaatttaaggcagatgcgcatagggagtagcaacacaattgtagttcttgaatacactgtacttttatcttttagagaacaagccccccttaaaaaaaaaaaggtaaaagtgaacttctgtttccttttcagcgtcaagccaagtacacggagaataagctgaaggccatcaaagcccggaatgagtacttgctggctttggaggcaaccaatgcatctgtcttcaagtactacatccatgacctatctgaccttattgatgtaagtgcttaaagccaagggcctgagggcacctcttttctggtttcagaatactcgtcagacattccccgatactattgttcaggaatctggtgcattttgagaacaattaggaagatagcagccatgatccatcagggtgcttgccaagcaccaagtgaaacacttcacacttattcaatcctaactggaattctgggaggaaggcattattatctatatttttacagattaacagagagtttagatgacttagtcagagtcagttaacaaatgacagaggcaaaatttgcacctaggcctgatgactcaacccaggctcataaccactacactcgtctatctgccaggaaatactttcttccttttttttttttttttttttttttttttgagatagagtcttgctctgtcccccaggctggagtgcagtggtgcaatcttggctcactgcaacctccatctcccaggttcaagcaattgtcctacctcagcctccccagtaactgggactacaggcatgcatcaccatgcccagctaatttttgtatttttagtagagatggggtttcaccatgttagtgaagctgatctggaactcctcacctcaggtgacctgacctcaggtgatccacctgcctcgacttcccaaagtgctaggattacaggtgtgggccctgcacccgacctaggaaatactttattacatcagcttctcttgcacagaagtgagtggcaagaacttaactaaagagttacaatgccatcccttatatttgtatagcatttaaggtttctcagtgttaactcatttgactctcacatcaccattatgggtaagcattgctgtctccagttgctagataaggaagctcaaggtccagaggactacgagactcacttgtccaaggttatgctgcaaattagggtcctgtcaggaaggtatccagctccccctgacatctggcccattttttaaaatatgtgatgcaaaggggattgaggaaagcggctaataggcacatgtgttttgcaaggggcaagcgcagggataagctttttgttttttgcctgtgagttattcttggccttgtttttcctgctgcttccccttacagttgggtcttacaagccctctcacctacagactccaatctggcccaggtcctgagccacacctaagtgaagctatgtaattacaccctttctcacctctccttccagtcatcaaagtgaggcatctggagccagccaatttagcatcccagtctctggggcttcaagtgtatctcatctcggaggcctgccatttgtttcagggtcttgttggcagcagttgggctttgcaaaactctggcccgaccactcttgctttcctgccttggtttctccacaagcaaacctgccacacctcacaacatcatatgggatttgggtccgagtcttgctgttatatcaccacctgggtcatctaggcttgtcactgaattgttctgaaacccagctttgtttctcacccactcccaagctcctctagctaactgaagaactggactaattccctggtattaaaatctggcctcacgtaagagttgcttggggaacttctctaaaatacagattcctgtctccctttagccgaggatttttgattcagtagatttcagccacttaatgccctaggtgtcattgtctcactgggttagtagagccttgctccctgttctggtacctctttgttctctctgcttattgatgacaatctgaacactgtccttcaatggaggtcaaagccctaaacaagatcctttctcctcctcaggggaagagctcctcattgttgggagagaggcctgttctcagcataaggaagagaatccattctttcttatgcacaatttctgctatttatctcgcatttggtaaaaattcagactgtgctgtctgccacaccactgctattggttagccctcttctctttttttgtactcaaggcaacttccctacctttttcaccgaaatactgatctcaggggaagggaggggttactgctgtatcagccacaacctttgcaatccatagattctccatcaggtataaccaagtgttttaaaatcagtccaagaagtgaggtattttgtaccttattttcatcatttaaaaaaaaaaaaacgtctgctaagagcctaatttcacaggatgtggtgtgacatgccattgaaaaagaggctgccttagtacttggcagggtgtgggtctagatcactgggatcaaaaggctacataggtagtaataaagtttctcatgtttctttttttttttttttgagaaggagtctctctctgtcgcccaggctggagtacggtggtgcgatctcggctcactgcaagctccgcctcccaggttcacgccattctcctgcctcagcctcccgagtagctgggactacaggcacctgccaccacgcccagctaattttttgtatttttttagtagagacaggttttcactgtgttagccaggatggtctcgatctcctgacctcgtgatccgcctgcctcagcctcgtttctttgctgctgttttggttgtgtcttgttttagtttgttggttggttgggtttttgttgtttttcctgggatatggacacattcattattttttttaaagttgtattattctgctctataaatgttcagtaaatatttatttagggagaagccacgtgctcagtattggggtaaaaatggattatagtagttctcaccctagaggtagtcataggctgtaagacaacatttttcaaaccattggtcagatcccttaagaaagccaggaaatcacttttattggtttaacctgtgttttcagatgactagatgagactagaataagaaagaaaatattagagtacatcacattggtaagattatgtgaaacttttatgttagatatgtatgtacacacttgtacatcctatgggggagtgtgtgacaatagaagatgtgtttcttattgtgagttgggagtcaaaaaagtgtttgtgagccattgtactatgaacagaggaagatctcagtctcatctgttaagttctgtgagagcaggaaccaagagttttctttaccttagtagcctccagtgcttaatatatagctgagcacatagtgtgtttactgaaggaagaaaggaatagaaagaggaggaagatgatcatctaagctaagatcggtttttctttttgtacctttcaatatggttttgaagtataatttacatacagtaactaaacttaagtgttacagtttcaagagttttgacaaatttgtacatctttgtaacctatgtcaagatatagaataaatattttgataagagatatctttccattgcctcagaaagtttctcttgtctcttcccagccaatcccccaccccaaggcaaccactgttatgatttctttcaccataaattagttttgcccattgtagaacttcacaaagatgggattatccttttttgtgtctggcatcttttgtcagcatgatgtttttgaatttcatccatgttgtttgcatgtatcggtagtgtctttctttttcttgctgacctatgagataaaaagggccaaaaggatgcagttagagcaggactaagtgaggagcctgggatattggcatcctgatcttaacattattcattacttgctttaagacatgggatgaatcctgttgcagtccattgccatctgtgtcatgtacagccttctgcctccttcttagtggttctgaagccaaatgtgtgcataaggcattgaggataagtgaaaagaagttatttttgttgatgccattacattgaccaaggactagcctccgacttctttttatagtatagtgcaagatttaaacttcagactgtaggaatccacgtgaggcatctgccacactggggaaaccttgacttcaggccaaaaagacgttctgagctcatttgatggcatctaagaacgtaggctcactggaatgtaattttcctcccccatactcttctggctctctcaacccaggagcagatggatgaatgaagaacagggcattgtcctcatgcatagctggagtgttgtaagtgccgtgtacatgtatggaaggtctgtgacaccatgtgcacccaagtcggacatgagggaacttggctgtttcagtaagaaatgtcattaagggcagttatttttctcttttgtgtgaacttgaagtgggtgttgtgaaacacccatttttcctttccaggccttgtggagtctctgggtgaagatatcagctgggaaagggttaatgagctatcaactcaagtcatcatacatctggatgggctgtcattaacttcttacaaaaatttgatttcccctgagagatttttcatcaaacatttatataacccagaaatggccaggggagtccagcgtggccacagaactcatcagaagccatggaaagcctgctttgtccccactgtgagcaaaataatgtgcttcctgtacttactgggattcttcttggaacaggatgaaatattcaaatctcatttacctaaccttgccagatattgcttcttcgctgaaggctcggtttctggctgtttcccctacaggtatatagatagtcaagactctggagaacctcttccgaatctgcctggttggctagaggtgtagaggagccaggggcacattgtgactcagaccctcactcattggcacaaagaagctacagaatagttatataaacagaggcagtgtgccagcctgggaaaactcccagcctccctttggccatagagtaagcaaaacaaatggcttcactggccccatctacccacttgacttaggtcagtattcagcctaaatgttttatttcctgagaggctggaatctgtatttgtggtatcaatcagtcaactgaaatttattaaatgcctgctgtgagcaaggcctaatgctgagggatgtaaagaagagtgagaagctagtctggttggggtgatatgacatggcaagtcatagaatgaagaagcgtattccttgtcatatgaaagctgtagattagtgtgtttctaagtagaggccagggtcactggagtctaggattgcagggttggctggcttcccagaggctaagaatttaatctggatcttgaagatctggtccaattccaacaggtgagaggcataggaaacatttaaggaaaaggacattctgggagctgaagggcagaggtcagtggatttggagctatattagtatttttttaaagtgtctacatggtaccaaatatctgtaaatatattgcctgttagcctacaacaaactgtgtggctggtgttatcctcatttgaggcccagaaggattaagtagcttgcttatggccatatagctgatttgaagactaatactctaccctaaacagagagtatttcattggattagagcagatgaatctgaagaagaaaataaagggagttgatgttggatgggtagattgaagacagattacagtttgttctggctattgaaccttgctcaaattatttaacttcactgaacctcagctttcaagcctggaaaattaagattataccaacctcattggggttattatgaggattaaaatgtagaatgtatataaagcacttagcacatggactgacgtatagtaagcatacttagtgaaatagaagcattttttaaatttcaaaactgaggaaggtggattttaccttggggaaaaaaaatgagaggtattttaggttcttcaacaggaaagtgccataattaaagtcacagtttaggacagtgaagcagacggtgagggtatgaataggggtagaggtagtaagaatggagaggaaagggaaattaccaaaaacaggtaaaagttttttgaagggtaacttttctctcccagattctaccccctgcccacaccccctccacccacactcatacactctgtgggccgtgttacttctgttcattagacttataggcatagagctcatcaacagggtctacatagagctagtcaggaaggtttacaggttcaagggcagcctggtgagaccagcagcatctcccagagagcccatgcccgtgcagagtcctaatgagccgcttttgtctagcttccatttgctcttccctcccaactgaatttaatgtctttccatcctctgcctctagttaagttgtaactgctgttattccactgcagccaggcagctgccagggcctgttggcactgaacccagagcccaacccaactgatgttctcactgagcttcttgtcagatgccaggaaagaggaggcacatcatatgccttttcttccccaatagtagctgcttccaatgtgatcatgatgagaggaaaaggctgtggggagagttaatttgatgcttgcttgtgcaatgaaatggcaatcaggcagatggccttactctatgcatagattcttctttgaggtttcttctcaggacccggacctcagagctgcttaagcaatagagaagatgatggatggccaaggaattgggatctctgggtcttttgggagggatggggaatattatcacagagttacagaatgccattgctgaagagggccttagggattacatttagtccaaggattttcagacttttctctaacagaagaattctttcttcaaaccaaaccttacatagaatccctaaatattaaatagaaaaaagagcagggttggcttggttgaaggaggaatagaagactccaagtcctagtagttgggttgtccttttactcacttctcaagggcagcttcagtgccagctctggtctactgcttgaaagccactagcctggccaaatctgttcattttactatggaagaaacaggtccagagaaggggagtggcttttccaaggttgcttgattctgcgccagtgctttttttatacagttgcctctttttgcattttgttgtaaaaaatcagaatcctttacatggcatgaatttttccagtaacacttttgcgtagagctttttagtcttataaatgctatttctgtagtgcaggggcatctgttgtcagatgccaggaaggaggaggcatgtcagaaaccctagtctgcagctaaggcctgtcctaggatgttgggcattggtggggatgatgacccacagagtcagctccccattctctccttctcccatctagagttgagcttgcatacattagctgctgttgcaatactcctgctttcagaaccctgaaatggcctggcttggttgctatatagtgatttaaccacagtaaccctcagtgagtggcaggttgtatttttattgttgaattttgttataatgacaaccccagataaacctgaaaatgaaagaggattctctttaactctcaattcttctcatgtttatgaagtagcgcttaattaaataatgtcattttatccttatgaatcttcttcctcctaaccgcctcacagccctctagggtgtgtttaactgttgaattgggagtcaagaactgagaactctcacccagaccttggaagtcggaatgtcagccctctttctactgcacagccaagcctattgatgtggtcagatctgccctctggaccaccttccttttctgccaagccttggggctgtccatggtgtgctcatgtgccttctccttcccacagcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggtgaggccctttccctatacccccaccctcaaggggcttgagtggacttgtctagattaattacacagaaggcacattattctggggtgggagaggcctgggcccggctttttgtcaggtgggtgaggcacattccacttattgagcaaacagttagtgagtgcctgctgtcagacactcgggcttgggtgcagacatgggggattaaagccctcagggagcttacagtctggggaataaggtcgctaaggcttgaggagggttcaaactatgcatagagaggggtatccaaaggggcccagcaggatcaaagaaggtgaaaaacagcaggtatattctaaaaactaccaacagttcaggatggtgaaaggaaagtgagggaggggggcgctcccagtggtgaggctagaagaaatgagagctgaggtggggccacatcctagaggctttagtggggaagcgagggctaggcagggaatgctgtgatcttttggcatttggcagagttctgaataatcttattctcctgaaattagaagactgtgatgaagtgtatagtttgggtattgaataaaaaagaatgggtacctgcaggaaggaaaggagctaagatgctatcccaaaggcctgatgctggttgcccagacaggggagcatgaacatgggggccttgttttggactcttagcctccagtgactagaataaaaagggcctaaaaaagctaaagtgagaggcaggagaagctcctcggttttcattgttctgaatcttttggttccacttgtgtggttgtgtgtacaagtcagagtgaacctcattcctgtggataagagccaccatttctcctactggtgaaattagaaggaggttgtatagggcttatgcaatagaaaagatcaagatggacctttgggtatagttggctttaggaggaggaattttaccaagatactgttttgctgtctctgtactacttcctgtgtgttaactccattctcagacaggccattctcccatggaggcaaggtgactgcatttccagccttccctggtaggttgaaatctagtggaaagagtctctgcctccctcctcaaagcccccataaagtttgtgtgtctcattggttttgattgggtaaagtgcttatgcctgggtccatgcaaagcacgtggcctgagttgtggagtgggaggttcccctcgccgagggcagttagaccaaagctaccaaaaaaaggaggagtggacgccggggaccaaaaaacagcaacatgtgtgctcctcaggaatgatgcttcccttaagattagcatccagactctagaaatccccactccagaatgacagctgtggcagtggaaccagaggatttgctgtcatcagttggcctctatggagagtgagacgctgtcctggagatagaaatgtggagttggtttccttcctttccttcctggggaaaatcaaaccatttacagttcatttccattgctgtggcttaggaaatgtcagtgtctgaacagatggagaagtgagatggcagcatgtgcaattagaattgggggaaggggtgtcaccaagcctcaggaagccccattcctcacctgccctggcttctggtcaaacttgccttccaagcaccttctccagctgtcactgaggttccttcccagggatcagtggaacttggggaccagctgagtggagtgatacattttctggtgttagtgactgagttgccttctgagccaaacagcttgtctccataaaggaggaatccagatgctgggtgctcaagccccctcctccccctgtcagagccttatttccatactccagagtgcagctgaagtgtattaccttgcaccctggtagcggaccactgccaaagcatgcatcatcatcagctctgctacttcttaaaggaacaggcttggaggtggtttttccctccatgattcctctctgctaggtctgggttactttaaaaatcaatagctcactcttctgccagggccctccctttatgtaatatagctgatcagtggctgagccaggcaggggccaggaccagtcctggagcttgtgaaggttccgcattctagcctagccttcatatgagtgaaaataaaaagagatgagagggtgggtcattcttggcctctgcagccagtctatccccatcagtgtgggttgtctgcagattgtggaggcaacaggagggagctgcctggaagtcgttgaactagggccaaagattgggtagcattttgaccggaagccttaaaattggccagggtcccacactaactggtgttctggggtgcacagcacatgaattgatgccaagtgctctcagatgtactaggaggaggtgcttggctccatttttggtgccctcagaggctgtgggactctggatgcctgactggtgacatcaggcagccagagaatttcactcttggcgctaaccggttctggccactgagctttctccattgtgtctgcttatccaagagttagagtgaagtcagctctctgtggatctgagagttggctcaggccagcctctcagctgggggaagaggtcaagtcagttgggagcttaaaagccaatggaggaaaaggtcaagtcccagccccctccatttgaagaaaggttttttcttttcaagcaagggaatggtccgtgggcatgtgaatgtgcccactctttgctgaggaggaaggagaccatttctatccagatgtctctctgcagacaagaggctaaaggacgaacggtaacaaggtgacaggagctgtctccacatgggtcctgcctcccaactctctcagccttctgctcctcatctgtcatccaggggactgtggatgacctcatcccataaccacatctccaatgggagacagtggaacagccattccttcacacaggggaaagctaattggcaataatccttgcgggaaggtcagactcctctcttacagatctagggaaggcctggggtaaaatgatggctctttggaaaatgccaagctccttcagattccataccccctcgggccctctagcataggcaacgaacttgttcctggcttcacgctttctcattgaatcaaagctctcatgcatggcctggatttgtaaacacatgctggctgccagcagtggcaagttagcctcctgacccacttctctcctgctttcactctggtgtatgaagggggatgagggaggggccagagaggtggccacttggacctttggcaggaaatcttcactgtgccaaagcattgtgtttctggagccggagctgcctgaggcactcttctccagcctcctcagccttccatggagctgcagaccctacatagacctacccctgccgggctccaaacagatccccctacccattcctttcatgtactgtttggtcctggaagaggctcacacaagttggctttgggttttgcttcaacatagaaaccacgagccttataccttgaatatgggtagtttcattgccagtaatgggaactctggaactgccaaagggactgtatcctctttctgacctggtgttgctttcttttgttaggcttcccagctctgtgcccagcagcctgtccagagtgagctggtacagagatgccaacaactgcagtctcgcttatccactctaaagattgaaaacgaagaggtgagtttcttccttaggaggctcaaagccacactcttagtttccctgttgaaacttttgctgctgcccgtctgggagcaggtggaaggagcatgcagagaatgtccgggcggccgcaaacatttcctagccaaatgtaggcttggactttccccctctgctacatcctgcccttgaactccaggaagttgctcttgcattgccaaaggttgtgctctattttgagcttttgcgaaatgctttttttcccctctacacatttaatcaaaatggcacttggcagctgtgtgaacaatattgtgtctctgaaaccacctcctcatgcctagctttttccagcatgttcaaacaaacagaggcctttgactttgacacttcaaacatctccatcctcttaggaaagggtgagtttcttctgggctcagtgtatttgctttcaaaaagcggttcaaaagggcgggtgatccagctttctgttgagctcagatggcttcttaccttgtgtctcagtaagtcttactttctgcaggaagatcaggaagaagtagggataggtcacttagtttgcaaatgagcaaacaagttcatcagtttgttgaaggtcatgaaacagaacctggggctttgcagtactaggcccatcacacattttaattagctgtttgtatgagggggttggtttagatttattttattctctttcccttaaaacttctattataatgttgttatataatattataataatgctaatattaaattttaaaagtaaacattaaaagatctgggtcaagtacatagcatgaagggttgtagtggcttttaggttttcactgtagagagtagcatgctgtagcagagtccatgtgatgtttacctcccacttagcactgtccagtgggaagcagagctgcacactctgatggcatcctgtggccttccccagcccactctcttcaagcttctccatcacctgctgtttaacaacccacccttcatgcatcctgttggcccttgtcgtggcaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacagtaagggagtgctatggcttttaaagagcgtcagcatgcactgcagcactcaagggagatttggaactcagagtccttgttaagtgtctgaaggacaggcgttgaatatcttagatacgaatgtgggcatactcagagaccatccctacacttaaaggtgcaaacattaaaagttgtatatgtctaacagggatccgcccaagagaaaggatgctcccaagtatacaactaagaagattttcttttttaagaaatttttaactagctagtaggctttcactggaaagtttccttctcaggcacaggggatcctgaaaggggaacttcatcttttagttcttggagagtacatacaaatattcataataacacatattttgtttataaaaatctataatctcttctaggtgatatgatgacattattttataacttttattgttgggaaactattttttctaattattgctaaaacttaaaggatgggtaatatgcagcattactattttgcacataattccaaaacatcgtattttcttattcatgtatctctagtcttcttttagacagttggacccttttttctttttcttttttttttttttttttaagtattgttaacaatcctttggaagtcactactggtctttgtgtgctgctttttaataattgagttattttgagcttgccaagtaggatctattgcctggactaaaatttatttcctaatcttctgatgaccaagaaaggaaaaattaagtttgcagatgtgagatgaaatatagccagtgaatatgcatactgattctgaatgaaaggaattaacttttcagtcaagaaacagtctgcatgcagtaaattgaatttttcctgcaactggaatgatttgtttaattcttctttgaacactgccctttctccagtaagaacactaatgatttgctaatattttttaaagaaatctgtttttttaattagttaagctcagacttcctcttattttttatcctagagaaaactgctaaaagggaatgatatatcagtactattcttctaaaacaactttttaaaaatgattatacaaagccaaatatgctcattatataaaatttagaaggaaaaagaaggaaataaaaattttccataattctaccagctagagataatggtgttagaatatattcctttctaatctgttttctatgcatgcacaaacacatatgtgagcacatatttataattttattctaaaaaataggatactgctgtacatattgttttacaatctaagtcatataattataatattctttaagcatatttatgagtaaaatattaaaacctatacaaaaaaataatagaatggcattttagctcattcattgatttttgtaaaatatttaacacactccctggtttgtagttagcgttcaataaatgctaaaaatttatcttcaccatcatcattaatttatttattaatcattattaaattattcattgatcattttttgaggatttactattgccagacactgtgctacaagctgggaatgctgacagtataagataaagagggaaatgatgggggatgggtcatgtaaagggagaactttcatttttacttcatatatatctaagcagttataataggttgatttttgtaatttaaaaaatgtaaaaatgcatacatgcactagtgcatgaatggcagccaggatgagtggaattggagaagcatcacacacacagtgacttttgtgtttgatcttgaagaatgagcgaaccaggcagggagtcggggaggagaatcgcattccttgaggaaagagcagcatgtgggaaaacataaatgcacgcaataacctggctcacatgttaagagaactttctgactataatgagggatgtgttgctgccccaagcttcattatctaaggagtttgttgaacactctctagaggcttttaataataggattgtttagctggtctgtctggactgcttagatataacactatttaaatgacccaatctcattacattgtgaagatttccattttttaggttacgtaagaaattttggacctaaaaatcttgcattttaagacagtctttgtcagaattactttttggctctaaatgaattctgtaacatttgttttctaaattgacctttagtaaaagcaggaatggccatattcaaactggtaacctcgcaaatcctgcccaccctttcactttctgtctcaatacattgatgtcctctaacccatttcctgtcttatgtggctctagtgccacttatcaaaattgtgtgcaaatttccttggctaacagtaacagtttttgtctgggcttgtctagcagtggaattctgcctgagttcatcatttttgtgactggtacttgaagtgcatcagatgattaatttcatgataagagggctttttggggtggtgaaatagacatttatggaaaatgggatacccacattaagcagggtgactacctgtttaccatacaacccacacaaagccaatacaactatagatgtgctttctttagtctgttgcctctgcaaacattgcccgtgtgtttctctatgcccttcaaaaacatcagagcagcacatcctggaagatcctatcttttgtaagtttaagaagcagcctcttgtcacagcttgactcctaggtagtgtgcctagtgaccaagagggctgctaagaaagctttctgaccacttgtggctgtcattggactgatttgcccagatgacatcaattgggaatttgaggcatgacctataaagatcagttgcttgcaagagtctcaggaaaataattgtggagttaagaaacttgaagcgatttttaaaaattacctaacccaaccttctcatttgaaaaattaaaaaataaataggccagatatggcggctcatgcctgtaatcccagcgctgtgggagcctgaagcgggtgggtctcttgaggccaggagttcaagaccagcctggacaacatggtgaaaccctgtctctactaaaaacacaaaaattagctgggtgtggtggcaggcgcctgtaatcccagctactcaggaggctaaggtgggaggattacttgaaccggggaggcataggttgtagtgagccaagatcgtgtcactgcactccagcctgggtgacagagtaagactctgcctaaaaaaaaaaaagaaagattaaaaaataaataaatctgctgggcgtggtggctcacgcctgtaatcccagcactttgggaggccgaggcgggcggatcacctgaggtcgggagtttgagaccagcctgatcaacatggagaaacctcgtctctactaaaaacacaaaaaaattagctgggcgtggtggcgcatgcctgtaatcccagctactcaggaggctgaggcaggagaatcacttgaacccgggaagcggaggttgcagtgagccgagatcgtgccattgcactccagcctggggcaacaagagtgaaactccatctcaatcgatcaatcaatcaatcagtaaatccagagaggatgggtagctcacaaaagctggacccaccactctggttacagggtctctggccacaggctgcttctctacaccctgtggaagaagcagaggtgaagggaagggctcaggaacagctcagcaatttttgcctcttatttgccctcagtggtgacatgtttcctgatcttcttggctttgtgtttatcgcttatcttttataacacatagttcatcaatgtctactttttacccgttgccttttttattgtgattgttaaaaatcaatacttttaaaagatgcaaagatttgaaaagggtatacaggaaaacgtactataaagtttcttttcattcctgactcctatttcccctcccctctgctggtgattgaaaccagtttcttctgtgtccttccagagatactctatgcatggacaacaactgacgtatctgtaaataccctttaatatgataaattacattagaaatgtaatgaaagaaaatggaagtagatatagaagtattccacttatacagttcttcacttttttaacgttctttatcttggatcttatttttatgttagtcccaaaagatctgcgtcctttttaaatggctggatagaattccactgtatgaatgtgccatcatttgtttaacaaattccctcctcataggcagtgatgctcgctgtttagccaaggtttaccaaagctttataaggctggcattttcctaagtatttcctttgttttttggaaaccaagcctcggctcttgttgcccaggctggagtgcaatggtgcaatctgggctcactgcaacctccacctctcaggttcaagcagttctcctgcctcagcctcccaagtagctgggattgcaggcacacgccaccacgcctggctaattttttgtatttttagtagagacggggtttcactatgttggccaggctggtctcaaactcctgacctcgtgatccgcccaccttggcctcccaaagtgctgggattacaggcgtgagccaccatgcccagcctaagtatttccttttatagggagttggagaattaggttcttttatgggggatagaacagtgaaggggttaaggatcatggccgataaagtaacaaagctaaacagtctgaattcttagggacaggtttggggaaggtaataggagaggaggcaatgccttggccactggggcactgagtgacactagacttggaacttgtggtctgagatctttttatcttggtattctcttgcaggcccttggtaaacgtgtgctagtgagtacaaatgagtgaatgcccctgtgctgtcaattaaactggggagacatgctccatttaaagtttactctattatgtattctatctgacagctgtttcctattttaaaaattgacggggaggaggggaaatgtcagcatgcctgcatggtggggaaacagccactatagtgacatctgtgtatctctgagcatgggctgggtaggtgtactcactcctcctgccttgctgcagtggatacttagggtcttgggttcacgcagattaaatccaaggcataagcaacatccagtgagttttatacccccatggtaagagtgtatttaaagggaagaggtttttaaaaatgaaatttgaaaagcattctagtgcctcttactacttttttaaggcccaaaaccttctgctttcattctgcttttattttagcacaaagcaaagatgcttagggaagggatgcttttaggttcactgaggaggtgattcaggtataaaggaacacctttctgagtgcctgctctatgccaggccctgtgctattaacagtaatgcttattatccaatttcattctcaccaactttgtgaaaaaaatagtattctcatttttcggatggaaaaactaagactcagggggttaaatgatttgcccaaggttaggagagttagtaagtggtaggactagaatattccaactcatgctttttcattttaatgcaactaaaacgtctatcaaggagggaatgtgcagaaagaaaagttattatgttaatacttttcaataaacaaaactcactgctgacagttaatatccaattaggaattattaggaaatcaattaatgagatcataaaaactgaattgaagtttcacaatggcactaaacaaaatgcccaatagactctttgcctcccttcctactttttgaagaaattctcagttttgattattttaagtgtgaaagttgttgggggtgggcactggtcagactgtgttttaggaacttgattttattttggtgaatacctagaataaaatattacctgttcttttgctccttcattgaggaaaaccccaggtagccactttgattttgggtgtttggtgaaggaaggaaaaagaactacctaatattggaacatgccctaagtaaggagagtgatcctcattgcccaaggaagggattttgagattggagattataagcagcccttttcctggcccccctgatctccagaagtcattaaaagccacctattcttcccttgcattcttcagcggtctcagctcctttctctgtgttgtctgtccaacagcaacagaaaccttctaactcacttccaccaattaaagacaaggtcacttatccccaacgagtctctcatatggataagtgctgacttgtgggtgggataggggagtgataaataaaataacgtgcctgcagactctgagatgcctttacctttccatacctggcttacctggatggaaaactcccaactgtggtttccacgccagtattagggatacagttcataccttgacacagttatgatccttcaggatttaatgaaacccgaagaggtaatccatcatacatctttaccagattgttatttattttaatggttcatcaagtgatagccagagttaactaatgaattgtgaacatgaatttaaaaaatgatttctggaatcacaagtagtgagaggaaggaatttgtatccatctcctttgagaactgtggctgttttctgagcagtctggtcttgttttgaaggttacagcttcttggtgaattttcctcattaggaaacctttagagtctcctgggataaccttccaaagagagaggcttttgaggcttgcattgttggcaatggatatttcctgaaggctttccacctctgggccctaaagtactgttccaaacccacaattaggcattggttggggatttggatattaccccgggaagaatgacagcaggtgagctggcatctggagcagatggaaaagggaaggtgataacagagcctctttccttgcagaagttcttgtgcaaaagcataaaaggacagagggaacagatcatgaataaggcagtagaaatgatttggtgtaagatttggttttggcttgttttatttttaatttagagagtacgggcacactaggggcttggtttgtaactgctgaggaagggtctacccagaggagagtgagactgctcattcatttattcatcatgcatttattgagtatctgctatctgctaggcgtggtagtatcagggatgcaaaggataatgaatgacatggtctctgaccatagagaggaggcagtctgaagaaaaagacacatgagtaataaaccctctgtgacagggctgtatgagaagtgctgtcatggagatttgcatggtacacacaggaccatctgggtgaacatgggagggctagggactgcatcccagagaaagcagatttttcttttgtttttaaacaagagagagaatcagatgcaagctcttagttaaaagttcacactgtacagaaaagtatagagtaaaagtaactcacatttgttcacttttcttttctttttctttcttttttttttttttttgagacagagtcttgctctgtcgctcaggctggagtgcagtggtgcaatcttggctcgctgcaagctccgcctcccaggttcaagcaattctcccgcctcagcctctcgagtagctgggattacaggcactcaccaccaccatgcccggctaatttttgtatttttttgttagagatggggtttcaccatgttggccaggctggtctcaaactcctgtcctcaagtgatccatctgtctcagcctccaaaagtgctgggattataggcctgagccactgcacctggctctgttcaccttctctttctatcactcttaatcctaagtggcaatccatgaaatcaaaggtttgatgtataattatatgttttacttaatatacattaaaagacagacagaactattaccatttaaaatggtgcatccacctatctacctcagtgatctcatatatcaccagtaattcacggatcacactttgggaaacctggccatttgacttctgagttcagacttaggcagatagcccctgatctggaggatgaaccactgcagcaggaggtgatcaaggcaaactaagacccccaagaaaggctgtggaggagagcggaaaagatactgtgttaaaagtccaaaggccttagattgggcctgacactaccacttgctagcttgcaatgatcagcaatttatttgatacctcccctcccctgagataatcttatctgtaataaggaaataatatcttccctatgtgccatacagttatttattgttagagtcgaatgagagaatatgcggtgaagtgctctaaaacctgctatgttgctgcatgcataaagcattaatactacaaaatttagttctgcttctctccttctcctgctctgtaccatgatggatggggcattttgtcgtaatggttaagagcacatgctgtattgtcaaactgcctgtatttggatactaactttaccactcactaactgtttgaccttgagcaacttaattaaactctcgaaacctcagtgctctcatgtgtaaaatggaaatgatgatgatgatgatagttcctagggttgttttgaagattcagtgaattgtctggggacatacggtctctcactgggcagacgagggttgagagagaacaaatctgaaagtgcagcacagcaatcatattttgactgtgagagcaggtgggatcacatttccaaaacttcatcttgtatttagacctggatgtgtgtatgcaagtcggggatgtcagccccttccgctgagtgctcagaaatccgaagctttccataaagactccatgcagaatagagaaggaagctgttgaggatatggctcaaagatgctccacatcctgggcttgcagctgaggcagggactgagcctgccattggcactgctcctggtgtgatggaatgtccccccctcctcccaccgaggggccagggcagggtgggatgtcagtggaggtgacagatagcaggtgtgtgtcctcacaccaagaagaccagggctcaataagttcatctaccctccctgctcttcctcagtgaaactgcaggagaggggctctaggaaacaatttctttatactggccatcatagaactcccagaaaaaacctggagaaggatattaatccaccatgaaaatcaacagctgcccatatgatcagtgccttaaagaaattaaaaaattgactggtggaaattgggtcagaaaccaaatgacctctatataggggaattgtccagctgagcatctgtgatttttttcttcttcttcaggagtctgattgctctttttcctcctcctctcttacagaaaatgaaagagtacctggagggcaggaacctcatcaccaagttacaagccaagcatgaccttctgcagaaaaccctgggagaaagtgagtgtgggaaccctctgctagaggcttgacagtgaggccagctggagctttcttgctgagcacacgcctccatcctcagccaagtggacccgatcttgttgtatgaatgcctttcttttcttggcttgttggatgtggaagcacacaccccaaatgactgcttgagtaatggggaaaggccaatgcttaatgaagcactaacgtgtatcatctagttgtttaaatggagcgtgcctgctctccacccagtccctccaccctcgcctcctctgccacgactagggtagagaggctgaggggttatttattctccagacactttgttaaaactcctagctcctctgaggcagcactgagactggagcaagaaggtagggagctgtgagatgagatacgcagctgctctgagaggagagaatcctcaaatgcaggagggatggacagactgctgctttctatagcttccagaaagagcatcagtttccttctgctttgaaagctcctaatgctgtttaagtggcagccctctctcgtgtggctatgctgaggccttggtgctgaatggactgtcttgtctcatagaatgattttaaccagaccctggaaagtagcaaggcagagaactggaccggcactctggactttctctcctcaactgtcaaacagaaggtggaggttgaaagagaagcttccccagggttttttggcaccctgcccagatttcctgcccaactctcagcatcctatgattaatgggattcccaggttggggatgcctctgaatgccgcccccccctccctgccccactaatctaatctcctcacttaaagataggagggagtggaagggagaagctgcagggaatatgtgctaacatcagttacaggcaagcctgtacttacacagagatctgacattttaaaataaattcttgagcactctttagacaaactgcaaagtttaggaaagtgtgcaatactccttggctcattggccccaggaattggagcctcacttcttattataccagaacctcctacccaccttttttgccctgtccttttcctgccttggatgatttcccagatgattaatttttttctctaatcttttatctaatgacttcttttttttttttttttttgagatggagtcttgctatgtcacccaggctggagtggagtggtgccatctcggctcactgccaactccacctcctagattaaagggattctcccacctcagcctccccagtaactgggattacaggcacgtgccaccacgcctgggtaagttttgtattttcagttgagatggggttttgccatgttggccaggctggtctcaatctcctgacctcaggtgatccacccacctcagcttcccaaagtgctgggattacaagcgtgagccaccatgcctggctgatcttatgactttttttttttttttttttttgagatggagtcttgctctgtcacccaggctggagtgcagtggtgtgatcttggcttattgcaaactccacctcccaggttaaagcaattctaccacctcagcctcctgaatagctgggattacaggtgcccaccaccatgcctggctaatttttttgtattcttagtagggacgaggtttcaccatctgggccaggctggtctcaaactcctgacctcaggtgatctgccggcctcggcctcccaaagtgctgggattacaggtgtgagccaccgggcccagcacaatcttatggcttttaagacattttcttttatgtgaagaaagctggttagataatttctattcttcttcctcaccaccgaaaggactcagactaaacaagtttgggcattgagggccaaactttgcttatagaaaatctttactcttgggttatcacatcactccatggagaatcaagacagtctaagcatagtccataagtaagacagagagcagggccttggggccatacaaatgcattcatatgcgctcacatttgtgtgtgtgagtgaatgggtttactcacacatttatgcaccaaatgtgctactatggagggatgaaggctgatcattagtgctgcaaattgtcttaatctaaagatgacaagttctagcaataaagaaaaaaaaaagctataaatctttctgtgtgcaagtcatcacgtccctgccttctgaatgtttttgtcaccatgatgcaggagccccttgttcttgccgtagagggataattgatgtgtatgaatattccagaatggaaatggaacagatgtagaaaataatggctcagaataatatttttgcacataagagctgagcctttggtaacgagagacagttaggggtaggggatggcgttgctcaagatgagctgaactgtaagcaacaattaccaacctttaaaggcaagaaaatgccctgccctccctccgccagcccttggagttgcctttgcaagagcttggatagggaggagtgtgggagctgatttttacttcccccagctcagcacctgctagggtttgcccctggtttaaataatgcagatctaaaacagattgagcttcattaactgtggtcctaaagaaagcaatatatattacatcatttcccatgtagacatgcatatatatttttttaaaacatgagaatacttctcatgaacttgaagattttcagtttcatttttttaaaagctagcaatgacccattaaactcctaaggcccactgttagattgagaaccatgatttgctagcagtatcaacattgtatctcccatctcccttgccacctcagtcaaacctaacaggagaatttactatgaatctaaagctagaatatccatatcttctctgttctctcccgcaaacaactcctcttgttctctcagcctccaactctctgtgtgtgtgtgtgtgtgtgtgtgtgtgtgtgtgtgtgtgtgtgtactcaggagcaagtaaacttggccttccaccccaccacacacacatccaacataagagaagctgaatttcatctctgggagggcttctaataatttattctattaagtatgatctgtgctgctattgttccactacctccatctctatgttcccattgggaagcagaattggccctaaggtttagggggactgacctggactgggaatcagcatcagaaacagtttttgcccagaaagagggtcttggtgctttcttttctttctctctgtctctgtctctctctgtctctctctctctctcctctcttttgccacacactgttatactgtggctgtctaggggagataggcatggtagttactaggagtgggtctccctccttcacctcttctcctttaacataatgctttttgcctttgtgtttccaacaggtcagcggacagattgcagtctagccaggtgagtgtggcctgggacaggcctgggaagtgatagaggcttggtgggtagagcaatcttactctgggagagagccaaggagttgagttgtaaaggcattgaatgactttacaaagcaatggcctggggcggggtttgtttacttccctttgccttactgaccccatctgatctcagatagaaatggggttttctgggactttgagaaggagctaagcagaactgagtaaaaggggttatcatttgctgaaattgtcccagagaccccctaacgccactgaattgcaagtaacataaacattcaactgtagaggattctggtaacctaaccttagctgctagacttcaacataggggctctggggagtctctgacccagagaaagaagatcaggagatggcatttgattttttttttttttaatgcccagaaaagaaggcagcccctaattagtagtgactgttgctggataatgaaatattacattgcattggctcgccaaagagtattggtagaaatatttgcctgatgtacaagtatgcacccctcccaatctttccccaccttccccttcctcctccaccccagccaaatattttccctctcagtcatggtgctgctatgagaaaatttgtgagctgtcggagagcaaggtattcattcatccagcagttctcagatgcctagaaatgtgctgatttaactagagaaggggctttaatgggttggactccttagagaccctgggttagcccattatatcaaccacttatatctgccaaaacacataataattatgaggccatttacaattataggttcattatttagagatagcttcatttggctttcattgttttgtcattgtgaattacaataaagatcccattaatataccagtcttgatgactggagggaaccaggataatgggattctctggaacacatctttttggtgttagagtcttactgtaagttcacctgagctcctgagtctgtggaaggctctgtaggactgaaaagagctgagttgaatttcccggtgctgagttattttgctgtgagaccttaggccgctcttttcccctctctgaactctggtttcctcttatagaagaccagagcactccactagattcaaggtgtcctaggattccaaaggggttcctcaggagtggcctggtggcaggggcagagcgatgaccagcaaccaggctctggtcccatccttcactcagagcaggacagccctggcctccttggtttgggtgttatgcctctgagtcagattccctttgagaagaggcttctgaggctaaacacagattggaaaacattgacctagaggattctcaaggttgtttccaaactagatgttctacactctaaacccagaaaaattgttccctgtaaagatagcgatctttaaggatttcctagagaaacaaaacaaaaagcatcctttggtgtttcccagtgtctcctagcaggcaaaaaaatcttcttattgtctagcccaaaaatattttactaaaaattgaaccagtcctctcctattctaattttgagtagtggtagacattaaaagcagggacgtctgtgcttttgtgaaaaaaaagagctttcgtaggctttattgtggaagtaatttatcaagtttcttagccatttctgggactgaactgagtaatgtcacatgtttcattggctaccacacagattttttttaattattaaaaactttacttctgggtttaagagtgattgtttatctcattcgtcccaattttctctttttctcccttgttgctggattggtccaatctgattcggcgggattggtcacaggcgcagctcaactgtgaggaaacaggtaagggcccaagcggggccaggctggtctggcctgaaaatatagtccatcccacaggcatttattgagcgccactgtgtgcaggacagacacctctgacttcatgcctgcatttggaatgtatcatttagtcatagtatgtttaatatggtggcaatgtcattgatttaactagttggagtggccatagtctttttgacttgtccctctcctttctagtcatttatcctcttgcatactaggggtttggtttcattggtgcagattgttccagaactgcccatggcatccttttccaagaccacaaaagaggcttgacacttcctacatttgtgctaacatatcagtaactcacagcacctaattagctagaccagacaatctcgctttaagttggcagattttgtttgattgtttccggtggcgtagtcattctagatggattcctaagacatgctaacaatgagaagattaagtctggtctaggaacgataggcaagggccgttcaactctgcaatttggtgcatgatcttcagtgttgtgttaaaatctgccactgggcagccagctctcattacccatattaggagggctcttagagagcagtggcatggataatccacatcaatggataatctaaacagcacttgtgcttgtttaaaaaaaattaattgaagtattttttgcagtagcaaaattgacttcctaattatactttatggcaaatactgaaatgattttatgtcccctaagctcataccagctatgcagtagacagcagggagggcgggtggagagagctcagaaatgtctttgtgtctgctcaggggaaagctaatccaggctttaaaaaatcattttgggtaattctcagtggctctagccacagggagataatcgaataaagagggcgcatggtttttatggtgtcggcagcaccggcatttcttcagctcatctgactgctctgacagggtggaccattaagctggggaacttggatgatacaggcctcgcttgtctcagctttgctgtcactattttccccttctctactttgaatctcgtcttaatgagtatgccatcagatgcaattacacattttttaaattataaaaatttaattgcaagtctcctccctctttttcctctatttctttcttcctcctctttcttccataatttcatttaaaactagagaggaatggagtgactcctagagataatttagtgcatttaaaattaataggtgcatatcttgcagagggagcaagccattttccctttaacactaagaaaagaaatgagcttgaagtttgttcttttcagttccttggctgaaaccaggcatcttgcttatagctggagcatgtttgcaaggggtttgcagctccactgtggctgcaggagtgccagagacatcagtttggcaggtgatatgtgcccttggttgggctcactgttggaggggaacagcacccatctggtttgcatcctgctgcacataagcagttgcaggcaaagtgtgtttgcctggtgctagatttgcgtaggagttacaagatataccaaaatccccaatccaataaagaccttgttttcattctgctgccccagtttctctctagcagttcatatctactagtggatcagcaagaagttttcctaagatggtcaggaagataaaatagatagtaagttacttggaaggtgagtaatcttatataagtaacaaggaaataattgtttgtttatggcaaatcaggcaaacaagaggaagaagctagtagtttttgtttttgagggtctttaatgggttccggtcatttttgaccctgtcaaagactaggtttaaaccatcccagaccttttttaaaaaggagacagtctcactgctgcttccagaccttccctgctccctgtaacctcagcattatttctctcctggccatgacttcatatcttctttgttggcctttctccattcctctaaattgaagcatttctccagggctctgtcctctcacgatgtctctctatattctttcctttgtcactcttgttcccttagatgaatctttctcttcttccctaagcattcttttgttctataatgctgtccttttgagtccaatgagtaattcctcagtgatcgactagacattcatacttgaaagttgtgatagcaccttctaccttcagcatcagtctcaccgtcccccatcacattttgatttgcgtagcccctcccttcacttctctgtttgtgttcggggggactccattcttcacagtctctgaggccccaaatcttacctttgatgcttttttcatcattactcacatataatctgttgtcaagatttgtattttctcccttggtaaaaatgaaaattaacaaatgtagtacaaataagtacctaacaaaaactctaaccctcttactcatgtgaaattatgccagataatgcatattcacagattttctggccacctttctgattttttttttttcttttttgagacagggtctggctgtgccaggctggagtgcagtggcacaatcttggctccctgtaacctccacctcctaggctcaagcagtgcacccaccatagcctcctgagtagctgggactacaggtgcacaccaccacgcctggctaatttatgtatttttttttttttttttttttttatagagactgagtttcaccatgttgcgcaggctggtctcgaattcctgagctcaagtgatccacctgcctcggcctcccaaagtgctgggattataggcgtgagccaccacgcccggccctttctgattgttttctcctgcaaattactggaccactgctttactatgttttccaacttaggccctacctttctccctctacttttggtttaaagttcccttaatctgattggatgagaatttggcctgattccttaaaggccccttctaaccctaagatttcattaccaaaaaataaaaaagtgtatgaaggaattaagctgacaaggatttctaacattggaggagggaagaagacagagagaaaggaagagacgaatagtacataaaaatgtagacactgctcagtcagtgctcacgcctttagtcccagcactttgggaggcccagatgggcggatcacctgaggtcaggagttcgagaccagcctggccaacatggtaaaaccccgtctctaccaaaaacagaaaaattagccagccatggtagtgggcacctgtaatcccagctactcatgagtctgaggcaggagaatcacttgaacctgggaagcggaggttccagtgagccgagatcatgccattgtactccagcctgggtgacaagagagagactctgtcccaaaataaattaagataaaataaaataaactcagttaactctatgcaagggcagtggtgaagtgcaggtcttcgtggcaccacaggagtgcacagacacatcccagggaaattaatttactcattgctcagaaacattataaggagagaggaggatggcaggagcgttcaaagcctttgtgactttgtccattttgtgctcctactggactcttagactccactggagcagtggggactagaaaaatgcctgtgcagtaggacaggtcatctttagcccacccttacctgccacaggttatccattgggggctgcatgtgagtgctgctggtaaccacggacatgcaggttaatatttttcttgccctgtttcctgccaaccctttgtacttgcctttaactaccactgatattccatttcctgcaggccaaattttgtactcacacaatttgttgaagccagtagcctgtaagctttccagctttcctctctctaggtcataatatataaacctaggaccaacaaaactatgcaaacgctcatatcactaacttcattatcactgctgctactattttttaataatttatattaatacacaataattgtacacacttatggggtacatgtaatattttgatacatgcatacaatttgtaataaccaaatcaggttaattagggtatctgtcatctcacatatgtatcattttttggtgtgtatgtattgggaacattccaaatcttctatctgttttgaaatatccaataaattattattaactattattatcctactgtgctatcaaacattagaacttatttcttctatctaactgtatttttatacccattaactaacctcactttttttttgttttgttttgttttgttttttgagacagggtctcgttctgttgcgcaggctggactgcagtggtgtgatctcagctcactgcaacctctgcctcctcaattcaagcagttctcatgcctcgacctcccaagtagctgggattacaggcgcgcaccacaacgcctggcttatttttgtatttttagtagagacagagtttcgccatgttggccaggctggtctcgaactcctgacctcaggtgatctgcctgcctcagcctcccaaagtgctgggattacaggcgtgagccactgcaccctgcccaacctcacttctttttttttttttttttgagatggagtttcactcttgtcgcccaggctggggtgcaatggtgcaatcttgcctcactgcaacctccacctcctggattgaagcaattctcctgcctcagcctcccgagtagctgggattacaggcatctgctgccatgcccagctaatttttgtatttttagtagagacaaagttttaccatgttggccaggctagtcttgaactcctgacctcaggtgagccacctcacctggcccaacctcacttcttgacccctcactccccgctacccttcccagtctccagaaaccgtcattctactctctgccttcatgcaatcaaattttttagcttatagatacaagtgagaatatgcagtatttatctttctgtgcctggctaattttacttaacacagtgtcctccagttccatctatattgctgcaagtgacagaattttattcttttttatggctgaataatatttcattgtgtatatataccacattttacccattcatctattgatggacacttaggttgcttccatatctcagctattgtgaataatgcagcaataaacctgagagtgcagttacactgatacttcaatatactgatttcttttcttttggatctatagccagcagtgggcctgctggatcatatggtagatctacttttagtttcttgaggagcttccatactgtttttttgcggtagctgttctaatttatattcctgccagcagtgtacaagcattcccctttctctgcatccttgccagcatttgttattttttggctttttgataattgccattttaattgtggtgagattatttaaaaatttgcatttcttatgattagtgacattgagcattttttcacatacctgttggccatttgtatgtcttcttttgagaatgcctattcaaatcatttgcccattttttaatcagatagtttggttttttgctattgagttgtttgagttccttatatattctagttattaatcccttatcaggtggatagtttgcagatatcttctcccattctttaggttgtctcttcactctgttgatcgtttcctttgctctgcaaaagctttgtagcttgagataatcccatttgtctgtttttgcttttgttgcctatgcttttgaggtcttactcaaaaaatctttgcccagaccagtacccttgaagcattgccccaatggttttttttttagtcatttcatagttcaggtcttacattgaagtctttaatccattttgatttgtttttctatatggtgagagataggatctagtttcattcttctgctgctattatttgtaaatgagaaatgtaataacagaagtctgtaaacataaaaagactccccccagattgagcttttctggcattttcatagtggaacccagtttcttccttagaatagggaagagaagacaaagattcttcccctgagatcaccctagcctaaccagccagtcagtgatgccgacaagaggacagacactggctgctgtagctggaaagctggaggaagcagatgggtttgggggtcatgaagatgagcatttgggtcgctgcgaccgtcctgacaccagctccaacttggcacatacagtactccctttggcatcatccctggttcccagaaagcttgagaggtagaggctaagccagcttttctctcagcctgacttttttgtgagacccagctgcttgcctaatagtggccaaaccctatggctacagtggcaaattcagagccaggggagggatccacgcagacctgtcaaacgggcagaagctacacagacccatcgcacttgacagtctggtctctgtcctgaacatctaaagccctttctagttaagttcggtcccctctccctgatctctttcttccacacagctgaattattgtacattcagctgcattataaaaccctactggtttaggccaggcacgatggttcatacctgtaatcccagtgctttgggaggctaaggcaggaggattacttgaggctaggagtttgagaccagcctgggcaacatagcaagaccctctatgtaaaataaaaacgtgctgggtgtggtctgggtacctgtagttccagctactcaggaggctgaggcaggaggatcacttgagactatttgctcaaggttacattgagctatgatcgcaccactgcactccagcctaggctacagagggaaaccctgtctctaaaaacaataaattaatttaaaatataaaataggccgggcgtggtgactcacgcctgtaatcgcagcactttgggaggccgagacaggcggatcacgaggtcaggagatcgagaccgtcctggctaacacaatgaaaccctgtctctactaaaaatacaaaaaaattagctgggcatagtggcaggtgcctgtattcccagctactcgggaagctgaggcaggagaaaggcatgaacctgggaggcagagcttgcagtgacctgagatcgcaccactgcactctgtctggcctgggcgactgattgagactctgtctcaaaaaaaaaaaaaaaaaagaaaaagaaattgtatatataaaataaaaccctactagttttgagtaatacttggtatgcacacctggcaatgtttgctgaatgcctagggtgcagtatgggtagtggcaaagtgttaggtctccgagggagattgcctgggtttgaatcctggttttgccacttgccagctgtgtgaccatagcagctacttaacctcactaagccttcatttcttcatttttcttttctttttcttttttgagacagggtcccgctccatcacccaggctggagtgcagtggcttgatcttggctcagtgcaacctctgtcctctgggctcaagcagtcctcccacctcagcctcgcaagtagctgggaccacaggtgtgcaacaccatgccaggctatttttagtagagacagagtctgttgcccaggctggtctcacactcttgatctcaagtgatctgctggcctcggcctctcaaagtgctgggattacaggtgtgagcgaccgcacctggcctcactttttcattttaatgagtataataataataatatgtactccataggattgttaccagcactagtccatctaaaggacttagtacatggcctcacacctctttaaattcctctataaatggtaggcactaatgttcatgtgttaataggaaatattactctccttgcctccagtcccctccccagtctgtagaaggcaaattgaggcccaaaaaagttcagtgacatgagccagactgtgaagcaaaacaacagagcaaagattgacatctgggaggcctgcttctttgcttagtacctgttagtccccactatttagagttagtttttcttttctatcttacctttataccaaacaaaccctctttctgaagctcccattggttcattctgctaccttcaactgagaataattgagcacctcttatgtgagagcatcatggccaaccctggacacccaggaattgacataggatctgctcttgtgaagtttgagctgtagtggtgacaagtgccaacaaatattcacatccacacattggagtcacagtcagggttgaggagaacatacccccagcaggagcagctcatgcaaagccacgaggcaaaggaggactttgcagaacagaaacgtggccagcatagctgtagcagaagctaggggaaagaacaggcagtggaactggaggcacaggcagtattcctggcatgcaaggccgtgtaagagagtaatgagaggtctttgaaagagtttaaataatgaaatgtgcccttttaagattacctaattactatgtgaaggaagagaaatgcgggtcagaagatggcaaggatgggaattgaggtattggtggattgaactaggttgggggcagttgagatagagagaagcgaatggatttgagagatatttagaaggcagacatgacagaatattaattaattaggtggtggagaaggtggtgagaaactggtttggggcagaagatgatcagttttgtttaggacatgctaactttaaggcatctgtgtagcattccatgtgggtggttgtatttttgtgctctggaacttggaggacaggccaggtgcttctttgtagaccggctggtgatccgctaagacagttctgcacggtttggcccgttttctctgaccctgggctatccctgtttgaatattctaatgttgtgtttccctttggcttttcaggactccagccaggcaattcctctggtggtggaaagctgtatccggtttatcagcagacacggtaagcaggatgacagccttgtccatatttgtgcaaagattgggaagaacttccaggaattctttgtagagtaagaatagagattgacttcccatcctggcattctcagaaaaggaataaattcttacttgtccacataacttttgctacctcaaaatagccacacctagacattgaaagaaatgcatcatatattttgacacaaaatgcctcagccacttatcacgcagcatttttttagcttgagagtaagtttgaaattgcagctgttatgtaaatacagctgctattatgtggtaacagtagtttcaccattactcacagtctttgcaagtgtgggtatctcccactgtacagcctgaccattttgtcactttctgtaccagactagtttgaaaacaactcctttcccaatgttgcagtgattcctaataatcagtttttgttctggtttggtctcactggatacagcatggccaagggctgagttagtagctggtcttaaagttgtatccaacttttgagaatctgcagaggcaggctgcttctcagcctaggtgaaatcatactctcttctacttggatgaagctgaatcttataaacaccattcctcaccagctactggtctcattggacagaatttagcgatcgaaataattgccagagaattgatttcccagggattagagtgtttataaaggacagaactagtgctatgaaaatttctaggaactgagcatcagaaattgtttttagatgctgttctttctgtgataggaaaaggggcagagtgacctttctggagctaaggaggtagataaaatattgcttgtctaaattcagaggcagctattctctctccctctccttgtctttttctctccctgtaaactgggacattgctcaggttcatttttggaatagtaattattatagcatggttacaattgatctcattctaatcagctataatttttaaattttatccctattcatttaaagtaacagcattgtatatcagtattgaacagtcaacaaatttatcaagtccctgatcaatgctgggtaccatgcattgccatgcaggaaaacagaaacaggaataatatactcttcctgtctttaagtggttttgtgatgcagttgggagaaataagtaagcaagtgataagttaaataaaaagggataagctgtggtaattcagaatagagtataagaaatttcacaagatagtaatgattaacagtcaaacagtttgcaaagaaaagtccaaacggagttcaggggaggatgaattatttgtgcctaagagacaataggaagaagaaagtctgagccactgttcattagcatacatttcattcattgaacgaatacatattagttgcttattatatcccaacaaaaagtttctgccttcataaaccttacattccactgaaaggtggataagcaaatgaccaattgatcagccagtaaatacagtatgtcaggtattggtgaatgtcatgaagaaaagtaaagcagggtgaggggatggagaaggaagagggaacactgtttgaagctggttcagggaaaaggcctctcctaaagtgacattagggcagagttgtgagggagtaagccttgtggatatctggggaagagtatcttggggagcgggaacaagtgcagagatccttgccatatgcaggaagccagcgtagctggagcagagcaaatgaaaaaggaagcggcaggagatgaagctggaagccagactcttagggcctcatgtgctaggattggattttattctgaggaagatgggaagccactggagaattttgaacagggagtcatctttttaaaggatccctgatgctctatggagctaagactgtaagaaggagacaggaagcaactgcagtagcctgaggaagacatgatggcggcctagaccagggtgttagctgtggtatttgctgaaaagtgggcaggttccagatattgtggcatgaatgtacctgtttctgccccttacagccacagtgcgtgagtgcttcaccattactgtggtgaagctctggggaaacaggcacatttatatgttactaatgggaatgcaaactgatacaactctttggaagggaatttggcagtatctaacaaaacttcatatgcacttacgatccagcagatcctaggaattctagaaatttgccatgaagttacatctccaacaatacaaaaatgcatgcgcacaaggttatttgtgacagcattgtttgtagttgcaaagtattagaaacaacctaaatgcccatacatagaggagtggttgaagaaactatgggacattcattcaatggagtactatataagaatgagtaagatttccttgaactaatatggagagattcccaggatatgttgttaagtgaaaaaaacaaaatgtgaaagagtctatatcatgtagaatactacagatgctcctcggcctctaatggggttacgtacggataaatccatagtaagttgaaaatgtactcaatatacctagcctagggaacatcagagcttagcctagcctgccttaaatgtgctcagaacatgtacattggcctacagttgtgcaaaatcatctggcaacactatacactgtagagtatgtgttgtttaccctggtaatcacgtggctgactgggagctgtggctctttgttgccgccaagcattataagagaatatcgtactatattttgctagcacaagaaaagatcaacattggaagtatttctcctgaatgcatatcattttggtaccatcataaagtcaaaaaatcataagtcaaactattgcaagtcagggactatatatatagatattcttttgcatttcattaccttttatataagagagaagaagatataagaatatccacgtatcttctcatttctgcaaaaagaaatgcaggaaggatgaatctaggaactaatatttaattggttacttataggggatggatggaaaaaacgtgaaaagaatggggcaatgggaaatggtaaggagtggcatttctcttaccttagtgtagttttgacttttagaacaacattagtgtttcctgtactcaaaagataaataaacaagccaagcatggtggctcatgcctgtaatccaagcactttgggaggctgaggtgggcagatcacttgaggccaggagttcaagaccagcctggccaacatggcgaaaccctgtctctactaaaaatacaaaaaaattagctgggtgtggtgttgggcacctgtaatcccatctactcgggaggctgaggcacaagaatcactcaaacccaggagatggaggttgtgatgagaccacaccactgcactccagcctgagtgatagggtgagaccctgtctcaaaaaaaaaaaaaagataaataaataaataaaggcagagtatgggtacaacccaaaatggaatgcagacagtaacatataaacctaactgtattacaagtgaataacgtaaccacaatgaagagaatgaggaagaaaataacctaagtaatttgtcttgactgtaatataaatctgaagataaaaagatctctaaacaaatattttacagtaattagtaattttttatcacacaaatatggattagcaattctaaaagtattttatatatattctaggatcaagcaaatatattgtggattttttaacaattgagcacatagtagctgctcaaaaaacatctgttccactaaattgatttttcccaaataggggcttaaggtgctcatgaactccctaaaaaaccatagtaaaaatttttgtgtataggcatctaatgaggatagagctcataacctgtgtcagtcttgaaagagtctgtggcccactgaatgctggggattttcacatcctaactatcctcaaatcccatgggaggtagacattatagtccccattatatagatgagaaagctcagtggtgggtgagggtgattcaggaaggcttaaaggaagagaagcgatttgaggaacaattgaaactgaatcatgatggaaaaaaacaaaaaaacaaaccgccattttcatgaggaagggagcaagataacgtgaacatgagatggctgctgtagaaatcatttgaagaattctccaggagaacaacttttggcaatggttggatcccgtgcacaatggaaggttttgtgccatttccaaatagcttagtccaagtctgatgagttttatactttcatgttcatgtgaactgagaaaaaatttaaaagatcatggatgtgtcactttggttatgtaaggattcgcctgcattataataaaaagccaactggtttttccctttactttctggaaaccagccacttattaatgtttctgcttctagaatctagagattctgtctgttgagcaagaacacatagtagtccctccaaaacataagttctcaggaggaaacagagaccagacctaaagagagctccatgtgttccaggcctgctgcctgatttccaatgagctctcctctcatttcttcttgtcctggacccccaggccaaggctgcttttccttggtgtcctaacctaccaaaaagtatcaagatgatgacgctctttcaagaatttgtgcaatggcttcaccaactagaacatagtgagtagcctggtttccgagatgacatttgcttataccatgttgtgacatgtggctgtttctctcaaagcacttgttgtttacatactatctttaaacaacattatctggcttttacatcccatttgtaactagtattatagtcctattacactggtactaatgaggttttaacattgcctgccactctgtgaggaatattctggagattcctttataggagcagacaacttaaggcctattacaagccaggtaactatatttcctctgcttactttttaatgttgtttcagttggattcaaaatatcagtcccggcctatgtggtttacctccaaaggtctaactgatagaattcatctgcctcctcactgagaaaccctcaaacagtgggcaaaatgtagcattagtccattttgttttcctaaaataaaatttgagatttctccagcatgtcaaggtttttgaaggattgtgccgtaacagagggattttgacagaatgcttaagattgagacccagggatcctgagaaaagctgagcggtcctgatgcaatcagagatgctagtccagtccaacccctggggctggcactgatgacacacttgctggatttctcacccgttttgcagttgtgtgtgtggtgctgtctgtaaagccatgtccatgctcagactgaccaatgtggttccagcctctgcacttgcactccagtagactccagaagcctggtgttgaggactgagtatgattgcagccacaaggcctgagtttgagtcatggccctggttcttacttcctgtataacttaaggctgactatcactcatcaatcccctcatccagagaatgagattgttgccaacctttaccttgttgtgacattattatttctgaggaccaagtaatttatttctgtgaaagcattgattagcagcagtcactatgccagcatttttttcatgatttttttctctaacaaaaccaagaaattcttgtgcacattatcgtagtataacattcatgcatgtttgtctttagagtaaagctgtagtcaggaaccagtgcctagcacaatgtctggcaatactatctgttgactgatcacttcatagcaagcttgttcaacctgtggcccatgggctgcagcacaaattcgtaaactttcttacaatattacgagattttggggggattttttttttatcatcagctatcattagaatattttatgtgtggcccaagacaatttttcttccaatgtggtccagggaagccaaaagattggatgctcctgacttatagtttcatgttctctctttttcatgagtattgaaagcattgcccccttgaacaatcaaaccgtgttaaaacagctaaagcaatattataatctcagaccttatgaaactcctctgatgagaactaatgccttgacctatttcccattcttttttttttttttctttgagatagagtccactctgtcacccaggctggagggcagtggtgtgatcatagctcattgtagcttctaacttccaggttcaagtgaacctcctacctgagcctcctgagtagctgggactacaggcatgctataagcactgtgcctggctactttaaaacattttttagagacagggtctcatgttgcccaggctggtcacaaactcctggcctcaagcagtcctgctgcctcagcttcctgagtacatttttctattcttgaccctagatgatttaaaaaagtaccaatgggtcacttctttgctttacagatgggaaaagagaggcaaaacaagggaaggaatctgcctcatagtcgcccttggagtcaaaggagtctctaacttggtgctttctagtgaaaatgaatgcctcgaaattattccagtgacttttccaacatccttgcacatgtttttctcctttggcctaaagaagagagacagcgtgcttaaatacatgctggctgggggagacagatattcaactaagcttggcactatgcttgtgaatttgctttttcttcttcttgatcacttttctgtgtatttccaggactacagcatgaaggaattttccgggtgtcaggatcccaggtggaagtgaatgacatcaaaaatgcctttgagagaggtaaggaaacagtcttgaagataaaaccaaatatttgccagccccctggggtattggctccaccctttcttctctaagaggtccccagaggtcaggaagccaacttccctgtctcttcagggggtacctgctgtcttgtacacattcccctgtagatatgcagagaaataccagggcacatcccagtttccttcttctttcgtagccctacccatcctgcctctttcacgccgatgatctgccaaaacccaagaagttaactatgatatctgggcggtttatggcttcatccggaacccttggtagcagttaatatcaaggctaatgcgcttgttcattgtagcccatttattattttgtgggctattaaggtaatgggcaagctttggcaatttccgtcactgtaatggatatatatagtgtcaatttgaggttggccctatcattaaatctaattacatctgatatgaaattttccatagggagctctggcatgattgttctgtaagtaggtgttcttggttgcaggccaggagacgtgagagccagtctcaggagctggcctccttggcctcatttttctccccgcaggggctcagtcccagcctggtttcatgattcttgtgagatacagttgctgtgtcccatcctcagcccatagggaatgtccctgagccaggctggcacaagagagtttatattggtggactcatctgccgtgctttggtcctggagcccctgaaatggagcagtctttgctttatctgttccctggtctgtcccactcatggccaccatgccgggcagaaagctgatggattgggaccaggacatgcatggttcaccccttccccacgttcgtcctgtgtgtttttgcctctctcactctctttccttttcgtgggggttgcttatcctcaggagaggaccccctggctggggaccagaacgaccatgacatggattccatagctggtgtcctgaagctttacttccgggggctggaacaccctctcttccccaaggacatctttcatgacctgatggcctgcgtcagtaagtaccattctggcttcagattggcttctgggctacagcaccggtagcaagagagaaaaagtttccacagggtctgtgtgttctcataagcttttcaatgaagtttttcttttccccagtgaaatttctcctcagcctcactccttcatcccctggtgggaggggaggaggaaagacttttcagtaagaatctaggaccccccaagtcagtactcctggcctttttttttttcttctgattcatctctgggctttatctttttttagtaaaatacctttattttcaattatgtatttgaagcttatacattagtgcttgtgcttttcatggtacaagggggaaaagcataagcgttgcaaatatttcatgcttgttgcattaaacaagacatggcttacctgctaaatgtattaatatgtgttctaggaacaaaagccctctgcacatttaaaagtagtaataggatattttcccaaagagaaaggtatattctctgctttatcctcttaggagttctctgcctcttactctaaaatttgggtcttgaaaagctattcctagccatttggtttagcttgtggtactggaacaccctctcatttgtttgccagggaaaacaatcaatggaaacttggattaatacaggtcagcctggaagcaggccctgtctgactgatggctccagaggctggagggagtggtacctttgaatggagaaaagatccttcttcctaggttgaccagatcttcatacctgctgagtttccagtttcactcagtatctgccctgagtacttgtccctctctgttatcctgagaaatgcccagggcatttgggaagctggctctctggtttgttttgttgacttctgtttgtgggagtctagtggaagtgagttatgtgggtgattaagaatgtgattcccttgggtcatgtctttgtctttttccgggactgggcctaggtgaagtatcttaagctgaactggggttgccaagacagttcaatatcccttggctgcccagttcttccctagagatacactcttcttcctaatccagtacttcccatctctttttcatataaaggcactcatagaaaatggcagtgtttacatggcacactgtggaagtgagaggctgcctatgatggaggacctgtaattgacctataattaacctctccacagcacaagaaaacctttcaggtctccttcccaatatcactacatacccaggggcctgctacctcttgcctcaggccactttttactcattcatagtgcagataagggagggagaagataagccacacttgtccagaggatgagatggcatgtgtggagtgagcaggacaggcctcttgcacagcctctcttcccaccgagaagtaggccctttgaggctttgtgttgagcagttacagcaggttggcggcagctccctgtcagtggttgtttgaataagagggtggtagatcctgtggggaacatttctaaccccatttcctgtgcccaaatccaaatccaaacttgttattaataacaatgagattacaacaaccctagttcagtttaatattaataatgtgtaataacgagtttggatttggatttggcacagttccctgtgcccaagaagtatacaccttacatccggcaatggtaaatgtctggagcccagcaggtgccctcttctaacagccctactccaaggagcaacagggatgacactcctgtcactgcaccagtgctgtgcgtgggcttgatctgatgctgtccgtgttgcccctgctggtagtagggacttctgatcattactgcctgggatcccagtcatagtggaggataacacatggctttcttcttttcagcaatggacaacctgcaggagagagctctgcacatccggaaagtcctcctagtcctgcccaaaaccactctgattatcatgagatacctctttgccttcctcaatcagtgagtagccttcccagtgaacagctggatcaggctttggcttgggcactggaagttcctctatggacctatgcctattcatccatcccaacaaaatatttattgagcacctactgtgtgctagccacagtgctagacttatttaatacatcgttaaataaaagatgaaagccttgatataatttagctcctgttccagggaaggaaacagccaataacagatatatcaggtagaataagtgcttagaagaaaaataaaaaagagtaaagagaggggaaagagtaaaggggtctgaatgaaaggagggagaagcactgtagttgaggtggacagcagaggcctgcctgagaagacagtgtacaagcagcagcccagaggaggagaaaagagtgccacggggccatttaaaaccccagagtcatggtaatagcgagtttggatttggatttgggaagcaattagaagattttctttttttttttttgagacggagtcttgctctgtctccaggctggagtacagtggagcgatcttggcttactgcaacctctgcctcctaggttcaagcgattctcctgcctcagcctcctgagtagctgggacccaggcgcatgccaccacgcccagctaatttttgtatttttagtagacatggggtttcaccacgttggccaagatggtcaccatctcttgacctcgtgatgtgcccacctcagcctcccaaagtgctgggattacaggcgtgagccaccgcacccggcatgttactatctgatttgtgtattttatttttttaaaaactgccaactgctttgtggagaagttactggaaagggtcatgaagagaaacagggagaccctatcccaaggttaccatctggtctggccagaggtgttagtggctgagtctggagagcggtgaggaggggtcaggtttgtgatacattttgaacatagcattaacaggatttgcccatggattatacatagaatatggagagagaaatcttaaattgttggcatgagcgacagggacatagggtggtcatttatggagttggagaagacaaggtgtggagaaaggaatcaagacaatgtgttgatgtggtcatggtcatttgaggcacttgtgagatgtccaagtggagattttgaacaattggacctaggaatccaacccttaagggagaaaccaggagtggagctgccagtgcaggagttgcccatgtactggtggtatttagctaatcacccagggaacggatgtgtctacaacaaaggtctgaggagcagagggggccgcgggtgtggatggggcatttcttctcgtccaagcagcatgtccttgtgtggagcaagctttggagtccccacatgacaggaaaggcaccaagcaaggacatgtgattcttcccctctgaggcacctctgtcttttcactttggttttgctgcagtttcgccctcaacagcctagaccaaaggttataaatgggcaccctgagagccagataaagccgaagatgtgttctcttcaggtgtctattgtgtcttgagaacaatgaaatcatacttacatttggggaaatttcactttttaaaaacctagatttctagcttcttttgaaaaattattagatctggtgatactgactctgcagtccctggtggcagcaattccctgtggagtaagggctgtactccctagatggggcaggcactccccaattcaccacagtccccagccctccccgttgtcccccaatcctgaggctgaattcagttgctatttatcatcactcttgttttgtggttttcatagagaacaaaaatgtttctctggatccatgaatctatcagagtaggggaaacaaaaggtaaaccaagggacccaggtgtttttgcacatatttctttgtgaaaatgaggagccttctacaaggttagtctctgcttaaaaggaatacaactttagagaccatttcataagtgtcagcttgcttccaagtttgtggtcaacctggccttataggtatctgggttagtggccccagcttgagaccttttctggggcacccacactatcatgtagcccccttgctggcccttcagagctacagagggtccttgttccccatcttgtctcttccatgcggttgtgtctgctctattcattggccaggccctgactcagcaccaccactgcctttgggttgaacaccccagtgagtcacacagcgtgttcatgtgcagcctggaaactctgctaattactctcgagttagtcccttcagggctaccagtcattgtctcccctcagagaccaatacctgccctcaacatgagcctcgtctgtgcccccagagctgggagcatgacagtggtgagcaaatggggatgaggggaaaacagggagggctgggggactatatgtgacagtacagtggggagaaacaatagaataagcatccatgcagggttgctgcttgcagagatggcagccactattgaagacagcataggaattgcaccaattcaaattattcattttgttttgcttttattgggtttttttctgattgaaacgagattgatttgctcatcaaagtgttaacattaaaaaaatgcagcattaataaagtgttttctaaaataataaatagaatgcaggacacaaatgataaagcagaccacctccacaggaagacagcagctgacaggtgtgcacttccggacaggggtagcaatagttggcaggtagctcccgatgcagactctgcctgggcccagaccatcaggaccctttttcttcattgctgtgagtcctggatgtatgtgtactttatttctggctactgtttgttcttggattggacacattgtcaatctcaaggaaccaaaaaagctaatatctcagtttctgtgggtctggaatccaagtacagcttagcaggggccctctggagaggtaattgcatatcattaaaaagttaaaaatccagaaaagtgcatgctaaaaagtaagtttcccaacaccaatcctggcgccccaaaaagcctctgttcctaaccacaatgctgaacctttttatgaagcacaaaagatgagttcaaatcagttaggagaattcactaataatatgaactgaaactgtagaaatacagtagaactctttgaggacatggcatgagtgactacaagtcgacaccaaaaattttaaagcagagagttgttactaatgttatccattttaggtatttctttgtttttattttgttgttgtttgtttgtttttgtttgtttgtttttgagatggagttttgctcttgtcccccaagctggagtgcaatggcacaatctctgcttacggcaacctctgcctcccaggttcaagcgattctcctgcctcagtctcccgagtagctgggattacaggtgcatacctccacgccagactaatttttttgtatttgtagtagagacagggtttcaccatgttggccaagctggtctcaaactcctgacctcaggtgatccacccacctcgacctcacaaagtgctgggattacaggcatgagcctgtaattacaccgcgcctggcctagatatttctttaaaaataaaaatccagttttttatactcttacactagacacagccttcagggacttcaaagattattaacaccatgacattttacacaaaactgtgtgcatttatatgcgcacatatgtgaatttttctggggagagaatccctagtttttgtcaagttattgaaggaacttgtgtcccctaaatagttaagaaccactgctttaggacaggcgcagtagctcacacctgtaatcccagcacgttgggtggccaaggcgggtggatcacctgaggtcaggagtttgagaccagcctggccaacatggcgaaaccctctctctactaaaaatataaaaattagccaggcgtggtggtgcacgcctgtggtcccagctacttgggaggctgaggcaggagaatcacttgaacccaggaggcagaggcctcagtgagccaagattgtaccactgtaacccagacaggcgactccgtctcaaaaaaaaaaaaaagaaccactgcttcagcccctaaacttagatgttcccactgtatattggaaaagaaaaatggattttcatctgtattttgatgggagcaagaaaatagacctagaatcatgagaccacagtccacaaagatgtgtcctcttcaagctcctggtcattgtagccacctatgaattgaacagttcttaccttagcaggcttcccaacattcttcatcttccacagagctttgactcaggactctcaggactagagtttgtttccctttgaccatcaggcttcccagacactactggttttcttttatgttaccaaaacattgtcagatcactctaaagtatcaaggccttcctcctctttgtccctccatgacaccaggaactggccagccttggattagctacagcttaagcctgcagcacctcatgcctcagttgtttgctctgaggttaccaaggtaattatcctcctgtccctccccagttttaatttgactaggaagtagacttagaaacttcccctagtcttttctaaatctctgctctctttgaactcaggatccggggaaggattatacacttttaagaactcctgtgaagcaatccaatgagatttgtaacctcccccgttgctggcctctcctgcatttgattccaggctctagagaacagtgattctcaactcttttctcccatcacgtccataataccactcttcaagtcctgcagtgattcgcaaacagacagggggtacatctccaggaggggagagaaccactgagtcagagggtaatgggctttgtaatgtgaggctggatgaggggtacactacagaaacaaactctgcaatcagttctgaagaacagctactcagatggagacagctgagtctcaggcctcgtttcccaacagaggacctttggttccttctcagaatcaaatcctgcccatgcctataagggagactcctcagcagagctcacagctctgcaggctgtgttggggaggtatccagagctggcccagccctcaatgcctggacgggcaaggcccaatgggactcatcaggtgcagtggctcattgaaggccttgggtccttggccaaggttggaggtgtggctggaacagctgctggctgagaaggggagagttcccagaataaataaatacccgagaatgaagtcagcctgcatccagaggaagcccgagcagaagccaaatggcatgctgaccttttcctgaaaaaatcctgaatgtaataatatagaaggagattatgaacacgaaaaacaattgcatttgctgttctaggaagaaattcactggcttgatggaatacaaaagctaatcagttggctatttgttaataagtctagaggctagaaaggaatatccctaataatttgattattttgttatgcaagaaggtacacaatgcacagtgcctgtgcctctgaccatatctttaccagggcagcctgagggtccccgtctgccctggcagcttagtatgttggtgtgtagcagccatattcagctctgcagagtgacatgttctcaaggtcatgtggcctttgatagataagatccggggatagggatgaggatggggtggtaagtagaatttgaaatgggagctggaaagagagaagggatcagagctgcaagcaagtacctctagtttgcatttcctgagctcctgaatgaccattctggttgtcagttttctccccagcttactttctggaaagtctctgacacccagaaaggcaggtggcaatttgtggaccttctgcttttgctcttggcagcgcctcctgtgattgtgttttctgggcattcatgcgagagctttccagcttgccccctttcccttctcctccagtttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactggtaggggggcttgggacgggaggaggggagggattcactagcacacactggcatgggagccagatggccacacgaaaaccaaagggaaacacccagatcctcccaactcctcactcccaggctgctagggtctggggatgctataggcagcccccacctcggccccacccacagactaaatgccacttcttgccacctccctttttgatgagttctgagtggcaagggactattctgaaagatattgacaacattaattgtgatactaatctctaagaaaggactttttataaagttgcatctagaagtgatctttattcatcaacagtgtctcttgggcttctactctgtgctctgtattctgagaaaaaccatcctgggtcccagggaattcccttccttttgggaagagtttagataaaaggcataatttcctgaccgtgagtttgtaagctggcacttcagaatgattttagaaatttgtgaagagaaagaagggtaagccttgtttttggcaggttagggacagtcctcccctgaagcagcattccattctgtggggccaggttttccatgacctagcttcggaacagagatctaaaaggaatccctgggatatatgtttgctagacccctctgtttgacaaagaacaaatcactatttctattttatggatgaagtagctgcaacccagaaaggccagtgacagtattttaggccactctagtgatgggaatttaaccccaatctcatctctttgtacagggtacagtccgttaccccatgccacccgccatggtaccatttacagcgtcgttttttcactaaacacaaagacaactgcctctctcttttaatccctaacgtcccttacctccccctcctcctccccctcccttcttcccctaaatagtatttcagcctgagctgaaagcacaagccagcccaaatcggattctgtctgaattcaacatctggaaccaattcggccagccccattgctatcgactgaggtaggggaggacaggggaggttgtttacttaattagaggccaattggtccacgcttctccctgacccccacagaacagcctcttgcccaaggagtgaagaaagtggcatttgtgttctgtgaacttagtaataccagtgacatccctgggttcatccctctctgctgtactgcagatttcagtgtctgggtccaagctggaggaacctatgctggccagctgggagagaaagctttttgtcaccgacagatggttggtggtgactggggaggttgttggtcactttaggtctcagcctactggatgatgagctccagggagctgtccttgtgcatgtgacttagagctttggttttcccccttgcatgagtggtgaaaagctgtagaatagcattcccttccttctaaagtcaggcagaacctccgccctcacttctcaaacatcaaaccactgcaggctctggtccagtgcccggggcacagagacccctacagccctggcccctgagtcccagcccagtgggtcagagtcctggaggggtgtggctcacggggacaggtgccttcctccagtttcctccaagatattctcccaacctaccccctgtttcttgtgcactcaacatttattagcagcctctggaaaaaccacaagattagtcagggaacattactaccgcagactgtgtgggaggctagaagcacctgaggaacaagagtcagcaaccttgggttgagagggaccttctaaccgctggattcacacccacctggaaggctcatggcctctcctctcccttctttgggaagtgagagaagtgccagccccgggagctaaggcagtaaggaggtgagtgagggtggtagaaggggagatagagcactaagaagagaatggagaatgatcaggagacccaaacagccatggaaaggagagcaccaggccacatggcctccccacagctgtggagaggagagacaaatccatttcaccacactttccagtcctgaaactggaaccggttttctaggactaccggctgggtggcatggtggactgctcctgagacctcaggtatttttgggtctggtgggtgcacaagagcaaaggctggggatggagtgtgtttcaagagaatcataggattttagggctagaagagacctcagaaagcatcctcttgcctttctcataaagcagtggttttcaaagtgaggtccctggaccaacagcatctgtgtcacaaaggactggttagaaatgcacgttatttggctccacccagacccagtgacacaggaactctgaagatggggcgctgttttttaacaagccttccatggctcgctgaagtttagaactgttgccttactggctggctgtgtaaataaacttgaagccctgagggaaagtttgcctttgaacctctcccccgccacccccaccatctcaaaggtttccagaacattacaaaattcatcagattcatcagatggtttttagccctagaaaacagtgagaaattgtgcctacattttttgacaaagaggaatctccgtttatattcttctagaatgttctctggagcctgggaaacctccttggaagtgacttgctctacacaggacgagttctgaactggtcacccagtctttgaggaacttcccaggagtgtaggatccatcccatggggaaagaggcttgagggttccaaggtggaaactgtgcggccaggctgccaggctgagtgggtgatggtgctttcacacaactgcctggaaagcctcacctgttactgcctactaccagaggaagaactttagaaatgaacagtttctctacttttcaggaagtaagaacttcctggtgcccatcctcatgagttctgaagtccatgagccaggagatcaggaatagaaatgactttcctagtaacctctctatcatttctcgattccttacactggatgatttttttttttttttttttttttttagacaggatcttgctctgtcacccaggccagagtgcagtggcacgatcatggctcactgcagcctcgacttcccaggcttaaccaatcctcccacctcagcctccagagtagctagaaccacagcatgcacactggcttttttttttttttctttttttgtagagacagggtctcattaagttgcccaggctggtcccaaactcctagactcaaatgatcctcccaaagtcctgggattacaggtgtgagccattgtgcctgacctaccctgaatgattttaaatttcatgaattatttcaagaacttgacccagcttctctcccctgccctccaacccataattggatcctgccctgtagcccatagcagattattcctcccctacttttgtttcccaccctctcctatgactcaccttccactttttcaccagttcacagtctgaactgcaaagcaacctagaggcatcaagcaaaatgagaaagaaggaaagcaagtactatttattaaacacccactctgtgccaaacttgtgactaaattactttattaaatcctcacacagctgaggatatagatctttatcttcagtatatagatgaggcagctgaggcttaaggagattaaataacttgcccaggatcacacagctaccaagtatcagagctggttttcgaatccagttttatctgatgccgaaacccagtgtttcccttccaccctgcttcccctttgaaaaccaggaatgaattcacatagagaatcagaccttgaggagttgagttgttctctattttctaaagaatttagtttataccttcaaaagggcttccctttgtcttgagatattctaagttccaagtagtctcaagtggtttttgtagcaggagctagactggaaaaactctagagctttgtatttcattataagcatttgtctattgtgtgcagttaggatatagagagcataagatggattcagtgccctcgcgccagggaggctgtatgaaggggaagacaagaattgtatgagcacatgttaatgtccctgtcactcttgcttctgttgcagtgatagccctcatggagagactacctcggttgaagactcaacccaggatgtgaccgcagagcaccacacgagcgatgacggtacgaggccctgcttcctggtcagtggggacgccaggggtgaggcagaaggaagcgattatatatcctgtgcatctgatgaacctgtctgcccagcggtcccctgagggcaggcagagagctccctgtctcaatttcatttccttccttccttggagaggtagcccaccttctcaaatagaatcgctcgtattaaaccagaggtgaggaactaggcctttcatagcccttcaaccttcttgctccacctcccagctccttgtctggcctgagtgcagcatgatgttggtcccttatcatagcctagactcctgccagacagctggagaacaaagtgaaggaaagtacatttgaaaaacagtaagcaattgggtgtggtggctcacacctgtaatcccagcactgggaggcccaggcgggaggatcacttgagttcaagaattcaagaccagcctaggcaacacagccagaccctgtctcttaaaaaaaaaaaaaatagcctggcatggtggtgtgcagcatccctgtagtgccagctacttgggaggctgaggtaggaagatcccttaagcccaggagttcaaggctgcaacaagctatgattgtactacagtactccagcctgggtgagagagtgagaccctgtctaaaaaaaaaaaaaaaaaaaaaaaaagtaagcctggggtgggaaatagcagagctggttgcccggaacccaatagaagcaagccagagggagtgggaatgaggatgcagaaaccacatgctttcacgcctaccgactggaaaaactgaccctttccaaagtacagacatgcgagtgccgagcagcctggtgggcgtgcatcaaggggaggaatgctcagctgtcatcctcaggcccctcagcagtgcccatgctttatgagggtctgtccagccagcacatttcccccgcttccaacagctccacacctcctctggatcacatgggctctggaagtctcagcagctgacaaggggcctcagaattttctgggcacaagaatgaaatggcaacagtctgtggagttttccctgttccctgccttgctgggaattctgcaattctaggccagctttcaaaggagaaaaaaaaaaaataggactgcttatttagatcctgatgtcataaggatccatatgatcatttgctacattcgaggaggggagtaggtgaactaggaaaatgagtagtgggttagagcctacctcgtggccagctctgctagagtctttatatatgttatctcttaatctgtagtgaaaaagatatggccgctattttacagttgagaaaatgcaggtcagggaggtcgagtaacgtacccgaggctgtagagaactaactgaggtgggtatatttagacaggccttctctgaccagcctcctatagtgaaatctccaacccctcctgtgcaggagcagacccaccagctagggccatctaggcatggtcttatttttaagcagcctttctctctgcttcccagaatagccgactttcatctcaggttccagctttctgggagccttctctttgctctttgatctctacctgcagcctagcacagacgaagataatgataacaataagtcgtgcacacataccacttactatgggcgggacactgttctaagcacttttacaaattgtaattcattgactcttcataacaacttcatgaaaaagacacgattattaatctccatgttacagatgaggagacagaagcccacacaaaaataaagatagattgcattcgtagaccccttttacttttttagattactttcatgtgcatttttttcataggttggtcacaaaatatattttcatattttgctccttggaaagttgattgggcaagttattttctctttatagagagacagaaagctcacattctacttactagggggaatggataacataaaatatttagaatacatgtatgtattctaaaaaatgtatgatacattttctacaattactggaattattatataattagaaaagaaataatgcttaaaaatatagtatggcaagtttgatgatagacgtcaaggcatgaagatctttggaaacaccaaagaagttactgtagaaagcaggggatgcggtcgggcgcgtggctcacgcctgtaatcccagcactttgggaggccgaggcaggcagatcacgaggtcaggagatcaagaccatcctggctaacatggtgaaaccccgtctattaataatacaaaaaattagctgggcgtggtggcacacgtctgtagtcccagctacttgggaggctgaggcaggagaatcgcgtaaacccgggaggcagaggttgcagtgagccaagatcgagccactgcactccagcctgagcgacagagtaagactccatcccaaaaaaaaaaaaaaaaaaaaaaaaaaagggatgcttgagttgtgttttgatgtgcttcatcaggcagataagagagaagaagattcctggtggagggaacagtgtgagcaaaggcaggtaaaaggtgataccagtgctttcaggataatggtatagtctgcgtgagaattacttgctttatagatcatccatggcttcgttttcccactaagtaatttcctaccactgtaagttcagctaattcagcttttccacccagtttcctgagtctgcaggtcccaagaacatgtgtttacttcttttccacccttctcagaatgtgagcccatcgaggccattgccaagtttgactacgtgggccggacagcccgagagctgtcctttaagaagggagcatccctgctgctttaccagcgggcttccgacgactggtgggaaggccggcacaatggcatcgacggactcatcccccatcagtacatcgtggtccaagacacgtacgttgggcccatggcatctttgggggtggtccccagctgctctatgggaatgagacttcatttctggagccataggactatgagggaggccaacccctcgggggtccagtgcagtcctgaggctcacacagttccttgaagagcagcccccccaccccccgccccactccctgcactcagtggagaatttttttaaatctctccactatctgtgccccctgcaaatcaccccctaatccagtcattttagaaacctgccagccagccagcactcatccatatttatacctgatgagtgataacaaggggtttttatttgaccacctatatttcttttctcgaaagatcaggctgggaaaacatttttgttactctcttttttttttaaacaactatgctcaccccaacctgttgagccactcttccacttgcaaattaaaatgactggttttctaggagaaatccggcttaagcagccttatggaagtgacctagttcatttaaccgagatgaggttgatatagggtaagatgggggaaggagggaaaaggatgtcaaggaacaaaggaaacctgaactggtcccagagagatctcatctgataggctgttggttgattctcacactttgaagcagttgtcccgtgggcccacccaagcctgccccctgtccgtttgccctgtctctgtccccagctcccctcccttggatacgatgctgtcagtgtttttagtccttcccttaatattattttttaaaggttgatatcctgagtgagtctgcaccctcccagcctcttcccggctcgttctgcagggaaatcctccctctgttgatagcatcgcaaacctggtggcaatctgtgcgtggacaggaccctcccaaatttagcattatgacttcaccacaggatcaagagaagatgaattgtgggggagaaggggctttctttgtcatcagtagccagaggggccaggagagcagtggagagacctgggaccggcttggatgctctgagcggggctagaggcgctacgacagtgtgtggcggtgtcctgccacgacgccgccgtctccagagccaccacacagttgactgtccttacccggcagtgctcaggacctcagccgataaaccacaacctggacttgccgcctccttctccaggaggccgccccagcacggcctccccaggaagcagcatggggtagaaggcagatgcctcgaatccaggtgtcccctagccacgctttcctgaggagctgaggagcccgcagaactcagcggattatttatttttatttaaacgacccttcaaaggcccttaggtttccttgcctctgctcacagaactagtccagccaggtgtcgctgctgcctcagagctgtgtggggtcgcgtgtatgtcggggggccatcttgccgatttaacgctgctttttgtgttgttgttgttttccctcctccctgcctgcctgccccttctcccccagcgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaagtaagctctgcttttcattttctgctcccctgaatgacttgcaacacccagcctcaccctctggcctaacccccatctccattcctgtgctgcacgtagggctcccagctcccccagcctaacagtttgcatgtggtcattgctgctgcaaggcggacagggctgaggatgctgctacaagcctcggggcaggtccaggtctccagctagctgccctcgtgctgtggaagggtgctttactgtgtgttcccgcagtgtctgtccacccagacctttgtggcagtcttacagctaaaactttgaccaaagctttggtcactttatgcaacctggttttgtactgtttctcagaggtgccttcttttttccaatccatactcaaataatagtctttgatgtctgtcttccttgacccgtgttcgtgcaaagattcagagtctgtgtgtggcttctactaggctgatgttacaccaggtgggtttattgagatatcatgtgtctgttcctccccctgtcctgcattcactcctgtggaggaaaggaggccacgatgtccctaaggaaagctttgtcctgagctcttcattcattggctaacccctagctcccttttcttctgccctttcacaccaggagaaataattttccattttgttcctattgctttggccttttgtattattctacccccttagtccctttgcagatccccactcctgctcagcaggctcttacctctgacccccagctttcattgtggctgttagcaacatcctggggtttaaactccacccacgcccgatctggctgtctagagggattctacgcctgcgtgctgccgcctccccaagaggcattcaggttattggagaactaatctcatctcaaggggccagacaccaagtcccaaagcctacagacctctttccgccaggccctgaaacctggccccgtgccagcaggatgacaagccccagggcgctcctgatgaatatggattggagatgatgtacagtttttattcccctctggcttttgaggaatgaaatgatttgcactttgaaaacctgttaaccgtagcctctggacactgagactggaaggagaataaaggatgcttgttgtttttaaacta

SEQ ID NO: 2065 - DNA, 14647 bp, Homo sapiens
tatcattcggccctcagactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacaggtgagaagacgtccccgcactgtgttcagctgggtagtcccatgccctgcaactcagggctgctctggggtaggaaagctgatggggaggtgaagaggaggagaagctgagggcttgcgtcaatgcatggaagagactcatccagtgaccgcctgtgtatggccttaatctccagtcctcaacaagtcatcctcctgcctccacctccacggaggtgccttcccaagtcccaggggtcttcttgtgttgcaaaagagcaggaacctgcagttgtggtttgtagctcaaagcgccccaggacttccccaggggactgaccatcactgtccccaagagtttttctgtccctttaaatcagcccttcgtgatgttcatgtaaaactgtagaccgccccacatctcccattttcctagatctcaaagacctcagctccaggaggggagccatttccactctaagattctaagactctatagggcagagatgaggccgggcaggctgagtggcagagaggacgctgatcccacctgtatcctgcgtgctgtcttgcagatccccccctcccaccccatcttctctagttggcccctgagaaaatgggacgagaatggggggaagagggaggcagaagtacatctcctgcttacatgggggtttgtctccagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatgtgaggcctcctggggtcagggctggggagaggtgggagcgggaggaaggcccagcattagggcatggccagtgccacatcagtagcaccgaaggccattgtggatttcttcacttggatgatgatccatggggactgattccctgggtccccatggagttggctaagcaggcccccatgtacccaaatgtcagagttctctgcagaaggaaagggctgggagtgaaagcatcatcccacactgaaggcccctgcttctgctctcagctgggcagcttactggctgtgtacccttaggcaagttacttaacctctcccagccccagttccctggtctgtaaaacagatggttcttcctccactgcctctcctacaatgtatttataagaatcaggttagtgcaagtaaaatcaaatgaagtagccagaggcttggtttgatttcctccttcatggccatttctctgctccttttaccttttattttccagcgttgccacttcctaggctctgtaaactccagtctgtattaccccaggctctggcccctgggagctttcccctggcttcctggtgagcacccttgtccctccccaccacccacaccctctttccttctcactcttccttgcagatggaatacttcggcactatctccattggctccccaccacagaacttcactgtcatcttcgacactggctcctccaacctctgggtcccctctgtgtactgcactagcccagcctgcagtaagtggggccaggagcaccagcagagaatgtctgggggctagtcctgggaggccaagcctggtactctggggaaggggggcttaggttccagaaactggccatccctgccacaccagcttccactctccatctttgagtcagccgtggaactgcttatagcagagatagagcaaagccaaggaagaactaaaatgtggctgctgtccaagagagtaactttcatactgatcagaattaatagaaagaaagccattgaaaagagaaatctttgacataatgactcacttcctttggaacacccaaaggaatgtaggggaagtttaatttaattggttatttctgagcagggaggtgagtcgggttctagtgtagatagtctgcttgtttcaaggaggcttggtagccttatctcctggtgcacacaggtggggctggtggggcacaatggcatgggtgggtccatttgtccagaggtaactcagaagtttcagtgaggattggaaaagaagagctacagaaagatgtcttgttcgatacaggacaagtcccagagacagaatgtctctggaaaccccaaggctagagatgtccatcggttgggagaaaagttgggagtaatttcctggggcaattgtttatccctgagtttcttttgaagccaacctctgacccacaatgggtggcagggactgtggctggcgcctgataaatgacacttatcttggtgtgcctcatgaggtcattgtggacaatcaggtttgctcagggatagctatttggtccccagttaggccacatctgtagctagagggaaatgtagttgttcattagggaggggcatcaccaggcttctaggggcccccactcagtgttgagagctgagggaagagaccctgccgctgtggggctgggtggcattagggcagggatgcagccagtgagccgatggcataagcaagagcagtgcacttctttccagagacgcacagcaggttccagccttcccagtccagcacatacagccagccaggtcaatctttctccattcagtatggaaccgggagcttgtccgggatcattggagccgaccaagtctctgtgagtgcaagtccttcattttttctctcttggacagaaacttgggagacttattcagaggtcttacatttcaaatctgcctcaggaatgggtggaaacaggggttagcactaacttctaggagaaagggcaagcaacactccccacctgagatggtggcagtgggtcagtctccacagcacgctgggccctgggggagagcagcacagggggactctggcaggaagcagtgcccagtgcacaaagcctggtggcagggtgcacagctggatctccagtctctagggcattgaggagataaaaccacgtctccgtcttgaaggataaagaagtccacaccagggggagagatttggactcagtaacataagggggcaaggtctgaaatgggagtccaatcacagaggcaaggcagaagcccagttgtccaaaggccaaggtccaaactgaactcagtgctgagctcatgagctgttcctcaaactccctctgacctctgaccctctgactccctctgaagtcctatgggtcctagaactatgggaatcagacaaatgtggggacagagagccaggtactttttcaggcttatagacagcaatatatgcctgggccttgggagaaagagaggttgacctactcctggtgaacgttggtccctggggtattcccgaggccagcagggcacagccttcatcaacatcccttagagtgggtggagtaggacatattatcaactgaaagaatgccagaagcagaaaaacaccatctatgtaaaaatatcatacagataaaacaatgtactgtattttctattggaactatgtatgcgtgtgtatacacacattacatatataatatataatatataatatccatatatgaatatatgtaatatacagtatatttgtatatataatatatatccatctgtatatattatatagatacaatatgtaacatattaaagtatataataattgcataattatatcatataatacatgttatatattatataattaatataatatgtaatacattacattaatatatgttatataatatataatatattatagaatataattgatataatgtattatattaataatatagtatgtgttatataatatattaatatgttgtatgtaataatatattacataatatattatgttaatctattatataatagattaacctattatataatagattaacataatatattacataatatgttaatctattatataatagattaacacaatatatatgtaatgtgtatatattatgttatatataagattctatatatattatgacatatacatatatattatatatctaattacatataatatatatataaaagttaaaatgactattttgaaggctacatccctaactgatcatcacagtaacctctgagatgcagggaagggactgaaattagcatagaaaggggaattcaagcctatagcttgtcacgtatctgttggctcacctggctggtgtagggcagcagccaagcccacagcaatgtcagctgcattgctccttccctcagtttttctggctccaggaccaggtgtgcacttacctctaacaaatcatcagcttttgctgcataacatccccatcattgaggctggagacttggggacagtgagagaacaatgtgggttccagtccaccctcaccctcatgggttccaactggccctttttctcccacttgacatctatcttccctttctgctgtgcaaactgtagactgctgctgcagcatcaggacagaaacagtatcctaaagtacactgtttaactagcacccacagttgcatataatcaatatctatatccacatcattatagctatatctataatctatagtacctcctaatggttctgcttctcttatcaaaccctgactgacataataaagatatgacatgtgaaaatttgtagatgaagctgatgcagcccttaaagggaccatttagcctaaaatgcatgcgttgttaatagaaatgctaatgatcaattatctaagctcctatttcaagaaatgaataacaagaaaatgagcaaaccgtaaacaaacaatagcaaatcaaacccaaagaaatcaaaaggaaggaaataataaagagtagaatgggacacaaatgaaatagagaaatcacacagtacagaaaattaacaaagccaagaatgaactctttgcaaagagtaataaaattggttagcctctcacatgactaaataagaaaaaagaaagaaaatacaacttaacaatgttagaaatgagaaagagaacattagtaaagttatcaagaataattttatattgataaattttacaattttcagaaaatcaacaaatgccttgagaaatacagcataccaaaactgatgcaaaaacaaaaaatagaaaatgtgaatcttttaaagatatactctgttattaaaaaatctttccacaaagaaaactccacgaagaaaagcctcactgataaattctctcaacactaaaaaaaatcagtctttcacaaactcttccagatatttgacaaagtaaaaacactttataactcattttatgaaaccagcataactttaataatgaaacttgaaaaggacattataacaaaagaaaatataaaattacagaccaatctcttctctcatgaatatagatgcaaaagttctaaatgaaatactagcaaataaaatcttttggtatataaaaagatcataccaagggtcatctttccaggaatttatcatttaacagaataaaaggagaaaaatcatatgaccaatatgattatattagtaggttaataacattcaatatctattcatgacttcaagaaaaactcttagcaaactaggagtagaaagtaactcccttaatctgataaaaatgaaggacttcatctaaaagaagcccacagcaaactttatacttaatggtgaattgtcgagagacttctccataagatcaagaatgagacaaggacactcaatctcaccacttctattcaacattgtactgaaaatcctagccagtgcaacaaggcaagaaaaaagaaataaagaacattaagatggaaaaggaagaaataactctgtcaatattaatgtatgacaagattccataagtagaaaatccaaaaatatctacagaaaggatattgggattaatatgtgaacttagcgaagttgctggatatgaggtcaacataaaaaaaatcatctggggccaggcacagtggctcacgcctgtaatcccagcactttgggaggccgaggcaggtggatcatgaggtcaggagtttgagaccagcctgaccaacatttctctactaaaaatacaaaaattagccaggcgtggtggcacacgcctgtagtcccagctactcaggaggctgaggcagaagaactgcttgaacccaggaggtggaggttgcagtgagccaagatcatgccatggcactccagcctgagtgacagagtgagactctgtctcaaaaaaaatcatttggatttatatatacaggttatggatccttatcccaaatgcttgggaccggaagccttttagatttcaaattttttcagattttgaaatatttgcattatacttaccagtttagtatcccaaatctgaaaatccataatctgtaatgctccaatgagcattttctttgagcctcatgttggcactcaaaaagttttggattttgaagcacttcagtttcagattttcagatttgtgatgctcaacctgtagcaagtaaaacaaatggcaaatagatttttaatgacactatttataatactatcaaaaccatcagctactttgatgtaaatttaacaaaaaatgtgcgagaactctactctgataatagcaaacattactaaataaaagtaaaagacttgcataaaaatcacaaacattaatgaataaaattaaaagaagacctgtattgaaaactaaaccatgctcatagattgaatgactctgtttcattaaaaagtcaaattttttcaaattggtctatacaaccaattttattccaatcaaaacaacagcattttttcttagacattagcaaactgattctaacatttatatggatatgtaatacaccaatacaatcttgctgaagaaaaacactggtaaatattaagatttattataaagttacagtaatgtagacgtgtggtgttggcacagaatttaaaaaataaacaaatgtaacagaacagaaaatacaaaactatcaacacagtcatctgacttgcgttgaacaagatactgcagtatgtggaggaaatgatggtatatttattaaatagtgccaggtcatatgaatatccagatagaaaaaaataaatcttaattcctaccttacacattatcacatttcatataggttccagatcgcaatgtgaaaagtaaacaataaagcttttagaagaaaacatgagaaaatgttttcatgaccttaaggtaggcaaaattttctgaaacaagttacaaaaaaacagtgtacaataagcacatgatgagtgacagaagccagataccaaagagttcatatgggatgattccatttatataaaatccaaaaaataggcaaaaccaatatatgttattagaagtcaggagactggctcttcttgaggaggggcgcaatgattggcaggtgcatgagggcttctgaggtttggaatgtcctgttttttgggaatatagcaagcatctttgtgctcatttagtcaaggaaagttgggaaggagaggcattagcttcaagacagaggaaaatccaggagtcaaaccctttgccagcaatcccctgtgccattctcctgttctcctgtgggctttctcctaccaggtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcaggtaaggcccatcaagtctgtgaggttaaagtcagttataactacagggagacaacacatacacttgacttagcagtcaaaagacctggtttaggtagcttggtccattaccagctgtgtgatcttagtcaaaacatttaacctctctgaatattgaggaaatgggatttgcttcatcaagtagctgtaaaaacactttgtaaactctaccacactggcttaaatttaaggaatctctgggattggttcttcattgatgctgtcactaaatatcaagctcctattatatgctgattatgatgctcacactggggacccagtgaaacaagaaagacagtacctgcaggaggaggaggcagaaaaaaatgaaaagctgacaataaaataattgcatgctgatggatgaataaacaaaatgtggcatatccaaataatcaaatattattcagccttaaaaaggaagaaaattctgagacatgctacaacatagaagaaacttgaggacataatgctaagtgaaataagctagtcacaaaaagacaaatactgtatgattccacttaggtgaggtacctagactagtcaaattcataggcagaaagtagactgccagttgccagagcctggggaggggaagtgaggaattcttaaaccgttgttgatggcctaatgggtataaagttccagttctgtaaaatgaaaggtctggattttacaacagtgtgaacatacttaacactactgaattgtagactcaaaaatgggtaagatagtacattttatgtgacatatttttacaacaatttttaaaattgcacattgtttttggaaaaggtcatgaggctcacctgtttctaggcactcttgcccggcatccttggagggtcatctcctcttcctccttacacaggaaggtgatttctgaccttgctgactttttccagctcagacctggcctgcgttcacactgtttcagcataagcccattcctctcattcccctctcccacatggagggtcctggattttccctatcaagctatgtttcctctccagcatgacagcactcaggaccaggcctaggaagagctgtgagtaagagaggcaagttgtctagacacctctgcttccccttgcagaacttccttctcccgtcgcctgggaaaagtgggctgtaatggagaatatcaaggcttggcagtcagactggcctggatttgaatcctgccacttacattgcttcatctcactgaggctcagtttcttccacggaccactaggttgatgtgagttaaataagtttagacagataaaatccccactacacggccttgcaccaaggtaatcaacaaatgtgagttcctttccccactccctctgtaaaaccactgtcctaaaattcctacaggtattcactcctctccctctttaccaccctgatttcagttttgtatctttctgatccttttcctcctcaaaatgaatctgtcttaggtcctatttctccagagtcctgctaggttccagaacataatctgagaaatcaataccaatgaaaataagttttcaggctctagtaagtcatgatacattcatattagcctctttgccttaacataaggagtgaataacacaaaaacgccaggcactgtcacaaccatagtggggaagatactttgggaaaaggtgtctttgggggttgcttcaagccacacagtgtatacccacccaggatggtcctggccttggttctgaatgacagacctgctggccccatttcccacctccttaacctttttatccaagaagcagaaacacattcacaaatggtcaaggggagttgtttctaaccttgtgtcaaaaaggcccagaccaattcacttgcagtagtcagagtcccggtctcaaagcccagactgatgtttctgcctacctgtgtgcttggcatgagaccaagaagcaaagggtcctagctgaggctcacccctagagttttgcagtggcccttcctggacagtttgtctttctctccatgtagtaacccagaaggtggtgcggggagcgagctgatttttggaggctacgaccactcccatttctctgggagcctgaattgggtcccagtcaccaagcaagcttactggcagattgcactggataagtgagtattccccatgaagtagtgacagtactaggggtaaactgaaaagaggcacaactcaaaccgatttaactgaaaaaccactggtcactagcagaggatgccagaagcttactgtggttggaggtatggaggtgctgagcaagtgtgcaggaagggacctctgtaaccagggcagcagacacagcttccttccttgtacacatggcgtgcttttaactcaacatacagtcaataccagtgcacagcctgctcccctttgttcttttaacattaacacacaaggcaagggatgagtaacatggggggttgcacaggtgaattgggctcagatcttgtcctcaaaaaacttgtacagaagatgagatgcacccaaaccactatcctgtaaaatggaaggtggtcagtgctccaagagaggtgccaccaatgtggtccagcagacaggcatgaccgcttctatctgaatgctccagtgcatcatggagggggttacattgaaactgagccaggaaatatatacaatatctgggcacgaagcaattggggaagtgggactacatgcctgcctcatacctagcgccgtgctagacaatgcaggaattggaaaagtgtagttcaagtttcaattcagctaggattgagttcctgcaaggtaccaggcattaggaatgcaaaaaataaaaggcctcaatgctcactgtctattcagagtttttcaaactgtaggaattcacctatttatgggtcatgacatcattttagaagatcctgacctgaccaggtgtggtggctcacacctgtaatcccaggactttgggaggccgaggcaggtggatcacaaggtcaagagattgagacacctacattttttagacgaattggaatacagtagaaaataccagagtgcacttcaattgcatgaatgtgtgtgtgtgtgcactgggtcaagaagtaaacagatttcttcctatggatctcagtagaaaacaattgaggaacactcatatggtgggtggaaatcattgatgtgctccaggcatttgagaggccaaaaaagagtgggagtttcctaggagccgggggagggaaggtgggccgaccacaaccctgtcccctcagcatccaggtgggaggcactgttatgttctgctccgagggctgccaggccattgtggacacagggacttccctcatcactggcccttccgacaagattaagcagctgcaaaacgccattggggcagcccccgtggatggagaagtgagtgcctgcctgcgcaagggagtggtggggacaggagagccaggccttctcttgggaggtggcaaggctctaaacggatcctccgtattgggttttagtatgctgtggagtgtgccaaccttaacgtcatgccggatgtcaccttcaccattaacggagtcccctataccctcagcccaactgcctacaccctactggtaagaactgtttccttattctgcaggccacagggccctccccacatgcctgccacttccccttttcaatcgcctgcactttgcccgcctttaccctaagccccgccccacgttgttctgctctcatgtggcattccctctgggagggacacagctgcctgtggtggaaagaccacggggcttgctctaatttccagttctgccatgaagcagtagtgaacttcaggcaagccatttaaggaagtcttctgatattgccatgtagggcttttccactgacaaagtttaatctcctcaaccaccaggtcagactggagctattactatctcattttataggtgagaatatcaagactcagagagtcaaataaatggttcaagatatgagctgtttgcagggaggagtggagaataagattatatttgttctaacttcaaattaacattcctcctctagcaagaaaatgtcttttgttgcagtaaattctcaagtttgtagggtgaagtagaaagggaactcccagaccttttggacacctatgagcacctcacaccacagttggtctgaattttcagcattctaggtattcggcaccacacttcaacacactaatttttccaagagtcactcacagcatcagggtgactgcatcagaagaggggtgctaaggtatagactgagggcttcagccctacccctaagcctctattaactccttcccaaagccaccaacagacaatccaaataaaaacaaatgtttgctttaaaacacagcttcatggtaagtcccctaagctcctgccacatagggattatggagctgccactctgaacaccacactgaggaccagtgagacatttagactgagccctgttcatcagtccacatgcccatcaacaccccagcacacccacactctcaccttcccccacgtgagttgagtccctgcccaggtggaaatcactgatgtgctccaggcgctggagagcccaaaaaagagtgggagtttcctagaagccaggggaggggaggtgcgtggttctttcccggtatggtgagtggttcttttagaagatcattttagaagatcatgacctgaccgggcatggtgactcacacctgtaatcccaggactttgggaggccgaggcgggtggatcacaaggtcttgtgctggttctttcgcagtacagtgagtggttctttcccaccagcagatttcaatcagagccaccttgatccatcaaaactgctgtaaaaattttgacttttcacgtccttcctctcaagaagtctccctgagccctctgcaaattttcccacaccctcatcagcaacttcacatttcaaatcattgttggaaagaccacacttgcctggtagagcacgtctttgccaaactaaaaattagattggagaaggtgacactcttctcttgaacaaggaatgcctacttgcctcatctaaagggggtcactcaaatgtttgtttccagaacatcaacaagaaaatagcagtggatagccactaacacagttctttctctcccttaacaaaaactaagctgagcttcactagaaactaaagaaaccagaatttaaaccaaggtcttccggtgccaacccttttgctcttctagccatgcagcaagggtttcccagttgtaaaatgatggtgacaggggtaggtgggagtatataacagatgaacagttctcaaaattgtagaacatagaccccaggcccataagaatggacttgtgcagacaaacactttattaagcaacctagggtagggacatatgaagcaggaggaagaacccaccgaccaaaatggtggaacccaccagctgtccaaggccacccagtgccagccaccaccaccacacaggcagcctccaggcagtactactaccttcttcccccgtttgtcatttgcatccttctttccaacccacaggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcatttta

SEQ ID NO: 2066 - DNA, 14647 bp, Homo sapiens; identical to SEQ ID NO: 2065

SEQ ID NO: 2067 - DNA, 83522 bp, Homo sapiens
ggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttttttgttttttgttttttgttttttttttttgagacagagtcttgctctgttgcccaggctggagtgcagtggcgcaatctcagcagagcaacctcggcttcctgggttcaagctattaccctgcctcagcctcctgagtagttgggactacaggtgcacgccaccacacccagctaatttttgtatttttagtggagatggggtttcaccatgttggccaggatggttttgatctcttgaccttgtaatctgcctgccctggcctcccaaagtgctgggattacaggcgtgagccaccacgcccggcctaaaaaagttttttaagagacagggtcttggtcgggtgcagtggctcatgcctgtaatcccagcactttgggaggccgaggtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctcccaaagtgttgggattacaggcatgagccactgcacctggcctattacatctttaatgttaatattatcacactgtctggggcatgatgttgaataagagtggtgagagtagacatccttgtcttgtttctgatcttagagggaaaacattgtcttccactgttaaaaatattaattgtggagtttttgggtaggtatgctttataaaattaagaaaattcccttctatacctagttttctaagagttttttttttttttaatcatggatggatgttgaattttgttaactgtctttcctgcaccagttgatacaatcatgtggcttttcttctttactctgttgatattatgagttacattgattgattttttttgaatgtcaaatcagccttgcattcttgagatgaacctcacttggtgatgatttattaccctttttacattttgctgggtttgagttgctcatattttgttgatgattttacatctatgtatttttatttttttagagacagggtgttactctgtcatccaggctggagtatagtggcacaatcatagctcactatacagccttaaatgacttggcttaagcagtcctcctgcctcagcctcccagttagctaggattacaggtgagagccaccacacctggttcatttattttcatgtttagtggatatgggctcttgctgtgtttcccagtctcgtctggagccactgggcccaaggagtcttcctaccttggcctcccaaagctctgggattgtaagtgtgagccactgcacatttacatctatattaataagggatattggtctgtagtttttttaattttattttttaaattttatatttatggttttttaccaactacctgcaaggatactggtctgtagttttcttttcctctctaataataacttcaggtttatcgggggaacccgcccccaatatttcaaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttttattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgataagggtctgtgttcagcagtgcacgtattgtcttgataaacatcttaaacaacagaaaacagggtttgagagcagagaaccggtctgacctcaaattcaccagggtggggttttttccccaccctaataaccctgagggtactgcaggagaccagggcatatttcagtccttatctcaaccacataagacagacacttccagagtggccatttatagacctcccccaaggaatgcattcctttcccagggtcttaaatattcattgctgggaaaagaatttagcgatatcttccctacttgcacatccatttatagactctctgcaacaagaaaaatatggctgtattctgcccaactccttaggcagtcacaccttatggttgtcttcccttgttccctaaaattgctgttattctgttctttttcaaggtgcactgatttcatattgttcaaacacacatgttttacaatcaatttatacagttagatacaattatcacagtggtcctgaggtgatgtacatcctcagcttaggaagataacaagattaagagattaaagtaagacaggcgtaagaagttataagagtacactgggcgtggtggcttatgcctgtaatcccagcaatttgggaggccgaggcgggcggatcacgaggtcaggagatcgaaaccatcctggctaacacggtgaaaccccgtctgtactaaaaataaaaaaaaaaaattagctgggtgtggtggcaggcacctgtagtcccagctacttgggaggctgaggcaggagaatggtgtgagcttgcagtgagctgagattgcaccactgtactccagcctgggtaacagagcaagactctgtctcaaaaaaaaaaagaaaagaaattgtaagagtattatttgggaactgataaatgtccatgaaatcttcacaatttatgttcagagattgcagtaaagacaggcatacgaaattataaaagtattaattttgggaactgtatgtgtccatattaaaatgaaatcttcacaatttatgttcctctgccgcgcctccagccggtccctccgttcagggtccctgacttcctgcaacacaggtttggtatcaggataatgctggtctcatagcatgagttgggacatgtcccattttcttctatattcaggaagagtctctgtagaatcaatgttgtttcttccttaaatgtttagtagaattcactaattaagccatctcagtctggaattttcttttttgaaagtcataaactatgaactcataaactttgatattggactattcaggttatttatttcttaacagtgttttattaagttatgtctctcaaagaatttcacttcatttaagttgtcaaatttatggacatgaagtttttcataacattcctttatgatcatctctaaattgctggaaagtctgtagtgatatcttctgtgtagtttctgacattggtagtttgtattctctctgtcttttttttttttgagatagggtctcactctgttgcctagtttgaagtgcaatagcacgatcactgctcactgcagccttgaactcctgagctcaagcaatcctcccaccttagcctcccaaagtgctgggattataggtatgagccaccatgccagccttagtgctttctttgagtttaatatatatatattttttttagtatcttaaggtggaaccttagatcatgaatttgagatcttttttctaaaataggcatttaaagctatcagtttcctctaaatactcctttagctgtatcccacaaatattaacttgtaattttattttcatttacttctattttctaatttcccttgtaattttctctactaactaagggttatttagaagtttgttgtttgattttttcaaaagtatttggggattttcccagatattgttctgaaattgcattctagtcgaattttgttattgatagagagcatcctttttaccagttcttttatgtcttaaagtttgttttatggcccaaaatatgatctagctaggtgaatgtcccacacgcactgaagcagaatgtacaacacaaaatattgagtgtttgctccagtgactacaatatatgtagtgtacttatggtatctatttaaaatagtcatgttaaatatgggacattttcaacagcataatttcattcattttgctgttgttgtaatataatattgtaaatatattaatatatgacttctttatatattttaaacctcacaattaggccagcacagtggctcatgcttgtaatcccagcactttgggaggccgaggctggcggatcacctgaggtcaggaattcaagaccagcctggccaacgtggtgaaaccctgtctctactaaaattacaaaagtacaaaaattagctgggcatggtggcaggtgtctgtaatccctgctactcaggaggctgaggcaggagaattgcttgaacccaggaggcggaggttgcagtgagccaagattgtaccactgcactccagcctgggcaatagagagagactgtctcaaaaaaacccaaaataaataaataaaataaataaaaaaaataaacttcacaattaaaaattttacaatttttgctttaaatatttatttgtctccaaagaaattaacagaagaaaagaagtgtgtataattgtgttgaggattcccaagaccactccaggtttggtgattgctaggtggcctcgctagattcagcttgtcgtcatactcacagctgagatttattacagtgaaggcatacaaagtaaaatcagcaaagggaaaaggatcatgggacaaagactagaggaaattaggcaaaaacttccaagagtcctctcctagtagagtcacttaggacctgcttaattccttcagcagtgagttgtgacagcgtgcacaaagtgtggtctaccagggaagattacctgattcttagagtccagggtttttattggaggctggtcacgtagacaaaatttcagccactgaaatttcagactccagaagcaagcaaatgttcaacataaaccatattgtttctgcaaatagtttagacacaatgagccatccttataacctagtgaagttttaaattacacttctagatgccagcaaaaggtcaaccttgcaagcaggacttcctacagagagcagcaatctctgacctgctgtgttgactcttctgcacaatagtctttcatatctattcacgtatttaccatttccaatagcttttatttcttcctacagaaacaggttacccttttgtgttatttccattcccacgaataacttcttttagcatttcctgtagtgtaggtctgctggtgatcagttttctcagatgtatgtgaaatgtctttatttcctcttcatttttgaagggtactttcattggatatagacttctgtgttgaatttctttattttagccctttcctgtttatttcattgtcttctgttctttattgttcttcacagaaagtcaatgccattcgtacttctcttcccttcctatgtataatgttgtattagttctcacactgctataaagatactacctgagactgggtaatttataaaggaaagtggtttacagttccacatggctggggaggcctcaggaaacttacaatcatggtggaagatgaaggagaagcaaggaccttctttacatggtggcaggagagagaagtacaagcaggggaaatgccagaggcttgcttataaaaccatcagatcttgtgagaactcactatcatgagaacagcatggggaaacacccccatgatccagtcacctccttcccttgacatgtgggattacaatttaagatgcaatttggctggggatgcagagccaaaccatataaaatgtgttgtttttctctcattgctttcaatattttatctttatttttagatgtcacaagtttgcctatgatgtacctggttgttgtttgtttgtttttggggacaaagtctcactctgttgcccaggctggagtgcagtggcacgatcttggctcactgaaacctccgcctcccgggttcaagtgattctcatgcctcagcttcctgaggagctgggattacaggcatgaaccaccacgcccagccttgtttgttttttatcctgcttgaggtttagtgaacttcttggatctgtaagttgatgtctttcaccaaatttgaaattttttagctgttatttctttcaaatatatattctgtctcatattttctcctgtccttataggactctaattacctatctgctagactgcttggtacccattctctgagtctctgttcttttttttttttttttttttttttagtctttttcatttctcttcttcggattggataatgtctagatctatcttcaagttcactgatgcttctgccatctccaatcttcttttaattctttctagtgaatttttttttttgagactgtcttgctctgtcacccaggctgtagggtgatggtgcagtcttggctcactgcaaccaccgtctcccgagttcaagcagttctcctgcctcagcctctggagtgctgggattacaggtgtgcaccaccacgcctggctaatttttgtatttttagtggagacagggtctcaccatgttggccaggctggtctggaactcctgacctcaagtgatccacccacctcagcctcccaaagtgctgggattacaggcatgagccaccgtgtccggccccaatgaatttttcattttaattgttatacttttaagctctagaatttccatttggctcttttttctttggttcttttcatagtgtctcttctgaggttcactatctgcttactcattatgtgtatgttttcttttaagttcctgaacacatttcagctgcattaaactagttgtttaaattcaggtcctcttagggtctgtttctattccctgctttttcccccattgtggatctcattttcccattttgttctcattgctgctgattttttattaaataatggacaccatagataatatattgtaaagtctggattctgttgtatttctctgaataatttttttttttttgtagctggcgtttaacttaactgtattcaaaattccaaactcttatctcctgttgttggcaacatttattctttgctgggttttatcgcatacatatgtaatttcgttgtcagccaaggaatttagtggtcagtcaaatatttgactgggtttcatatgcagattttggggtaccttctgtggcttcttctcttgcaagatttcctctctaacttctaattttctggtgatacaagttctgaacattttgctgtagctcctcaagccagtgaggctctgacttcctgccactccaagagacacagattaggtagtgctctcaagccaaagttagacttgcaaatctcagagatacaattcctgtattccaagagtagattcttccagattctgtctttctccctccccaaaatactgtcagacagtatattttgtccggactttgtaatgtgttatctgtggggaggttagtcatgtaatggattgctaaaatgtaccatatccatttgctgtgctcagacatttctgatttttttttttttttgagacggagtcttgctctgttgcccaggctggagtgcagtgacaaaatctcggctcactgcaagctccacctcctgggttctagcaattctcctgcctcaccctcccaagtagctgggactacaggcgcctgccaccatgcccggctaatttttttgtatttttagtagagatggggtttcaccatgttagccaggatggtctcagtctcctgaccttgtgatctgcctgcctcggcctcccaaagtcccaaagtgctgggattacaggcgtgagccaccgtgtctggcctctgatggttttttaagggccataaaataatctgttacctggagataggttggaatggaatgagtaaaatactggaagtagggtgtcaggccatcatagcagagcaggcaatacgtattgtgaaaatctgtgactgttactatgttatattaatagatcaaacgtagttttctacaaaatatagaattctgttttcttgtatacatctgcagaaatagtataaaaataaaaatgtggttgtccattgctggaattatatgagtgagatagtatacagcttacttttagttaagctaacacaattttttcttttgtacatcaagagtttcctaaagtgttgatactgctgagacctttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggcagagcaggcccaaggcctgctggttgcccatttttatggttatttcttgattacatgtgctatgcctctgagagataatccttatgtttttatgtcattattttcaggttgctccctgagaaaaagaatcttgtaaaggtatgtaataaatactcataacttgaattggacacttaaaattttattgcatggaaattctacttcagtaaagaaaaatatatacatgacttttgtgactgaatgaaaggtgttggtagtgaaagtgctgatcatttcacaaaaggtgtctttgtgatgctctcatgaaaactttgttggtattgggcattaaattagtctttttttgtaatttgataatcagttttctcatttttctgcttgctttctcaagtttttggggagcaaatcatgcagagaatagggtgaaaaacaatttttgaaacacattgacaacactgttctcttggtggaaatgtttattttcctgaggattgatttacctgataaccacatcagatttttaactgtgtggagacacacacacatgcacgcatgcacacacacgcgcacgtgcacgcacacacatgcgcacatgcacgcacacatgcacacacacaaagccagttcactatgggcgacagaaattgatgactttaattaaaggtaagattttcttaacataaactatcttagtgttggaatcatctaagttagtccatcattcatagtaatctagattaatagttgagatatatcacagttttgttaaaggtgtagtatcgaaggaaattaatatttaattaaaaataaaaaatagttgagatatatgttttctggctttctatttaaatggggctagggaaggaaatttctgcctaatgctgttttcccaagctgaactagaaaatgggggaaattcttttcctcctagacttactctcttcctaccccttgccatacaaccttgactaactaatatctgtattccagaattataaagctttttttcattactatcctgtgtttgcttcttttaaatataatttatctcttccttataattctgtttctttttttttttaacttttatttagaacaagcttttcccacaagcgatttcttatttagagaagacttttcaggtccgtcgacctgcgggcactatcttacttagcaggtatgtcacatgaaacacagatcattttcttcagccgtttagtactctgcctttctcgttctatgaacatggcaaggtatgaaacttatactagaattttattatgcttgttcttagggacctaactgcaaggtatttaaaaagaataaaaaagcacctgctggataatcattctttccctgacctttcattgtgagatggtctactgaattttttctgggtgtagttgtcccctgttctccagatcacctttttccctctttcatgtggatacagtgttggctttatgaagtatttgggtgtttaaaaacccaaatcaagaggatttcctatagaacccaaattctttcttagctactttcctgactaaaatagtaacattattaatgaagtaatatagcagctaccagttggtttccatgtttttaactgctataaaatattctcttttttgtatttaaactttgatgtacaaatggactgaagacaatgtgcaacaaaccaatacctccggaaggaaaacgatcctcacaggtactgcaccggggagtgtgccgcacacacaaagtgcggccccgttattgttcctgaggaacatctccaggtatttcaccctgctcttggcagtgcttttacacctgaggagattttgaatttgtgagtgtcacagaatttttacagattcaagttcaaaggcttagtagcttccttggtctacaaaaagtaaccacagatatgctgattttattctttcattagctttcaagtgagtttaatggtattttctttcttcactcctccccacaggcctccttgcccctgtttatcttggtctgctgaatcactttagcttagaacattatcttgtcttccaaaatatcttttagcaaggcatatatctcagtttgttaaaggacagtctgacatctcttaagataaaaaatatgtatgcctcaacccaacctagaaatttattccacaaaatactaatggctacgtaatatatgtttaaaggtgttctttgcaaaactataaatatgcctatttagggtatatttatgttaagttatggtataaccacgtagtagaatactgtgcagttgttaaaaagtgaaggagatctctatgtactgacttggaaagatgtttaacctcttacatgaaaaaaatgttgcgaatcagtatgcagttagcccattttatttgaaagtatagaaacacagacaataaaaaaatgatcaaacaatctggaagtacacacgttaaatctgggtacatataaaatcatcaaacaatctggaagtacacacatgttaaacctggatacataaaaaattatcaaacaatctggaagtacacacacgttaaatctggatacatataaaaatgatcaaacaatctggaagtatacacacgttaaatctggatacatataaaaatcatcaaaccatctggaagtatacacacgttaaatctggatacatataaaaattatcaaacaatctggaagcacacacttgttaaatctggatacatataaaaatcatcaaacaatctggaagtatacacacgttaaatctggatacatataaaaaatcaccaaacaatctggaagtatacacacgttaattctggatacatataaaaatcatcaaacagtctggaagtatacacacgttaaatctggatacatacaaaaatcatcaaacagtctggaagtacacacacgttaaatctggatacatataaaaatcatcaaacaatctggaagtatacacacgttaattctggatacatataaaaatcatcaaacaatctggaagtatacacacgttaaatctggatacatataaaaattatcaaacaatctggaagtacacacacgttaaatctggatacatataaaaatcatcaaaccatctggaagtatacacacgttaaatctggatacatataaaaattatcaaacaatctggaagcacacacacgttaaatatggatacatataaaaatcatcaaacaatctggaagtatacacacgttaaatctggatacatataaaaatcatcaaacatctggaagtatacacacgttaattctggatacatataaaaatgttaatcatttctttaagagattgttggggaaagtgcttttctttcataagttatggagatttttgtgatgttctgagttttcttattgaacatctattacttatatcaaaaaaataaaaaatttaggccgggcacagtagcttacacctgtagtcccagtactttgggaggccaaggcaggcagattgcttgactccgggagtttaagactagccttggcaacattgtgaaaccctgtctctacaaaaaatacaaaaagttagccaggattggtggtgtgcacctgtggtcccagccacttgggaggctgtggtgggaggattgcctgagctggggacgtggaggttgcagtgagctatgatcttcccactgtactccaacctgggtgacagagtgagaccctgtctcaaaaataattagataaataataatatctcagactatgcctaagctaagctagtgcttaataaaaaactacaaggtcaggcacggtggcttatgcttataatcccagcactttagggggctgaggtgggcggatcacctgaggtcaggagttcaagaccagcctggccaacacggtgaaaccttctgtctactaaagatacaaaagttagctgggcatggtggtgggtgcctgtagacccagttcctcaggaggctgaggcaggagaagcttgaaccctggaggcggaagttgcagtgagcccaggtcacataccactgcactccagcctgggcaacagagcaagactccaactctggctcaaaacaaaactaaactaaactaaataaataaataagaatacagcatattgtcattaaccatagtcactgtgctttacaacagaactcttgaacttattccttctaactataaacatgtattctttgaccaacatctcctcagctcccactccctaaagtaattgattttaaaaattataaatgcatgtgttagagaaggaagaataaacaatgtgtattttctattaaatgaaatgagaatttgttttttttccctctacaagtattgcttacaccttaaaaataataatttactgatttttctgtttctaatttggagattatgattacttgggaattctgatagaagtagctttcaaaaaagtgaccattacagaggcaaataagatttgctgggcaaggtgcggtgactcacgcctgtaatccctaatccctgcactttgggaggccaagatgggggtattgcttgaggccaggagtttgagaccagcctggtcaatatagtgagaccccgtctatatatatttaaaaaatttttaggctgggtgcagtggctcatgcctgtaatcccagcactttgggaggccgagacaggccgatcacaagttcaggagttcgagaccagcctggcctatatggtgaaaccctgtctctactaaaaatataaaaattagctgggcatggtggcaggcacctgtaatcccagctacttggggggctgaggcaggagagagccgagatcacgccactgcattccagcctgggtgacagagtgactccacctcaaaaaaaattttgtttttaataataaaagatttgcttagaagattagaaacaaggggagatgactcatacctttatattgtttgaatttttaacaagatgtggattgcattataataggaaatatatttccattaggtaagattttttttaccacttagtttagaattaattgtagattcaaagaaagttgaaaaaaaagctacttttagggaaatcccttcatctagtttcagagttttaaaaccttttatatttctgtcttttcagcgtcctgtttggttggccttcctttgtaaataggaattatttaattgagattataggtttatgatcattttatgtaaagtggacatttcattaaaataaattcagaattagagctaggtattgagtagacagggaggtatggattttgataaaagtttagggataataaagattaaattgtactgtgtttatagtgtagattttactataagattaaatgccactacagctaactttgtctctgttctggctttctgatgtctcccgtgggtgcagcaatgccgggtctaccgtgggggtaagtggcctcatggagcagtgggtgtgccagaccaagaaggcatctcagatgcagactttgttctttacgttggtgctctggccaccgagagatgcagccatgaaaacatcatctcttatgcagcctattgtcagcaggaagcaaacatggacaggtaatctttcctccgggacttagtttccaagatctaatgtgggaactcttaaagcaaactgtatttttagtgttaagattacaggaatcttgcatttgccagattgcctctggtagacaggaatagcatgctgcctgggtttggagtggggttaggagaccgtgattagactgttattaatgtgataacccaagtttttagtcaaagtgaaagagagaaaagtgaagcacttcgtttgacttttctgcctgccgttcctcttccattttgatcctatcgtttttgcctaaattccaaagaaaaagtctgctgtcaagtgggccaagtgtggtggctcacgcctgtaatcctagctctttgggaggctgaggtgggaggatcacgtcagcccaggagctcgagacccgcttgggcaacatagtgagaactcatcttgacaaaaaataaaattggccaggtgtggtggcatgcacccgtggtcccagctactcagggggctgaggtgggaggattgcttgagcctgagaggttgaggctacagtgagctgtgatcatgccactgcactccagcctgggcaccagagtgaaaccttgtccctcacaaaaaagaaaaaacaaaatggctgggcgcggtggctcacacctgtaatcccagctctttgtgaggctgaggcgggtggatcatggtgaaactctgtctctacaaaaaatgcaaaaattagccaggagtggtggtgtgtgccggtagtcccagctgctcaggaggctgaggtgggaggattgcttaagcctgggaggtggagcttgcagagagctgtgattacaccactgcactccagcctggaccacagagccagaccctgtgtccaaaaaacaacaataataatgataagtccactgtcaagagaattttctttccaggtgactcctgctctaaggcaacaatttgaactttaattttaggacttctgtgctaaaactgtgaagaaaggtgttaataatgactgttcatctaattgtcatgtaatttgttatatgtgattcacttagctaaacatcacttagacattcagagttctcttcatttacaaaagatttcaaacatttttcctgtgaagcagcttagctttgaaatgaaaagttatatatgcagaagattgcctgtcacacactagacaaatcaagtaaaggcagtagaaattgccatatgtctcagaatagattgtatataacattctcagatctaggtgagattagatttgagattagcgattagctgacttcaaagggagtcagctagtctttttttttttttttggagacatagtctcgctctgtcacccaggctggagtgcagtggcgtgatcttggcccactgcaacctctgcctcccgggttcaagcgattctcctgcctcagcttcccaagtagctggaactacaggtgtgcgccactgcgcccaactaatttttgtatttttaatagagacagggctttcactatgttggccaggctggtcttgaacccctgacctcaggtgatctgccttccttggcctcccagagtgttaggattacaggtgtgagccactgtgcctggcctcagctcgtgttttgaccgatagatggatgtttaacacctcagcagtggtccttttatgcacaggaattagttaactaacttctcctagatttgttaaaagaaaaagcagttaccttcttttttttttttttttttttgagacggtgtctcactctgttgcccaggctggagtgcaatggcatgatctcggctcactgcagcctcgacctcctgggttcaagtgattctcctgccttagcctcctgagtagcggcgactacaggtgcgcaccaccacgcctggctaatttttgtatttttagtagagacaaggttttgccatgttggtcaggctggtcttgaactcctgacctctggtgatccacctgccttggcctcccaaagtgctgggatgacaggcatgagccaccacgcccggccttaagttcttctttttcaaggaagtgaaaccttccttcacaattgctatattgcattaattcatttcatgaatatttgagcggccaacagatgaggtaaacaaagtatagatgtgtatctgcctcatggaacttatgaattgcagagggagacaggtattaaatattcctgcaaataaatatgtgatttcaaagtatgataaatacttcatagaaaataaatagaatgttgtaacatagaggagaataaaagaggaaacaccttgtagatcaattgaacaaggaagacctctttgagaaagtgaaacgttagctgcaacctgaacattgataggctgtagccaaatagagagatgtggggagagcttgtgaaggcagaagccatgtacacctgttgcttcaggagcccctcagtggacactgtcggaggacaggtgctttgacaggcagacaggattgttttcttccaagtgctgcaggaagcccctgaagagttttaagcctggaagtgaaatccattttatattttagaggtcactgtggcaatttttaaataaaagaattgtattcatactttttctaattctgtgtctgttgctattacctatgaagaaaatataaagtatttaacaatttaaataagataaatgtactttataaatagtcagttatactttgatgaggtttgtggtgtttctatgtaagatgttaagatagtggtaggagaactgagcttggggttcctcagcattgttcattggctgcagcttttgaaagacagggaggcgcatggtggaactgaattactctggactcttgagtcctagtctgcctttggacttgcaggttctaggcacagagagagatgtagaagtgtgtagattctaaagggtgtagaatttggaagaagatgatgggatggtagaaatatttatgtgaatgtaggcagtgttggagcaggagaaagggaatagcaaacagataagaagggccagcgactttcagcaatctgaaccactcatttattgccccatttgataactgctttcctctctacctgcttgtctctgtgcccgtagatatactgaaatgctgaagttaaatatggattttgcaactaaaatagtgttagaatttgagcctttcagttcgttcttttttgggtattatattgatatatttcaaaaattcatattaaagtataatcaagtatgtccttttgtggaaacaggggttgatttgccatgccataggaaagcagaggatacatgtcttaaaagtaagatagtgatggtacaaaattgcattggatactttgcaaagatttttctgtccttgagcagtatttgatggagaagtaaatgttaataaatattgttctggaatgtaatttaaaaattcaatgtctgttttgacaggccaatagcaggatatgctaacctgtgtccaaatatgatctctacccagcctcaggagtttgttgggatgctgtccacagtgaaacatgaggttattcatgccctggtaaattctagccttactgttctttccttcatgccttgattttctgcttagtatgttctcatttttatacatatattccactttaagatgatgtggattcctagactcatgttcgtgcacatgtaccctaaaacttaaagtataataataataataaaaaattcaaaaattagcggggcatggtggtgtgcacctgtcgtaccagctacttgggaggctgaggtgggaggatggcttgagcccagggaggttgaggctgcagtgagccgagattgtgccactgcactccagcctggtggtagaggccgactttgtatcaaacaaacaaacagaaagatttataaagctttttcctcttttaaaattctaagattgaaaaatgaacaatactgaaaggcctttggaagtatatagatacggcagagccctgggctgctgctgctgctgtttgtttgttttttgaggccccatgatggcccactgcagcctcagcctcctgggctcaagtgatcccaccttagcctcccaagtagctgggactacagacatgtgccactacacttggctaatttttttttttgatagagataaggtctcgctatgttgcccaggctggtctcaaactcctaggctcaagtgatcctcctgtctcagactcctaaagtgttgagatgagaggggtgagccactatatccagccctctgctgctgcaacctcctgggctcaaatgatcctcccacctcaacctccagagtagctgggaccacaggcacgcaccaccatgccctgctaatttttgtatttttagtagagatgggggtctcgccatgttgcccaggcaggtcttgaactcccgggctcaagtgatcccccccgcctcagcctcccaaagtgctgggattacaggcatgagccaccgcgcccagcccttctgctgccgcttctgataaccatgtgaaaatccttatagggagaaagtagtaatgacttgccacttcctcaaattaaaggaaaggaaagtgtcagctaaatatttttttacatgtttatttgaacacatacgaatgtttatcttcccagtaatttttaagtaaatttattgtaagcaagtgtcagtcttggccacgtatctcagtgtccagcttccatcttttcagctctggtccagctcttgttcagaagtgatacctgatagctgatagcttctcaaaaaaggaagaagggccgggcgcggtggctctcgcctgtaatcccagaactttgggaggattcttctatatatataagaaggccaaaataactttaaaacgcagacagactttcaaaaccatttcataatgtacacacacacacacacacacacacacacacacacacagagcaaacaggaattaaaaacacaacagctggtgttctttatggttttaaaattctagtcgtgcttggaaatataattatacgacagtaattaatgtttgtagtatttctactgaatataaatttaaaatatataatacattttagaaaatttctcgttagaaatatttacctcaagtaatcagaatttaaaatttataaatatggaacacttaattgttgttcaattccagcgtaggagaagttcctacagaagcactggcgtggtgcttctacgttcccgttagtatcagtgctctcttttgatcgcaggcctgtaatcagccttgatgtttttcacttgaagacattttgaactttttcttacagggtttctctgctgggctgtttgcattctaccatgataaagatggaaatcctctcacttcaagatttgcagatggcctcccaccttttaattataggtatttttgttgttgttgctcttgttctcctcttttaggagggtgctaagactagaatctgagaatcacagtatattagatgccataaataataatgtcttcatggcaaacctaaggaaattgtagatattaaaacaaaatgggatataagaggccattttatgaaaacataacttgtgagatgtaagtgaggaggagagagatacccacacacaagaaccattcttaagctgataatttgcagtgcttccttgcattgaggatattcctcaaaagcatcaaaccttccggccaggcacaatggctcatgcctgtaatcctgcactttgggaggccaaggtgggctgattgcttgagcccatgagttcaaaacctgccgggcagcgtggcaaaaccctgtctctacaaaaaaatacaaaaattagccaggcatggttgcatgcgcctgtagtcccagctacttggggtgctgagcagaaggatcaattcagctcaggaggctgaggctacagtgagctgtgatgacgcatctgcactccagcctgggtgacagagtgactgtctcaagaaaaaaaagagaagccttccagtaaaaacgaagataatagagtaataaattcagttgttacagatataaagaattggattttgctttaactgtatttggggaaactgttaatcttgaagtatgaatgataaagagagattggagtgattaataaggtaaaaactttattttctggctggctttgttcactacttatgtgtaaacgttgccttgccatggaaaaacaggaattaaaaacaacctctctaaggcatggttagatgaacagataacgtgataacaaatacaacaaaatgttaattacagaatctaggtgagctggttgattataagggtgtttagtaaacaattcttttaatgttctgtatgtttgaaaattttttttctttttttttttttttgagacagtctcgctctgtcgttcaggctggagtgcagtggtgtgatctcggctcactgcaagctccgcctccagggttcacgccattctcctgcctcagcctccctagtagctgggactacaggcacctgcaaccatgcccggctaatttttgtatttttagtagagacggggtttcaccatgttggccaggctggtctcgaactcctgacctcaggtgatctgcccgcctcggcctcccaaagtgttgggattacaggcatgagccaccgcacccggcctatgtttaatatgtttgaatttttttttttttttttttgagacggagtctcgctctgtcgcccaggctggagtgcagtggtgcaatctcggctcagtgccagctccgcctcctgggttcacgccattcttctgcctcagcctcccaagtagctgggactacaggcgcctgccaacacgcccggctgattttttgtatttttagtagagacagggtttcaccatgttagccaggatgatctcgatctgctgacctcgtgatccacccctctcggcctcccaaagtgctgggattacaggcgtgagccaccgcgcccggccaaaatttttacaaaacagtattggaaaagaaaaccctctttatattttctgttcttttactgagaatgaaagatttatagggaaaatggtagaagtagtctagggaataagccagaaaaaaaatgacttaggttacagggaaaaataaaaattgatatccatcgtaattttctataatagataaatgtgttacttttgtagtagtgcttttatttatgcagggtagatttcccaaactgggattgctgatttaaaatctgtttacactataaattttaatagaaactgccatgttacattttttttaaaaggtatagcaaagcacattcccaccaggtgtgtatgagtgcttttgttaccactttatcagtatcggatattatagatcttttttatttttaagcccaatttgatggattaaaagatggtatctcattgttgtatttccaggactatagtgaggttttagccatttgcattttctctttgtacactgcctatttattttccttgtccagtcttttaggttaattttccctttctaatcacgttgtaggagttctttataaattagagatattactcctttttcatgcttattataaatatttctcctagtttatctttttatttcatttatcatgcttttgccatgtatagaaaagtttttaagttttttatcattaaattcatctatctttttttttttgagatggagtctcactatattgcccaggtgggtctcgaactcctgggctcaggcaagcttcctgcctccgtctctcaagcagctgggactacggtcacatgccactgtaccccgatgtttttttctttgttgcttaaggcctcaaaagattataaaaatattctcctacatttattctagtaaattattattcgatttctttacatttatagcttcaatgcatttgaaattttttttgatttatgtattttgggattcttttgtaaggtgcatatatgtttataattgttatatctttatgctggatttaccccttttttttttttttttttttttttgaggcagggtctcactctgttgcccaggctgcagtgcagtggcacaatcatgatcacggcttactgcagtgttgatcttcccaggctcaggtgatcttcccacctcagcctcctgagtagctgggactacaggagtgtgccaccatgctcatctagttttttatttttattttaaatttattttattattttttgagatggagtctcactctgttacccaggctggagtgctgtggcgcgatctcggctcactgcaacctccatttcccaggttcaagtgattctcctgcctcagcctcccgagtagctgggattacaggcatgtgccaccacacctggctaatttttgtgtttttagtagagacggaatttcaccatgtttgccaggtttggtctcatactcctgacctctagtgattcgcccatctcggcctcccaaagtgctgggattacaggtgtgagccactgcacctggcctatgtagtatatctttttatccttttactttccacctatttgtgttatttagtctaaactatgtctcttgtagatatatagttagagcatgtttttaaattcatttttccaattaaccctgttctgtctgctacagtgtctgtcaggttactggttttcaccatgattgtgggctgtcggttttcaaggctgcccaaaagctggagagagggcatggaaacgcaccacaccgctcctgtttctacggagattcatcaatttttcatgaataaatgctttctgcattgctataaatctttgattaatttccaaagtttaagaagttgatttcaccaagttgggtggtttttttcattgcttttttcatagaggagagaattttgagagatttttacgctgtcatttttgcttctgactttctggaatttatttttgtatgtggtgaaaaagggatttaaccttttttttctaaatggataatcagcacagttgttagataaattctactttcccactaaattaatatggcattttgttggttatgtttccttatatacttggatatctgtgaacttgctttcattttatcctgtacacttgtcaaaaggaagtaattcatcgtcatcttagccaagtgctagctatgtgaacttgaacaagttacttcatctccctgaacttttgtctctttatctgcaaaatagtgatgataatctcatagggttgttgaaaagatgaaatttaaaacacttatcagggctaggcccagtggctcacgcctgtaatcccagagctttgaaaggctgaggtggaaagatggcttgaggccaggaattcgaggccagttttggcaaaacatagcagatcttgtcccaacaaaaaataaaaaataaattgaaaaaaatttttctggactggatttcattctgtcacccaggctggagtgcggctgtgtgaacatagctcactgcagccttgaactcctgggctcaagtgatcctcttgcctcagcctcacgagtagctgggactacaggcacacactaccatgcctggcttattttattttattttattttattttatttattttgtttttgagacagggttttgctctgtcacccagtctggagtgcagtggcacgaacatggcttactgcagcgtcaacctcctgggctcaagtgattctcctgcctcagccgcctgtgtagctgggaccacaggcctgcactactgcgcccagctaatttttaaattttttgtggagacaaggtcttcctgtattgcctaggctggtatcaaactcctgggctcaagcagtcttcccacctcggcctgctgaggtgctgggattacaggtgtgagccactgcacccaaccaaaaaattaaatttaaaaaaatgtagaaaggaaaatacttatcaagtactttgtttggacttgatacataggaggttctcaaatattttaatttcatattgatatttataaagactttttacagtaaatgtaaatatttttatatttaaaatggtgaattttcagtaataattgtgttttaattctataattacagtctgggattatatcaatggagtgataaagtagttcgaaaagtggagagattatgggatgttcgagataataagatagttcgtcacactgtgtatctcctggtaacgcctcgtgttgttgtaagtattatcagacttcatgtctcatgagccatctgttcttttcctttactgtggtcctttctttactcatcattattgtttaagaacttataattagagcctatagtaggaaaagtcatataaagggaatgcaatgaagctacgggccacgagaaatctgaggaaatggaaacttggcaatggctctcacagctcctatcccacccagtgctttaggccagtgcctcctctgttgtgatgcctcttaggaccactggtactatttctataatgactgatcattttctttggtgtctgtattagtcaaggttctccagagaaacagaaccaataggatgtgtgtatatatctatacatctgtatacacaaagaaagaatacgagagaggaggggaggaagagatttctttttttcttttattttctttctttctttttttttttttttgatacagggtctcactctgtcacccaggctggagtgtagtgttttcggctcactgcaacctctgtctcctgcgccaaagtgatcctcctacttctgcctcccgagtggctgagactacaggcacgcaccaccacgcccagctaattttgtttatttttttgtagtgatgaggtctcgctatgttgcccaggctggtctcgatctcctgggctcaagcagtcctcctgcctcagcctcccaaagtgctgggattacagacatgagtcaccacacttggccaagaggtaacttttgaggatttggctcacatgactgtggaagttgggcgagttcaaatccgatgggataggccagcaggctggagactcaggggattgttgcccttggagtccaaaggcagaatgacttcttattcaggggaggtcagtctttgttctcttccggccttctcctgattgggtgatgcctacccacattatggaaggtgatctttacttcagagtccactcattgcaatgttactctcattccagaaaacaccttcacagaaacatccagaatatctgggccaaatatttgggtaccatggctattctcctttccccttttccttgactttgtacagctctctgacttctaaagttctgcactgctcttgggctatttcccatctctgaaaatctctaactaaaggacagatagaacccaatgagcaaggttttattctactgagcaactttttttttttttttttgagacagtttgcctcttgttgcccaggctggagtgcaatggcacgagctcagctcaatgtaacctctgcctgctgggttcaagtgattctcctgcctcagcctcccaagtagctggaattacaggctcccaccacgatgcctggctaatttttgtatttttagtagagacgggggtttcaccatgttggtcagggtgagaccctgtctcaaaaaaaaaaaaaaaaagaaaaaaggaaatttcttcctcccctcatctcatattctttctctgtgtgtacatatatatagatgtatacacacatcctattggttctgtttctccggagaaccttgactaatacagacaccaaatgatcagtcattatagaaatagtaccacggatcctgaggtatcacaacagagggggcactggtgacctcaggtgatccgtgcgccttggcctcctgaagtgctgggattacaggcgtgagccactgtgtctggccagaatagatttttttggacagctaaaagtgaccaacctttagttagactaagaagatgcaaataacataagaaatgaaagaggagacattacagctgataccacagaaacacaaaggatcatgagagactgttataaacaattatataccaacaaactggataacctagaagaaatgaacaaattcctagacaaatacaacttatgaagactgaatcatgaagaaataaaaaatctgaacaggttaataacgagtaatgagattgaatcagtaataaaagtctgccatcaaagagaagcccaggaccaggttcactgctgaatttcaccaaatgtttaaagaagaactaataatccagtccttctcaaacttttccaaaaaattgaagaggagggattacttccagactttttttttaccagggcagcaatactctaataacaaatttagacaaggccataagaaaagaaaattacaggctaatattcttggtgagcataagtacaaaaattttccaacaagatactaacaagctgaattctataacatgttaaataggtcatccatcatgatcaagtgagatttatccccaggatgcaaggatggctgaacatagcaaatcagtaaatgtgatccatctcactgacagaatgaaggacaaaaaccatacgatcatctcaatagatgcaaaaaaatcatttagcaaaattcaacatctttttatgataaaaaactgaccaaattaggtacaaaaggaagatacctcagcacaataaaggccatataagagacacccacaaccaatcttatactcattagtgaaaaatggaaagcctttcctccaagatctggaacactcttaccacttgtacatagtattggaagtcatcgcaagagcagtcaggccatagaaataaataaaaggcatccaaataggaccagaagaagtgagatagttgctgtttgctgatgatcttatacatagaaaaccctagagactccatcaaaaattatgaggattaataaatacagtaaaagttgcaggatacaaaatcaacacacaaaaattagtagttttctatatactaacagaaaactacctgaaaaagaaatcaagaaaacaatctcttttacaatagctaccaaaaaaaaaattcttaggaataaatttaaccagggaagtaaaagacctgtacactgaaaactaggtgaaagaaattgacacaataaatataaaggtatcccgtgttcatggagtagaagaattagtattgttaaaatgtccatactacccaaaacagtctacagattcagtgctatccctatcaaaattccaatgtcatttttcacagaagtagaaaaaaaatcctcaagttcatatggaaccacaaacacaccaaaaaaaagaaaaaatagccaaaacaatcatgagcaaaaagaacaaagctgttcaggcagtgtgatgcctccagctttgcagtatttcaaactgtactgcaaaagcatagtaattaaaatgtcatggtcctggcataaaaataggcacattgatgaatggaacagaataaattatgattaatttattgacttgattatgattaaccaattatggttaattgatttttaataaaggtgctaagaatacacaatgggaaaaagtctcttcaataaatggtgttgggagaactggatatccatatgcagaagaatgaaatttgacccttatctcacaccatatatacaaaaaccaactccaaacatattaagtaaacttaagaccagaaactgtaaaactactagaagaaaacataaggggacaactacatgacattggtttgggcaatgagtttttggattggaccctcaaagtgcaggcaacaaaaataaaaacagacaaatgggattacatcagacgcagaagcctctgcacagcaaaggaaacaaaagtgtgaagagacagcctagaaacagagagaaaatatttgcaagccatacatcagaaaaggcgttaatatccaaaatatgcaagaaatgcaaacagctgtgtacaaacagcccatttaaaaaaatgggccaaggacctgaatagacatttctcaaaagaagacatgcaaattgtgaacaggtacgtgaaaaaatgctcaacattactaatccttagggaaatgaaaattaaaagcacaatgagatgtcattttatgcctatcagatgactgttagcaaaaagacaaaagagctctcgctttggcagcacaaagactaaaattggaatgatacagagaagattagcatggccccagtgcaaggatgacatgcaaattcatgaagcattccatattttaaaaagaaaagaaaagaaacaaaagataagaagtgttggtgaggatgtggagatagtataaattagtacagccattatggaaaactggaagttcttcaaaaaactaaaaatagaattaccatatgctccaacaatccttgttccatgtttacacaacagatttgaaatcagtttgtcaaagagatgtttgcactcctgtgttgactgcagcgctatttacaacagccacattacagaatcagcctaagtgtccatcagcagatgagtgggtaaagaaagtgtgttatacacaattgacccttgaacaacataggttggaactgctcaggtccacttatttgtggactttctgtcacctctgccaccccttagcaagaccaccccctcctcttcctcctgctcaatgtgaagacaaggatgaagacctttatgaggacccacttccacttgatgaatagtgaatatcttttcttactgatgatatttttataacattttattttctctagcttcattgtaagaatacatcacataatacatacaatatacaatatatgtgagaattgactgtgcagttactggtaaggcttctagtccatggtaggctattaatagttaagttatggggaaatcaacagttatacacagatattggactgaacaggaagttgacgccactaacacaatggaatactattcagccttaaaaaggcgggaaattttgtcatttgtaagaacatgggtgaaactggagaactgatgctaaaaaaggaacagaaagacaaatacctaatgttttcacatttcacatgtgacatctaaaactattgaaccccgaagcagagggtagtggttatagaggctggggtggggggagatggtaaggtgatggccaaagggtacaaaatcacagatgggtgtaacactttttttttctttttttttgagatctattgcacagtgtggtgaatatggtcaatagtagtgtattgcacagatttaaattactgagagtaaatttaaaatattctcacaaaaaaagtatttgaaatgatggctatattagctcgatataattatttcacattgtattcataaatcataacatcactctgtactccataaatatatatggttataacttaaataaaaaattttaaattgttattgacatgagttacaactgtcaatcatcctagtctataacattttttagctatatgttgcaaaagtgaaaatcttcagagagaagaaaagatactaagtagtaatttcctagcaaagaagagtgtgactgcattaaaatatttagttatattaaaaaccatattttaaaaagaaattctcctttctcaacaaagtaattctttaatgttaacttattatattcatgtgatgaaaagtttgctgttatcttacggtacttttgtaccatatttgtttctgattttttttctggttcttaggaggaagcacgaaaacattttgattgtccagttctagagggaatggaacttgaaaatcaaggtggtgtgggcactgagctcaaccattgggaaaaaaggttattagaggtcagtttgtttttaaattttcctagactttatttaatgaaaataattcataattatggtaaaacttattcaagcaggttataaactgaaaaatgtttacgtccctttaccccttcagctctccagatgcactttccagatacagtcactccttactttttttgtatatactttcataaatgttatatatgtatgtgtgtgcaaacacacgctgaattgtctattttttcatgggttcacatatttatgcaacttttttcactttttccaaggcactataggtgcttctgctataatgcaatgtatgctttcctgaaaaacctttttcttcacaattggacactaaaaataacaagacttgtgggaaaaacaagtaaacagatcactaacagaaacaaataagtcatatagaactatgagctccgttttaaaaagacatcagattttcaataaatgaagtcctgtatctactctagtattttattaaaatttttatgttttttagagacagggcctcactgtgtcatccaggctggagtgctgcagctattcacatgcatgatcatagcacactacagcctcgaattcttttgggctcaagcagtcctcctgcctcagcctccgaagtagctgggaccacaggcaaacaccactgcacccagcctactctagtctgtgtgttcgttcgtttgttcgttcttttcttttgttttttttcttttcttttcttttcctttcttttcttttcttttcttttctttctttctttccttctttctttctctctttctttccttttctttttccttttcctttccttttacttttctttttctttttccttttcttttaactttcttttctttctttctgtctcactccacttggtcaggctagagtacagtggcatgatttcagttcactgcagcctcaatctcctgggctcaaatgcttctctcacctcagcctactgagtagctaggaatacaggcaagtgccaccacacccagctaattttctttttgttctttcagtagagatgggtttcaccatgttgcccaggctgacctcaaactcatggactcaagcaattcacccgcctcagcctcccaaagtgtggggttacgggcatgcattccgcacctggctactctagcatttctttaccttcaacatcagcagcaataataacccatggtagctggatgagggattgtaaatctgagtattgaggacaggggtaaagtgtacatagacttgtgagaaccatacagtaaacacttgcacgcagagccgctggctacaccgagcagcacattatgcactgtacagcatttttgtattgctgtgtttggctgtcttagtatacttggtgtttaggcctcatcacaaaatagtcacatgcagggaaaaatcaatgaaccaacgtgattccttgttatactgatgccattcccttatttatgaatttcacatgagttcattcacatcgcagaaacacatgctttcacagaataaactgtatacttggatctacccatttttttctatatgaatgtagcataacagttctgtgttaatgaacacagttcatggtttaaattttgtgttttagaaaatgtaatgagcaacttatttatatctgtgatacccaggatggggtttcaggtggtgtttttagattcaactaagcagtcaaactcacaggacctaatcaagccatgttgagaaaagattcccttcgagaaggatattagaaggaatacacagcgtgccagcgcagtagagccaggcattcctcttgggctccacatagcagtggaagggctgtcatctgtgcctctctccctccccatgcagctcaagtaccagagcacaagaccacaatagacagatgggaggaccagcctggcttagaaagatcatgtcccaaataggaaccagtatctttttatttttagagatctgcttaaatagatagttgcagctcatatacatcatgcctaaagttaatacaattctggaaagaatgaaattagtgcttgtgattactgttcttgtctaggtgaccacaaagtaacaatgatggaaacttacggaagggacgtacatttattcctcccatgggaagtgtggtttttttttccttaagaaattttcttaagtgactccctttagaaagctgtacattggccagaaatgaaaatgtttgtgcttttcagcagaagcgctgacagtagtaatttcattaacttctctcaaatcaactttgtgtccttgaactattttttttttaaagcgtggtatcacagtacttgagatggccatctggtgttcaatggaaagatttaaagaacactcagaactgtccaaagatgaaataagctctgtaagaggcagtgaagtcctcatcattaggtgacctcctgataggaattgtatggtgtgaattaaaatattgggtagatggtagagcatgatgatattttagacctttcaaggaagtccttttaccccatgattctgtcccacttgttttgcatgttacacatgtttctgtgatcacagagttgaaggtgaggaaaacattttcagtgtaattcagacagctattctccctgaccccaaattatctgtgcatttgcctcaatcacccactttgctttacctggagagtataatatttctgtagcatttctgtttccatatagatttatcttcattcatcacagagttctaaatgccagctgcctgccattccaagggaattgaacacaatggaagcacttagggcagaaaatagatttcacttcaaggttcagtctagtcatcttaaaggtttatgtatttcaccacttttaagtgaatgtcttgtcagcctctcacagttgaaacattttaaatatgtatatcagaggaattgcagaaaatattaggagttgcagagaatctagtctaattaaaccctgttggtgattttcagaatgaagcgatgactggttctcacactcagaatcgagtactctctcgaatcactctggcattaatggaggacactgggtaagacagctgtgacaagaggatatgaattgcttatgaaaatgaaattaatactgagcttatagcttaagaaaatgctgacattttatgctgaagcaaaatatacttattaattatttgaatcttgtacagttagctgtccgttattcataccaactccattcattcattcgttcattcaataaatacttttgttgttggttttaaaatagggtctcactccttctgcgcaggctggagtgcagtggcaatctggactcactaatcctggacttcccgggctcaagcagtcctctcacctcagcttcctgcgtggctgggactacaggcacgtgccaccatgcctggctaactgtgtatttttaatagagtcggggttttgtcatgttacccaggttcacaaacttctgggctcaaatgatccacccaccttggcctcccaaagtgctgggattacaggcctgagccacctcacctggcctcaacaaatatttgaggccccgagacatagtaataattaggacatacccctgatatgatttgttttcgaataagcaggggctgagcccatatgaaggaaagagtaaacaatttttaaattataaaggaaagactaaacaatgtttaaattatgaaggaaagactaaacaatttttaaatgactggttttttataaaacaatggaactttcaggtaaagccatgaaatactgttttgtttatttttttaagtagagacaaggtctcactctattgcccaggctggtcccaaacgcctgggctcaagcaagcctcctgccttggcctcccaaagtgctgggattacaggcatgagccaccacgcctggcagaaatactgcttttaaatgaaatcttttatacaacccctacatataaaaaaaatgaaagctgctttagtggaagcgttgttacctcttactctttctaagacagtctgagagaaaattagaaaattgaatcaaatttgaaaattaatggtagaggtgctattaaaaccatgaaaattgttgacactaccttcactgttgagaggtgaaagaggtaaaagcatttaaacatatagaggttattctttctttttttgagacggagtgttgctctgtcacccaggctggagtgcagtggtgtgatcttggctcactgcaacctccacctctcagggtcaagcgactctcctgcctcagcctcctgagtagctgggactacaggcgtgcatcaccacacccagctaatttttgtatttttagtgtagatggggtttcgccatgtcggccaggctggtctggaactcgtgacctcaggtggtctgcccacctcggcctcccaaagtgctgggattacaggcgtgagccaccgtgcccagcatatctcatcgagttttatgagacttaaatgagtaaatatctgtaaagctcttagtacagcgcttggcacactgtgagtgccaactaagtatgagcatcatataaaaacctgagctaaggcttcatgaaacaatacttaccctgaccacctacagtgcagtcctttattgtattgagtttttatttttattatttttttttatttttagtttttagtttttaaagagagagaaagaaatgttaatcaagatccactacgttggtttgacaactcactaatactcagaaactctctgtttctaatgccccctctactccctcactagtgctcatccttctgagttgagctaaagttgcttcctcagaaaaaccttcccgaattcttcagactaatgtaggtgtttctgttactgtgttcctgttagcatcatatacttctcctttggaatattcatcacacttcaaatgttttgttttagtatctgtcttccctactagattatgatcttcatgagagcaggttctgtttattgatttactactgtagccttcatttaacaaagtgcctaccatgcgacaaatgcttaggaactgttgactgctaatacagaaagagctgcaaagaaacggttatcaggaaggtctcatgatgtgtagctggagtgcccacctgaggatggaataacagcgctgataagatattctgcgctcatcgacatgtaccttcacaaaggagtctacttactccacattttattcatagggctaagggcttctgaacctgagcactgctaaaataattgctagtgcacaacattaggggcacctgtcactatctggacagtttgaccttgctgcgataccaagttagctagtaacgtaactcacattgtagttgcagaagttgcaggcattttggcattggagcaccgcgactccttcagtttctgtctgagtgagagttttgttcgttgacaggagagaagttttggaagatgctacattacacatttgtttgattttgtagcaaggtggtacaagtggaggggataattcttatctccccaactttcaagcctatttttttcaatattattattttttattatagagatggggtttcgccacgttgcccaggctggtctcaaactcctgagctaaagtgatccacccaccttggcctcactaagtactgagatttcaggcgtgagccactgcgcccagccctgagcctatgtttttatttactgttttgataatgctaaaggaacaaaatataatacacacaggtaagagactattttgtataattttataacttttgcaagcaaatcttgtctctaaaaataaataaaaactaaaacaaattgattgctttcaattaaatttgtctggaaactccatcagtgctttcttttttctcttactagaacttttttttttgagacaaggtctcactctatttcccaggctggagtgcagtggcatgatcctgggctgaggtgatcctgccacttcagcctctcaggtaactgagactataagtacacaccactgcacacctggctaactttttgtatttttagtagagacagggtctcaccatgttggccaggctggtctcgaactcccaacctcaaatggtcaaccgcctcagcctcccagagtgctggggttacaaatgtgagtcactgcgcccagctaggacatttaaaaactaatggacataggctgggcacagtggctcatacctgcaatcccagcactttggcaggccaaggcgggtggatcacctgagatcaggagtttgagaccagtgtggcaaacatagtgaaaccccgtctctactaaaaatgcaaaaattagtcagacatggtggtgcatgcctgtagtcccagctagttgggaggctgaggaaggagaatcacttgaacccatgaggcagagcttgtagtgagctgggatcgtgccactgcactccagcctgggtgacagagcaagaccctgtctcaaaataaaataaagtgaaaattacaatagaaattttatacttatgtcaaagtataaaagtatttaatacctccatcataagcctggttatggaatccctgtgtagcagtccctgtgcggcaagaacgttgtgagtgatcacttacagtgatggcctctggcctccaaaatctttcttaaggtcctaatgtgctcattgttgagattctcaattgttatgctagagttgtttttgaaaggacagcagtaaaaattgctttgtttgaattattccacagctggtataaagcaaattacagcatggctgagaagttagactggggccgaggaatgggctgtgactttgtcaggaagagctgtaaattctggattgatcagcagagacaaaagtaagaatgcatttcctcacagtgtcactgattacacagttcctttctgactttattctttatcctgagcctaaaatgctattttcaaaatgtagtctgagcagttcaattttaaaatatatagaaaaccatctatagatggttggtaataatatagtgagaagttagctgtaagtagtttttaatcatatactaaaggaatccacagtgaagggcccacagccatgaacatttctattcagcttattagaactcataaatatatatattttacaaaccttttgtttcctctgtcatttgtggtgttttcttcagagaatgcacctgtaaacatagatgcaaatattgattcagtatcaaaaaaaaggcacttttgaataggggtttccaaatccagatgcatattataatcacctagcaagcttttaaaaaatacagagtaagtttgatatctatctatatatcatctatacagatacatatcatacatagtaagtttgacattatctatatatcatctatacagatacatatcatacgtagtaagtttgacatctatctatatatcatctatacagatacatatcatacgtagtaagtttgacatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgacatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgacatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacgtagtaagtttgccatctatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacatgtatatatacagttgttctttaaccatggaggattgcttccaggacccccctggataacaaaatccatagatgcttatgtaaaagtttcttatataaaatggaatagtatttgcatataacctatgtatatcctcctgtatactttaaattacttctgggttatttataatacataatacaatataaatgctatggaaatagttgttatactatattgtttagggaaaaatgacaaagaagaaaagtgcccatgttcagtacagatgcaaccatcattttttccctgaatttttcttttctttttctttttcttttttttttttttgagacagagtctcactctgttgcccaggctggagtgcagtggcgcagtctcagctcactgcaacctctacctactaggttcaagcaattctcatgcctcagcctcctgaatagctgtgattataggcgtgcgccaccactcccggctaattttgtaattttaatagagatgggatttttccttgttggccaggctggctcacacctgtaatcccagcactttgggaggccgaggcgggtgggtcacttgaggtcaggagttcaagaccagcctggccaacatagtgaaaccccatctctactaaaaatataaaaattagccaggcgtggtggtgggcgcctgtaaccctagctactcaggaggctgaggcaaggaaacagcttgaatccaggaggcaggggttgcagtgagccaagatcgcaccactgtattccagcctgggtgacagagtgaggctctgtctcaaaaaagagaaagcaacagcaacaacaaaaatgttacatgaatgaattcatattgtatgtgaacttttgagcgtggctttttttactcagcataattctctggaaattcatccaggttgttgtatgtatcaataatttcacttttcatggctggttaatattccgcagtatgatacaccacagtttgtttaaacattcacactttgaaggacatctggattgtttccagttttgggctattatgaatgaagttgctgtgaacatttatgtacaggtttgtgtgtgaacatatatctttatttctccagaaaaagtgccaggaatgcagttactggctcattaagtaattacaggtttagttttgtaagaaaatgccaaactttttaattcctgacagtgacgtgtaagtgatatagtttctccacatctttgccagcatttggcgttgtcacaattttttgtttaatcgattctgataggagcgtagtgatattttattttggttttaatttgtgtttccctaacggctaatgatgttgaacctcttttcatgtgcttactcactgataatatatcctctttggcaaattgtctctttgtctttttttttttctgagatggagttttgctccgtcacccaggctggagtgcagtggcgcgatcttggctcactgtaacctctgcctcccaggttcaagcaattcttttgcctcagcctccagagtagctgggactacaggcacgtaccactatgtctggctaatttttgaatttttagtagagatggggttttaccatgttggccaggctggtctcgaactcctgacctcgtgatccacctgcctcagcctcccaaagtgctgggattataggcgtgagccactcttaagccaattttttaattggattgttttttactgttgagttttgagagttcttcatgtattttgggtattttgggtagtagtagtcctttgtcagatatgtggtttgcaaatattttctcccagtacatagcttgtctttttgtccttttaacaggggcttttgtagggcaaatgtttttagttttgacggagtccagaatatcagtttgtcctcttactgtgtctttgatgtcaagtctaagaagtgtttgccaagctctagatcttgaaagttttcttatgtttttttcaaaagttttgtagtttacactttacatttaagtccatgattcatttgagttaagttttgtataaggtgggagacttagatcaaggtttgtttctttgtgtacagataggcaatggctttagcaccatttgttgaaaaggctatctttccttcatggaattgcttttgtgcctttggcagaaaccatcagttgggtgtatttgtggtgatctgtttctatctgtttctgtgttttccgttctgttctagtgatccatgtgtccatgccttcaccaataacacacagtccttaattactgtaattatttaataagtcttgaaattgggtagactgattctttccactattttaaaattgttctggctgttttggttcctttgcatttccatctacgttttacaattatctcgtctgtatctgccaaaagacttgcagggattttgctaggagctgcattaaccctgtgtgtcagtttgaggagaattgacatttttactgtgttgagttttccaatccataaacatgggagaaaacattcagtctttcattattaaatataatgttagctgcagattttttatacatgttctttatcaagttgagaaagtagctgtctattcctgtgtttctgagagctttaatcatgaatggatattgccttctgtcaaatgctctttctactttagttgctatgcataatcaagtgatttttttcgcctgttaatatggtggacttcattggttgattttcaaatattaaatcacccttgcattcctggagtaaaccccacttggtgatggcttataattatttctgtatgttgctgaattctatgtactattattttgttgtggatttttgtttctatatttgtgacgaatatagatctggagttttctcttttttccccaattattttacctttaattaatcagtatggctctcagaacaattatattatgtcagttaaacttgatctttttcaaatctgacacattttgaaaaacaggtatatccttccagtaagagagatttaaaaaataatagtaagaagaaaatttatgaaatacataataattattactaaatgagcaaataatgggctctcctgtcatacttaatattgacttgatttaaattattatttatggccagacatggtggcttacacttgtaatcctagcactttgggaggctgaggcaggctgattgcttgagcccaggagttcaagactagcctggacaacatggcgaaagcccatctctacaacaaaatacaaaaatgaggtgggcatggtggcccatgcctgtagtcccagctactcagaaggctgaagcaggaggatcacttgagcccagaagctcaaggctgcagtgagctatgactgcaccactgcactccatcctgggcatctctacataaataaatgatttatataatactctgaagaataaatcccagtatatgatgaggtgtttatcatgctttatttttattttgattcagttcaaaatatttttctcttttaattcaaaactcttgtgtcactttgagttcaaaatatttttaactttctcttgagatttcttctttgaccactgtataatttagaagtgctttgtttaatttccagctattttgagatgttccagctatctttctgttactgatttctagtttaattccattgttgcaagagagcagaacatggtatgatttctcttttacatttgttaaggtgtgtttcatggcccagaatgtggtctgtcttggtgaatgcaccatgtaagcttgaaaaaaatctgttgtctgctgtttttggttgaagtagtctgtagagtctgctatatccagtttgttaatggtgctgttgaactcaactgtgtccttactgattttctgcctgctgcatctgtccatttctgagaaatggatattcaaatctgcagtgataataatggattcatctatttcatcttgcagttctatccattttgacttacatattttgacactttatagttaggtgcacacatgtttaggattgttatattttcatagagtactgattcctttatcattttgtaattcctctctttatctctgatcattttctttgaaaagaaaaaagttcttttttgtaccatctttgtctagtttctgtatcagagtaatactagctttataaaatgaactaggaagtttttcctcctcttctatttttctggaagagattgtataaaattggtgttaattcttctctaagtgtttggtagcattctccagtgaaacatctgggcctggagatttctcttttggaagtcttaaaattgtgaattattgtgaattaaacttctttagtagttacagggctattcttatcatctgtttcatagtgcatgaattgtggtaacatgttttttaaggaattggttcattttgtctaagttatcaagtttatgtgtatagggttttttgtagtattccattattattcttttgacatctgtagggtctgttttaatttgtaatttttgttggtacatactaggtgtatatattaatggggtaaatgagatattttgatataggcatacactgtgaaataatctcatcatggaggatgggatatccatcctatggggtctgttgtgatatctcttttcagtcctgatattggtaattttgcatgttctctttatctttttctagaggtttgccaattttactgatcttaaagaaccagctttttgtattgttgatgtcttctattgtttttttgttttcaaattcattgatttctgctccctgctatatctttcccactgcttgtttttggtttatttatttaattattatgatgatgattattttttgagatggagtctcactctgtcgcccaggctggagtgcagtggcacagtcttggctcactgcagcctccgcctcccgggttcaaacaattctcccgactcagcctcccaagtagctgggactacaggtgcacaccaccacaccccgctaattttgtattttttagtagggatttcaccatgttggccaggctggtcttgaactcctgacctcaagtgatctgcatgccttggcctcccaaagtgctgggatgacaggtgtgagtcaccacgcccagcgttttctgttttgttttatttttaaagacaaggtctgttgcccaggcttgagtacaatgggtgcgatcatgaggctcactgcagccttgacctcctgggctcaagcaaacctttctcctcagcctttcaagtagctgggactacaggcacacacccccacacccagctaaatttttgtatttttgtagagacagggtttcactgtattgctcaggctagtcttgaactcctgggctctagcaatcggcccacctcggcctcccaaagtgctgggattatagtcgtgagccactgtgcctggcctatttttctcttcttaatcttgatttttgagattattgatttgagatatttcctgtttctaatgtagctatttgttgctataaattttcctcttagcatttctttagctttatctcacaaattccaatatgttatatttttattttcattcagttcaatgtatttttaaaaatttttctttgagattcttctttgacccatcgattatttagaagtgtgttgtttagtatacaaatatttggaaatttttctgttattttttgttgttgaattgtatttggagaatatatgctgtatgatttgagttcttttaaatttgttcaggtttgttttatggcccaagatatggtcttatcttgatataagttttttatttttttttattattatactttaagttttagggtacatgtgcacaacgtgcaggtttgttacatatgtatacatgtgccatgttggtgtgctgcacccattaacttgtcatttagtattaggtatatctcctaatgctatccctcctcactccccccaccccacaacaggtcctggtgtgtgatgttccccttcctgtgtccatgtgttctcattgttcaattcccacctatgagtgagaacatgcggtgtttgtttttttgtccttgtgatagtttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacaatgtaaaagtgttcctatttctccacatcctctccagcacctgttgtttcctgactttttaatgatcgccattctaactggtgtgagatggtacaccaaaagcaatggcaacaaaagccaaaattgacaaatgggatctaattaaactaaagagcttctgcacagaaaaagaaactaccatcagagtgaacaggcaacctacagaatgggagaaaatttttgcaatctactcatctgacaaagggctaatatcgagaatctacaatgaactcaaacaaatttacaagaaaaaaacaaacaaccccatcaaaaagtgttttttttattttttaaatttttttgagacggagtttcactctgccacccaggctggagtgcagtggtgcaatctcggctcactgcagcctctggtgccgagttcaagctcttctcctgccccagccttccaggtagctgggactacaggcgcccaccaccatgcccggctaatttttttatttgtagtagagacggggtttcattctgttgaccaggctggtcttgaactgctgacctcagctgatctgcccgccctggcttcccaatgtgttgggattacaggcgggagccaccgtgtacattcggacgctgggtgaagcgttgcacaaatgtcagttaagtcctgttggttgatgatgttgggttcttctatatccttgctaatttcctgcctagttggtctatcagttgttgagagaattcaccaccatatcagtctttgagtcctgaagtccctaactagtctgacttctctccacccttcagagccccctaactagtctgacttctctgtaccgttcagagcctcctaacgagtctgacttctctccacccttcagagtcccctaactagtctgacttctctccacccttcagagtcccctaactagtctgacttctctgtacccttcagagtcccctaactagtctgccttctctgtacccttcagagccccctaactagtctgacttctctgtacctttcagagcctcctaactagtctgacttctctgtacccttcagagccccctaactagtctgacttctctccacccttcagagtcccctaactagtctgacttctctgtacccttcagagtcccctaactagtctgacttctctgtacccttcagagtcccctaactagtctgacttctctgtacccttcagagccccctaactagtctgacttctctgtacccttcagagtcccctaactagtctgacttctctgtacccttcagagtcccctaactagtctgacttctctgtacccttcagagccccctaactagtctgacttctctccacccttcagagccccctaactagtctgacttctctccacccctcagagccccctaactagtctgacttctctccaccctttagagccccctaactagtctgacttctctgtacccttcagagccccttaactagtctgacttctctgtacccttcagagtcccctaactagtctgacttctctgtacccttcagagccccctaactagtctgacttctctccacccttcagagccccccaactagtctgacttctctccacccctcagagccccctaactagtctgacttctctccaccctttagagccccctaactagtctgacttctctccacccttcagagccccctaactagtctgacttctctccacccatcagagccccctaactagtctgacttctctccacccttcagagcctcctaactagtctgacttctctgtacccttcaaagcctcctaactagtctgacttctctgtacccttcagagccccttaactagtctgacttctctgtacccttcagagcctcctaactagtctgacttctctccacccttcagagccccctaactagtctgacttctctccacccttcagagccccctaactagtctgacttctctccacccttcagagtcccctaactagtctgacttctctccacccttcagagccccctaactagtctgacttctctccacccttcagagcctcctaactagtcggacttctctgtacccttcagagccccttaactagtctgacttctctgtacccttcagagccccctaactagtctgacttctctgtacccttcagagccccctaactagtctgacttctctccacccctcagagccccctaactagtctgacttctctccaccctttagagccccctaactagtctgacttctctccaccctttagagccctctaactagtctgacttctctgtacccttcagagcctcctaactagtctgacttctctgtacccttcagagtcccctaactagtctgacttctctgtacccttcagagtcccctaactagtctgacttctctgtacccttcagagcctcctaactagtctgacttctctgtacccttcagagccccttaactagtctgacttctctgtatccttcagagccccctaactagtctgacttctctccacccttcagagtcccctaactagtctgacttctctccacccttcagagccccctaactagtctgacttctctccacccatcagagccccctaactagtctaacttctctgtatccttcagagccccctaactagtctgacttctctccacccttcagagccccctaactagtctgacttctctccacccttcagagccccctaactagtctgacttctctccacccttcagagccccctaactagtctgacttctctccacccatcagagccccctaactagtctaacttctctgtatccttcagagccccctaactagtctgacttctctccacccttcagagccccctaactagtctgacttctctccacccttcagagtccccttaactagtctgacttctctgtatccttcagagccccctaactagtctgacttctctccactcttcagagccccctaactagtctgacttctctccacccttcagagccccctaactagtctgacttctctccaccgttcagagcccgctaactagtctgacttctctccacccttcagagccccctaactagtctgacttctctccacccatcagagccccctacctagtctgacttctctccacccatcagagccccctaagtagtctgacttctctccacccttcagagccccctaactagtctgacttctctccaccgttcagagcccgctaactagtctgacttctctccacccttcagagccccctaactagtctgacttctctccacccttcagagcctcctaactagtctgacttctctgtacccttcagagtcccctaactagtctgacttctctgtacctttcagagcctcctaactagtctgacttctctccacccttcagagccccctaactagtctgacttctctgtacctttcagagcctcctaactagtctgacttctctccacccttcagagccccctaactagtctgacttctctccacccttcagagccccctaactagtctgacttctctccacccttcagagccccctaactagtctgacttctctccacccttcagagccccctaactagtctgacttctctccacccttcagagccccctaactagtctgacttctctccacccttcagagtcccctaactagtctgacttctctccacccttcagagtcccctaactagtctgacttctctccacccctcagagccccctaagtagtttgacttctctccactcttcagagccccctaactagtctgacttctctccacccttcagagccccctaactagtctgacttctctccacccttcagagccccctaactagtctgacttctctccacccttcagagccccctaactagtctgacttccctccacccttcagagtcccctaactagtctgacttctctgtacccttcagagtcccctaactagtctgacttctctccacccttcagagtcttcttttgtttctttaatttacagtgtctgggtttttagttgtacttagaagggggaatagagaaaagcacatctagtccatcttccaggaattagaagtggtactgatatttctattgttatatttaaaaaaaaattcccctggtgggccgggtgtggtgtggtggctcatacctgtaatcccagcagtttgggaagagggaagatggcttgagcccaggagtttgagaccagactgggcaacatgaccccatctctacaaagtaaaaaaattaggctggcatggtggcgtggccctgtagtcccagctacttggaggctgtggtgagaggatcccttgagcccaggaggtcacagctgtggtgagctgtgagcatgccactgcactccagtgtgggtgacagcaagaccctgttgcaaaaacaaaaaaaaaaaaaaaaaaaggaaaagaaaatactattctcatcttttctcacctaggttaggtcataaagcaatttaaatcacttgtagtttctactaaggagtctgacctctgagttgtaaccctaatgtgaagataataggcagtagccggaagcaccggcaaccactctgggtgtccccagcttgttacccctgcactacaggttgacctgccagttctcaaattttgctgcttatgaaaatcgtctacagaactggaaaaactctccataccccagttactaattaagtcatgactgtgctgagagccgggcactagcattgtgtgagtttgttttaataaattcccaagtgattttatgtgtaatggagtttgggaaccactgttccggtgtgtcaaaggaagtatgtaactcacactgcagctgcaagagcttagggaggtttttgtttgttcacttttctgttaacagttgcaactctgtttattccccttttggtcccaattataacatcacctaagaccagaaacagaagggacttctacttctttattcttaaaaactaaaactgtgggtcccctgaattctctcctgtcctttgattcttaagccactgtcagcaaggtttttttttgaagtccaaatagtaaatattttaggttttgagggttattacagtctctgtcacaactacttacctctacttttatacagcaagaggcaaaacaaatgggcatggccatgttcctgtcatcttccccatctctacagaaagtaaatgagcatggtggcacatgcttgtagtcccacttgcttgggaggctgaggtgggaggattgcttgagccgagaagatcaaggctgcagtgagcaatggttgtgccactgcactccagcctgggcaacgaaaccctgtctcaaaaacaaaaaatcgacaaggaaaaaaaaaacaggttgtggtcaggatttgacccaagagttgagtttgctgacccctgtcacagtcattcaaatgtcccacttgtgaggcattgaaattcagaatcatttacaggatagaagccatcttctgacatcacagacccagtctgcctgtatgtatgttagagattccagtgtggctgttctcaagcacttctgggcttcgtcatttgtgactcttctccattgttgggaaaccagggtgagaagggattggttgagtgagcgtaggcagagccatacttctttgaatcacttgaatctacacctacttaaagtaaggttctttctatgttcgaagcaactaaaactgataaatcgcccaactcctctgcctagctcatttggtgttaatattggctctagagctatactgtctaatatggtaccattagccacatgtagttaaacttatatttaaattaaagttaaataccatttaaaatttagttcctcagggccaggcatggtggcccatgaccgtaatcccagcactttgggaggcagaggtgggcagatcacgaggtccagagattgagaccatcctggccaagatgatgaaacctggtctctactaaaaatacaaaaattagctgggtgtagtgggacacacctgtagtccgagctacttgggaggctgagggaggagaattgcttgaacccgggaggtggagcttgcagtgagccgagatcgcactactgcactccagcctggcgacagagcaagactctgtctcaaaataaataaataaataagttcctcagttaactagccacctttgaagtgacatacatgattagtggctaccatattgggcagcacagatgtacaccttttcccgctctcttgacagtgcttctctggaatttgtaagccatgaatcttagacagctctaactttggaatgtttaaaatcactaagttttaacttcttttttcctctttattcatttagccaaaactcattttatataatttaaagtaaatataatatgccttttggttttagacaaaaaacagaaatgactttcatggtatcaagaaagtaactgattaacaactattggaacatgagcttccatattcattggaagctttatcatgggaagttaaaatattgccttatatgaagattttacgaaaatggtataaacagcggaaatcacatttattgagtagcctgcatgtgccaggcactgagtgctttgcggttgaagctcaggaaagttaagtaaattccacagaagtgtggctggtgctggtgtttgaacccagacctgtgtgacgacttcaaagcctttgctttcctgttaggctgtgctgcttcccatttgctgaagactgtggcaagtattttacgtgtttcatcttaggaagctgtaactccctaaagatgtatgctgagacaccatgttcatttaaataagacaagtcatcaattttccttaaaataagaaatatttaatacaggcttttttttccttaagaaatatgtggaagaagaggaaaattgtcaataattcgattacaatttgttagaccagtattaataggatttctattatttaggaatactgagattttatctatgaagctgctattgtgatattaatataatttttatatcgtcaactgtcagtttgatgactgctaagaattacaggtttgtttgaaggttatttttgcaagacagtgcaacagattctgatatcttttgataatttacatgcccttttttcaaattatactttcaagattacatttaatggaacagaacaagttgataacaattaggaatattcacacaatctttattttgcacaggaaaataagattgtctggtgaaggtggtcagttaaacaaactgtcagattattgagcagagaaaattccactctttgtagctgcagggcagaggggacattgcctccatctctttccaagaatcccatttgttaattatgaaggtttgtatttttaggccaggatctggaattccatttgttggctgtataatggacttgcagtattttctttaaagtttgataccatggtacttctctttgtttgcaggagacagatgctgagcccttactgtgacacgctcagaagtaacccactgcagctaacttgcagacaggaccagagagcagttgccgtgtgtaatttgcagaagttccctaagcctttaccacaggaataccaggtagaacagggctggggcacagtttcaggaatcagcttttcaaaagtagtctccattttaactaaaagagtaaattctcttaagattcttaatttataaggccttgtttgttttctgtaagttagaaaaaaatggaataatgcttccatttctttaaaactaatgtcctaattgatagcacttagttaaaatctagcagtgtcttataataatggcaagaataatttgaatatttgatctgtttttacctgtttatgttttctaattgtttccaaagccttgctatttaaattcctctaatttacacagaaaaagaaatctttaaagaaaataacttaagtactccaatccagttaattagaagacttggaaaccctgctttggaaaagatttgattcatgggatctgaaagattaaggaaatggtcccacatatcttgtctggatctctgatttgacctttatgtttctttttatcttttatctttttttccgagaccgagtctcactctgtcgcccaggctggagtgcagtggtgagatctcagctcactgcagcctccccttaccagattcaagcgattcttgtgcctcagcctcccgagtagctgggtttacagctgcaagccaccatgcctggctaattttcatatttttagtagagttggggtttcgccatgttgcccaagctggtcttgaactcctggcctcaagtgatccatctgcctcggcctcccaaagcgctgggattacaggtgtgagccaacatgtctggctactttttgtatttctaatagagacagggcttcaccatgttggccaggctggtctcaaactcctgacctcatgtgatctgcccgcctcagcctcccaaagtgttgggattacaggcgtgagccaccatatgcctggccatgacctttaagtttcttgttgccaaagctatctttaaaaagcctcaactttacctgccatttataaaggaaccttttgtcagaaatgatgtctcagaagctaatttaaaataaagctgctgaattttaagcttcctacacatatttgtgagctcactgaatgcttcagataccataaaatagtaactatattcataggcatagtgatataactcaataagttggtggaaaacgtgacatctttaaaaatttatctggtgcatccaggggtgtgaaaacacatacaattattttatttttatttatttatttttggagatggagtcttgctgtgtcaccaggctggagtgcagtggtgcaatctcggctcacttcaacctctgcctcccaggttcaaactattctcctgccgcagcttctcaagtagctgggactacaggtgtgcgccaccacacccagctaatttttgtattttttttttttttttttttttttttttttttagtagagacggggtttcactatatgttggccgggctggtcttgaactcctgacctcaggtgatccgcccacctcagcctcccaaagtgctgggattacaggcgtgatccaccatgcccggccataaaattaattttaaaaaaaaggaacaataaaatttatctggtgccttgtacctttggtattcaaagtatattatatatatgatctcatttattttctcagattttaattttttcaagtttgtcaaaacaacgtataaactgcctcctaaaaactcttgaaaaatttatttaaaatgttgtaactttatgcattagttctgtgttttgtcagctcttaaaacttctttttgctcagtgtaattaaaactacatgctgttaaaacattagtctaatttaacattatgatatataacttaagactcatttacttaccttgcttatttgtaaaactgtagcaacctttaactactcctctggtggtttattactgtgttctttatttggtgccattgatgaagaaaggtacattagtatcttgtgttatgtggcattaaagggttgcgagaaattgcctgtgcacttcctcaattttatacagaatgtttcttactttcttgtcttcccaatattttttctgcagtactttgatgaactcagtggaatacctgcagaagatttgccttattatggtggctccgtggaaattgctgactactgccctttcagtcaggaattcagttggcatttaagtggtgaatatcagcgcagctcagattgtagaatattggaaaatcaaccaggttagtcggctagtgaaatgaagtattatatacatattaaaattatgtattagcaatatagaatcgtggttaagggcacagaccctagagcaggactgtctgaatttgctttatagttcagctgctatccatatgtaagaagtgacttaacttttccctgcctgtttcttcatctgtacgatggaggcaatacttagagagttgtgagaattaaatgaattaatgtagtaagtgcttacaattgtgcctgacccatcgaagggattattcgcgtatgcatgcacacacgctatattttggtcataccttctagctgcacggcactttccatttgcaaagcactttcattcttaacattttattcttctgaaaacatgatgagaaacataaggaagatattactgtatttcccagataggcggatagatactaagtgatatagttaaatttgtgtcagtgcaagatcctccaatgccatcctctttttattaaaatacctcagataagctgctttttcctcttgtggggaatgtgcattttatgtaagatagaagcaacatgtcactcttcagatagcaaaacaatgttcttgtctcatggccagtaagatataccaccatattatttgtttcttcttaatacatataaatgaacaagatatcaaaggaataaacagtatggcaattgggtattctgcaataatagttacagctcatactaattacctttgtaaacagaaatgttctcacatctgatgtaagaaagagcagtaagtagtttttctctctgtgttcatcagaagttttaacctagtctccaaacccccaccccattccatactttattacagactaaggcatttacattctaaatttttgtattcttaccttttactcttaaacttggcagatgtaactggattcctgcagtcatttttccccatcattcatctattcaataaatgtcctggccaggcgcagtggctcacgcctgtaatcgcagcactttgggaggccaaggcaggtgaattgcttgagctcagaagtttgaggccagctgagcaacatggtgaaaccctgtctgtatcaaaaatccaaaaaattagccaggtgtgatggtgcacacctgtggtcccagctatggaggaggacgaagccagaggattgcttgagcagcccaggaggcggagtttgcagtgagtcgagatcatgcccctgcactccagcctgggcaacacagtgagaccccatgtcacataaaaataataaataaataaatatcctaacaacttataaccactcagcagttccatattaaagcaaaagaaatgcacagatctgtcagttatggatttgccagagatgtactatcacatgttattgttttagagctggagctggcaaacgttttttgttaacggggaaaattataaatatctggggctttgtgggtcataaggtctctagctttctgattcagctcagccgttaccgtctgaaagcagttacagacagtatgtacgtgaatgaatgtgccaggatttggcctgagggttgcagtttgctgaattctgttttattattattattattattatttttagagacaaggtctcactctgtcacccaagttggagtgcagtggcaccatcatagctcactgtaacctgtaactcctgggctcaagtgattctcctgcctcagactccccagagccaggactacaggcatgcacctccacacctgactaatttttaaaaatttttgtagagatgaggcttgctatgttacccagactggcctcaaactcctggcctcaagcggtccttcctccttggcctcccaaagtgttgaaattataggcttgagccaccacatccagccctgaaccccattttagacactgatcactatagttttgaaagactctgatactcaaaagaagtaaagaattctgttttattctaatttgcattttttagcttatataattcagatttatcaaaactggcataaaacacttatctttataatattttaaaatgggctaattgaactctctacttccccaaagacaacttattgtaaagagtctaaagagagcaaattactgctcgggtttaagagctttgtccctttgtccattagaggcctttcattcctctgcaggtttgtgcatactgtgagattagatcagcatcttactaggttggtggaagagtaattgtggttttgccgttaaagtaatgcgaaaaccgcaattacttctgcaccagcctaatatttgtggacttccaggaggtggcacaagttgaagatataagaaagttttcaaatgttgcaacaccccccaaaagtctgcattatataaatcacttggcctcatcctatcatgagtaatttggaggtgcctcctatttagaccaccagtgaagatgattttatcttggtgtctagtgatctaacgattcttagtgctagttcttctatatatttaacctagaaaacgttgggcccagttttattcccttgtgtctgatgcagtaattttctcccattaattcctttattaagaacctagtgtgagtttggaaccctgtggatcctaattttttttttttttttttttgagacggagtctctctctgtcgcccaggctggagtgcagtggtacaatctcggctcactgcaagctccgcctcccgggttcacgccattctcctgcctcagcctcccgagtagctgggactacaggcgcccgccaccgcgcccggctaattttttgtgtttttaatagagacggggtttcaccacgttagccaggatggtctccatcttctgacctcgtgatctgcccacctcagcctcacaaaaccctgggattacaggcgtgagccaccgtgcccagcctaccctaattttttaaatttaaaatttccatgaaacatgtctgatttttaaagcaacttttaatcataaaaatggaatggttcagtttcttgttctttgagccaaaagtcaatttttaaggagacttttcttctttgcctcagaaatttttaagaactatggcgctgaaaagtatggacctcattccgtttgtctaattcagaaatcagcattcgttatggagaagtgtgagaggaagctgagttacccagactggggaagcggatgctatcaggtaagcttatgtttgttattagttgtgccaaatattatgtgattttatctcttttatggttttgtattttaaattatattttcatattttatgtcattaatttactgatcaatactgtatcttgtttatgtaaatattagtttggatgcttatgttttatgaaaatattgtcatttctttagaaaaagtgcctcttaaaaatatatatgtaattactgtaatgttacttctgggcatatattctgaggaagtaatggtaaataggtaattttgttcttgagcaaatattactttgtaatggaaaacatgtcaattttatttcaaaaggtctgaggacctcatgggttataagaattagtaaatcaggctggacgtggtggctcacgcctgtaatcccagcactttgggaggctgagccaggaggattgcttgagcccaggattcgagaccatcctaggcaacaaagcgagaccctgtctccaaaaaataaaggaaaaagaataaatcagttgctgattaataatagagtgttttttcctttgtaattagaaatccaaaaagggcaaactacaattttttttcctttttctttttcttttttttgagacaaggtcttgctctgtcagctaggctggagtgctgctgcagtcacggctcattatatcctctacctcctgggttcaagcgaccttcccacctcagcctcctgaggagctgggactacagtgtgcaccacacacccgactaagtgtttgattttttgtagagaagaggtctcactatgttgcccaggctagattagaacttcggggcccaagcaatcctcttgccttggcctcccaaagtactgggattatagatggcggccaccatgcctcgcctactatttccttaattatcttatttgcacatctgatattatatgacatcaccttattaaggacttataaagatgtagccattctgtgacttaggagcatccaatggaatgaatcttctgcaccctacaaatggatgtcagggaggacagcgtaagcctgagaaatgcagaatcagcattcctgtgccatttcagctgcaagagctaaacggacctttagaactggaaatttaactcttatcattagttacttatcaaattaacgttttttttggtaactgcttttcttcttttctgtttttttttgagacagggttttgctctgtcacccaggctagagacaatggtgcgatcacgctcactgcagccacgaactcccaggctcaggcgattctcccacctcagccatctgagaagctgggactacaggtgcacaccaccacacctggctgatttttcttattttttgtagagacaggcttttgccatgctactcaggctggtcttgaactcctgggttcatgtgattcacctgcctcagcctcccaaagtgctgggactacagacatgagccactttgcctgacctggtaatagcactatcaagatatattttacataccatacaatttatgtaaaattaactttttttttcatttttcctcttttgagacagggtcttactctgtcacccaggctggagtgcagtggtgcgatctcagctctctgcaacctccacctcccggttccagagattcttgtgcctcagcctcctgcacagctggaatcacaggcatgcgccaccatacccagctaatttttgtatttttagtacaaaaattgaccaggctggtctcaaactcctggcctaaactgatcctcctgcctcagcctcccaaagtgctgggattataagcatgagccaccagtcctggccgaatatttcttttctttctgtaacaagatattctaagctcactttgttctttgtctacccctgacgtggaattaaccgtttctccagaggcccctagttacttttaatggagtatggtgtttagagactaagatctgggcggtaattatactgttgattgcttttggtggagtgtttggtgttagagactaagatctgggcgctaattatactgttcattgcttttagtggagtgtggtgttagagactaagatctgggtggtaattatactgttgattgtcattgataataacatttgggaattgggaataccagctcatcaggccctcttagtaaggtaggaaatgtatgtatatgtatcagtacactctcctgtgagtgcgtgtgtgtgtgtgtaagtaatcatgagtttgcatcagtaaggttggtttgattccatcggttggagaccttgtctgataccaaagcatttattttagttttccaccttttcacatatgtacttccttcaccaacagtgagaagtccagctgctgtcatctcagcatgtttactcatctgatctatccacatcccgtccactttctcccactcccattaccctcgtcacccggccaactctgcgtgacctcccggtcacacacctcccccacccctccaaacagatcacctaccttgcctcacttaacggctttagacgtaattgcttttgaggaaggggaaaggagaaagggagggatcactgggcttttttttcttaaaattgtggcaaaatatatataacataaacatttccattttaactgtttttacgtgtatagttaagtggcactaaatacattcacgttgtcatgcacattgccaccgagcgtctcagaaactctgtactcactaaacaatccctccctcttcctcctcccccagccctgacagcctctattctacgtcctctctctgtggatttgcctaatctagatagtccttataagtagaatcataccatgtttgtccttttgtacctgactccttttacttagcgtggcattctcagggttcatccacattgtgccatgtatcagaacagtattccttacggtgttcctttatgtctcaataacactccattgtatggatctgtcacgttttgaatcagttgatggacacttaggtcgtttgtgtccacctcttggctattggagtcttgctgcagcgaacactggcttccgcgtatctgtctgagtccctattttcagtctactcagcagtagaattgctgtatcatatggcaattctatgtttagcttttttaggaactaccaaactaggttttttgttgttgttgttgaggggtttttggtgttattttgaggtttcttttttattattattaatagactttattttttagagcaattttaggttcacaacaaatttaagtggaaggtacagagagttcccatatacccctgctccacacactcgtggccttccgcaccgtcagcatcctgtaccacagaggcatttttggtacaatcgatgaacccacatcatcatccaaagtccatgttcacattagggttcactctgggtgttttcaatgaaccgacatcatcatccgaagtccatgttcacattagggttcactctgggtgtttcgatgaaccgacatcatcatccgaagtccatgttcacattagggttcactctgggtgttctacattctgtgggctttgacacctgtaggatattcgtccataagataaatgagttgttgaaatggactttgttataagttaaagattggctatctgtggctaaataattgctgagactaacataaataagaataaatgaaataaaaagtgggatgaaatacttcaggtgaaagttcaaagggaaactgtattatctctgtacaaaagagacctttaagcgtgtgttttcatgtcaaccctttgtgttcttaacatgtttttccctgatgaaactgagatcatggaccttatcatatcaccttttgtgctgatggcaccttttaatataaatttttaagtaatttatatattgattaaataagtcagcaattcacatggtgaaaaattcaaaagatgcaaaagaatgtacagggtacaggaaaagcctttcccagccccgtcttttagtcactcacttctcccttcggagggaagtaatattaccagtttcttgcatccttctaaagataaactctgtgcaggcacaaatttatatttttgtttcattttttacaccaatagtatcaagttacacatactgttctgtggtgtgtattaaagagtcgttcttagtatcatcttacatcattccagccccatgtctgaactggctgtggacgtctcaagtacatttggttgtactttgatcattctgaattcagttcctccaaaatccagtttaggagccctctctcaacaacgctgcatttcggctgtgttgcttccagcactggtcccagtctctctaattagaaaccagaatgatcattttctactctctgttctataaagacggtcaatacagactaagtctttagattactctcctattgaaatctcttatatctattttattttaggtttaccttcatagttcaagccattatcacttcacagtttcctaactaatttccctcctctcatcttacttccatgaccacgttgatccttttaaaattttagttttgatcaaacttttacatgcaaatagtttgaaacaaatttgttgtctgcttccaaaaaactacagcctcaggccaggcgctgtgactcatgcctgtaatcccagcactttggttggctgaggctaacacttgaggtcaggagttcgagatcagcccaggcaacatggtgaaaccctgtctctactaaaaatacaaaaattagccgggcatggtggccgcctgcctgtgatcccagatattcaggtggctgaggcatgagaatcgcttgaacctgggagatggaggttgcagtgagccaagatcgcaccactgcactccagcccgggcaatggagtgagactacatgtaaaaacaaacaaacaaacagaaaaacacacaaaaaactagagcctctgttattacttccctaatgtttattacttcttcccagagtcttcactttcaattcttagttgttgttttgttgggggtggaggagtcaggggagacttactatttgctttcttatttttttttattattattacttttttgagatagattcttgttctgtctcccaggctggagtgcaggtggcatgatccctcggctcactgcaacctccgcttcccaggttcaagtgattctcctgcctcagcctcccaagtagctgggattataggcgcccgccaccatgcctagctgtttttttttatttttagtagagacagggtttcaccatgttggccaggctggtctcaaaatcctgacctcaagtgatctgcctgcctgggcctcccaaagtgctgggattacaggcgtgagccactgcacctggcctgcttttttatttttaaaaagcttatattattctttcataaggtttgaatttcaaatgttagctgttgactttggaaaataagaatttagttggttcgcctcgtcctcttgctgtgttcacttcctctttccccatcgtacacttcttgtttcccatcctcccagtggtgattatggataaatacgtattcactgtttacattaccaggactatgcagacgtggcgcctggtagcatgcaatcattacttccccgttctccccagtatttcgttttctctggatttaagaccttgtttttttgcaattagttttctttgtatttagcactaattcaattctaagctcttctcccagttgggctcatctcctttcagtagaaccagatacctgaggtattctatccatttcatcttgaggaaatctcttctggacatttctggcctgtgctaatctcgactatataatccttatgttggcagcacagctggcatcttgggatctcgagtcaggatcatcctggaggtccctctggtccctctgtctctctcatattggatcccctccttcatggattttgtgtcatattcttttttggattttttttattttaatggaacatatcttctagtggagatttgaggagtatgtgacggagaacaatgttgagacttgcatgtctgaaagcatcactgttccactgtgacgcctgctgacagcgtgggaaggcgggacttcatctctgccctcagggtcttcagctagtttccaccgtgatgtgacgcctgctgacagcgtgggaaggcgggacctcacctctgccctcagggtcctcagctagtttccaccgtgacgcctgctgacagcgtgggaaggcgggacctcacctctgccctcagggtcctcagctaggcctgagaatgaaataggcataagcccgatgaacaggaggaaaacatacacatttatttaatctaagttttacatgacacaggagcccacatgagtaaatgaaaactcaaagaagtgtgaaacctatatacttttatactacattgaacaaagggagacagttacagaaaagtaaaatgtatgcggaggctaaaggaagataagaattattttaagaaggtctgtttgtaccaaattctttggctttgactccccatattggtgataaaaatgtttgttttctcctggaaaaggaagggtattattcatgtgggagttgtgtcttctgctttcaggaggaagggggatgtcagaacagtcttgctgggtctgctgtgttgaagtccctttagctggaaacctttgtgccaaaacagcacattttggggtggcgtgttctgccgtccttcaatagcttgggtgggtatagctttatttttgaaaattattttcctaatggatgattgggtgcaggaaaaaaagaaagaaaattattttccatcagaattctgaaagcatttttcctttgtgtgctgactgtcagtgtcattctgagtttcaattgccagaatcttttttctttcttctctggaagctgtaaattcttaattttaacttcgcataccacatcctcatctgccacaagccccagtattccaaaatttaatgggttgattctatttttggtgatcattaacagcctgttcatattcaagaagtgactggagcctggcacagtggctcacacctgtaatcacagcactttgggagcccgagacaggcggatcacttgaggtcaagagtttgaaagcagcctggccaacatgatgaaacccctcatctactaaaaatacaaaaattagcccggtgtggtggtgggcgcctgtaattccagctacacaggaggctgaggcatgagaatcacttgaacccaggaggtggaggttgcagtgagctgagatgacactattgtaccacagcctgggcgacagagtgagactctgactcaaaaaaaaaaaaaaaagaaaagaaaagtgcctggaagccagtttggaagctctgagcacacacatagggcttgttgactgtggtctccctatggggctcctttcttacaaaacctttgatgtccgtccttttgacgggtcagattggtcagagaaactgccagtgacccgcctaagtttatatgctgtcagagttctaggaaggaagtcgattttgaatgctttaacctgtaaacttcgagtccttattttcatgatggcatcccagctctctgctgtacttagttttccccagaacagaaaaactctgttttaccctttccaaaaaataaatctccagtatgctggtgtattagtccattttgcgttgctgtaaaggagtatctgaggctgggtaatttataaagaaaagaggttaattttggcttacagttctgcagactacaggaagcataagtgctgtcatcggcttctggtgacggctcaggaagcttacagtcatggcggaaggcagagtgggggcaggcttatcacatagagcgggaacgagagaggagggagctcccgacctcttgaacaagcagatctctggggaacttattcctgtggggagggcaccaagctattcatgagggatccatccccatgacccagacacctctcactaggccccacatccaacactgggaatcatatttcaacagaagatttggacaaatacccaaactatatcagctgggttcggaacgaactggtccagctggtcgcagtgagggagaggaatgctggcgtctgtctctgaaacagacgtttgtctaatccttttgattgtagctcttacttcttggtaccaggtgtggctgtggcagtcctgagccctcttgtgttctgcagatcagtttcttcctggctcttcctgttgctggattttgatccagctttcctgagtctgttatgtctgctgctacctgtacatctaccctcctgcccacacttaattcccagaattccacaatgagaatacttcaacttcagcaagggagttttcctcttgtcctatcaacactctcatataattctcatctctaagccatgtgcattctgcttcccaacctgtaacatctgcccggcagtagtccaaatcctgtgtacatccttaggatgcaaatgctgtcttccatgaaagtttctaatatttgttcttgtttctaccatttattgactcttaatcataaaatagtctggtactgttcattttttgctttttcttctaatttcaaaatacagttagtattttataaaaaaaattattatttttattatcttttttttttgagatggagtctcactctgtcacccaggctggagtgcagtgatgggatctcagctcactgcaacctcggcctcctgggttcaagtgattcttatgcctcagccactcgagtagcccaccattacgcctggctaatttttgtatttttagtagagacggggtttcaccaggttggccaggctggtctcgaactcctgacctcaggtgatccacctgccttggtgtcccacagtgctgggattacaggcatgagccgctgtgcccggctgaaaaaaatttttatatcctactcctctttcctcaattgaaactgctagagggcaggcactgtattgtgtacttttttagtgtccttttcagcgccaagcacggcgcttgatcaagtctcgctttaaagaataatgatgttgcactgtagctgtggtgatgcttacttgatgtggatcacggagtgacagagaagaggtcacacttcattgtttgtttttgtgatatcttaaaacaaatgttcaaaagagtgatatatttcaacttaactgatgatagagttatttcaaaatgacttcaaatatacttttgaaattatctttggtagtttaatagtcacctaaggaaatcaatcttagtaattttgtgtcacacgttgtcttaaccaggttagtcaactacctttgctggacttgcttctgggcaaccttgggctatttccaaaaattatatctacttgctacttaaaaatttgctaccatcagacaggttcagaagcatgcactgactttgaagataggtccaagagagaagtttcagaagtgtttaaagggaagtagcataattgaatgtgaagtctttgtagaaaacaactttgaggttttttttaaaatagttaaaatttttggctgggtgcggtggctcacgcctgtaatcctagcactttgggaggccgaggcgggcagatcacctgaggtcaggagttcaagaccagcctggccaacatggtgaaaccccatctctactaaaaatacaaaaatttagctgggtgtggtagcacaggcctgtagtcccagctacttgggaggcttaggcacgagaattgcttgaacccatgaggcagaggttgcagtgagccaagatcatgccactgcactccagcctgggcaacagagtgagacttggtctaaaaaaaataaataaattaaaattttaaaaaattactatttctaaatgttttaaaagttagcattaatgtgttttcttttgcttttaaaaactgatttcattagctatcacgtgcaaatgagctatgagtcttgcctttaaagataaggtctggataaaattcctgtgactgagcagagcatttagggttagggagaaagaatgaagaacttgtgctgtgtggcgtttctatgctgtataaattcttgtttgtttataataaacatttttataatttcaaaccccaattaaaatttgacttatggccaggtgcagtggctcaaacctttaatcccaacactttgggaggccagggtgggtggataacttgagtccgggagttcgagaccagcctaggcaacatgacaaaacccaaaccccatctctacaagaaaatacaaaaattagccaggcatagtggcacatgcctgtagtcccagctactcaggaggctgaggtggggggatcatctgagcccaaggtactcaaagctgcagtgagccaagatcgccactgtattccagcctgggcaacagagcaagaccccatctcaaaaaaaaaaaaaaaaagctgtatgtgtgtgcccccttgtaatttttgggaaaagtgtccatagcttccatcagattcttaaaaaggtgctagattcaaagtttaagaactcctgccacacagagtgtaattcttttaggacctaaataaccctcttttggttttttttttttttttttttgacacggagtctcgctctgttggcaggctggagcgcagtggcatgatctcggctcactgcaacctctgcctcccaggatcaagcgattctcctgcctcagcctcctgagtagctgggactacaggtgcatgacaccacgcccagctagtttttgtatttttagtagagacagggtttcaccatgttggccaggatgatctcgatctcttgacctcatgatctgcccgcctcagcctcccaaagagtgggattacaggtgtgagccaccgcgcccggccaacttaactctttatatgaggttaaagttatgcccacactgcaaattgtgctttatagccaatgtttttagtaagttttaatatattttcctgtagttgaaggagaaatctcttagaatcttactgacctgatatttattatttttatatatctatttttttcctgtttgaaggtttcttgttctcctcaaggtctgaaagtttgggtccaagatacttcatatttgtgtagtcgggctgggcaggtcctccctgtcagtatccagatgaatggctggattcacgatggaaacctgctctgcccatcatgttgggacttctgtgagctctgtcctccagaaacagatcctccagccactaacctgacccgagctctgccacttggtgagtgctctctatggttggaataaagagggaaaagtgaaggaggtgaacttctcttataaaatgttggcatttcccttcaaggaagctctaaaacaagttgagtttcttctctgctgattgcatttttatgggaagttcctccttcccaccattatcggaaatctaaggtaggtcaacttgacacttttgagtaagagcaagggtgaggaacctttctggtgaagaacctctgagttgcacagaattattcatcaaagatcacaaaaagtgaacgttgtatccattcatttggaaattaagggtaaacaaaattctgctcattaaatacaaaaagtaattaaatatattttagtcatatcataatcagctgaagtgaaagtgagggaaagacctggaaaagataccgaaaaaaggaattggcatacccacaaagaggagaaagatgcaataacacacatgcgaaatgagacagagagatgtgggctggcaaagaccggggggttcattgaggaataggaccgagtgctcgttctgtgagactccagagaatggaactggcaccaagagattgaagttatgaggagacagatgccaattaaaccctttagaagcaggaggggaatgcagaaaacacccttgagaagaacgccttccccatgaaattgacggtgttcaaactgaggctgataatgcattgctgagagtataaaagcagaattcatcaattcacaattaaaattttgatttaaatgacctatgagatttttatggcagtttgacatttcagattatgaacaataaaaatcttatgcaatgtttcattttctcaactagaggtgttttttaggtggaactgcattgccctttgcctagtccatggtgtgatgtgattgaaaatagagggccacactcagttttcaagtcaaagtttctccacctctaagattaacttcccttcttttccaaatcctgaggacctcatcccctaggggctgtaggcagaggatgagttttggaagatgagtacttgtgttgggggtccccaggagcaccttaaatttgttggttcaccagaaggactcacaggactcagctgctcatcatagtactcatggctaagatttgttaaagtgaaatgatgcagagcaaaatcagcaatgggaagaggtgcgtggggcaaagttgtgaggaaaccagttcccagccaccagcaaaggccctccttgcatgcagaactttctaaagatagcagtttcaggcctgctgtattaactctgctctacacagtactccaagtgaggcagctgagttttctgcagttacaatcataatgacacaattaattttatttgatataaaatcttaggtcaaggcaggtggatcacttgaggtcaggagttcaagatcaacctggccaacatggtgaaaactcatctctactaaaaacacaaaaatcagccacatgtggtggtatgcatctgtaatcccagctactcaggaggctgaggcaggagaatcacttgaacccgggaggcggagccaagatcacaccactgcacttcagcctgggcaatagaatgagactctgtctcaaaataaataaataaaagctcatctttattgtttaaaatatttaaaagggcaactcatcctaaaataaggtcaggttggcctcatctccctactgctataaaaatatttccattatgagaactgttttaacctatgaggacacctcatggctgaattaaaatatacctctagtgcccaaaatctgtagaatcttctgctgtttcaaaatcaagtctgattgattggtgatatgaatgtatgggtagatatttagaaataggggaccatatgttctggtctgcctgagaccatccatatgcctgttgtcattattaatagtcctctcgcttgcatcctcacagtccgtctgcctattgtcgttattgctggtcctgtcccttgcctcctcacagtctgtctgcctgttgtcgttattgatgctcctctcccttgcctcctcacagtccgtctgcctgttgtcattattgatggtcctctcccttgcatcctcacagtccgtctgcctgttgtcattattaatagtactcacccttgcattctcaaaatgtactagtttgtgttgataaattatatggtcaccctacttagaaggtacaaagaaagaataaaagaagaaagttcttcaccccatctcagaataaccaagatctttatctttgctggggtactaccccaaggcaattttttttggataccattttttaaccttgacatagtggatacatcatttcttcctccatatatatttttcctccattaaaaaagaaacaaaaacttttttatacctgggttttgctcttgatttagctctcaaggtggtccttgtttactttttaataatcactgctcttcatctgtcaatatttaattggtatgatttatcccaaaattgtttatagaaagtcagttttttgttttcaactctagatctttgttcctgttcctcgagcctggtggtcaccctctggcttctgctaggcaatctgtttcctctgctggctggatttcttctgtgtatatggcactaggaatggaaaagtggatcttcaagatattcttttatgttatgttcttgtgaacaaagcacaaagtttgagtgagtgccaacctatgcagatggtagaagtggcattcctggctttggcttggaagaattgacgaccatcagaccttgaagcagaacttcacagcagcctgtcctcatcagcaacccaaccaccttcatcagcaacccaaccaccttcatcagcaacccaaccacctcgtcagcaacccaaccacctcgtcagcaacccaaccacctcgtcagcaacccagccaccttcatcagcaacccaaccacctcatcagcaacccagccaccttcatcagcaacccaaccacctcatcagcaaaccaaccactttcatctgcaacccaaccactttcatcagcaactcaacaccttcatctgcaacccaaccaccttcatcagcaaaccaaccaccttcttcagcaacccaaccacctcatcttggagaaggagaaggaactgcaagccaccaagtcttcatttttcagggtttgtaatcttcccaaagttttcctttgaaaataggataatgggtggaattttcagagtgattacatacctcaacatttttattaacatacaacaatgggaaagttcatcatccatatactgcagtcacttaaacaacagccaattattgcaagattagaattggagatcttgtcctcaaaagtataaattgtcctttgagttatagaaaataatggaattgggatttctacatatcattattatacctattttaaatttaatggcagccaggcatggttccagctacttgggaggctgaggcaggaggatcgcttgagcccaggagttcaaggctgcagtgagctatgattgcaccactgtattccagcctgcacgatagagttagaccctgtatcttaaaaaaaaaaaaattaatggctggtatatagtaaacttaattcactgttcccattgttctaaagaatttttttaaataatgtttcattaaatcttatgatttaaccgtgcttgccctttttgccagctatgtggcagtttacggcagaactgctgtcagtgtgctggtagccctctattcatccctcctcagagcccagcttccagaactgctatcactgtgctggtagccctctgtattcatccctcttcagagctcagcttctggttgtattctccatgagtttaataatgacatgaaaaaatgtggaagccgagagagtaaaatactctgccctgtaaaaacatggaagacatgcaaacagaaaaaaaataattgtattgttttagataatacttaagacaactgtgaaacaacaaaaacacaactattcctttgtgaccgatgaagataaaaagaaattctggtaaagacgggtatgcagttttttaaaatgggttaagaaattgttgcagaagaatttctaacatctgaaaatggttttatgtttaagaaggatggtctgaattgtgtactaatagcaaggtataagtttggtgtagagcctatccagtagcgtccactgtaccacttttaagtaagactcagtccacagaagctggaagattgccttcgctttaaatatcctttaccttctgcatttgacactcctcctgttactacatagattccggtccccagaagcaattttacactggtactagagcttaccagccccatttagtaatttttaatggctagatgaggtttaacaagaatatgaaaagaaaaaagaaaaaatatattcatgaatgataggcgatgcccattctttctctcaagctaatgaagtcctatggcattctaaccacaaccctcggacagactcctcctattcctccatggcattgtaaccacaaccctcggacagactcctcctattcctccatggcattgtaaccacaaccctcggacagactcctcctactcctccatggcattgtaaccacaaccctcggacagactcctcctactcctccatggcattgtaaccacaaccctcggacagactcctcctactcctccatggcattgtaaccacaaccctcggacagactcctcctattcctccatggcattgtaaccacaaccctcggacagactcctcctattcctccatggcattgtaaccacaaccctcggacagactcctcctattcctccatggcattgtaaccacaaccctcggacagactcctattcctccatggcattgtaaccacaaccctcggacagactcctcctattcctccatggcattgtaaccacaaccctcggacagactccttctgttcctcctttcctcgtccttccctgcttttcgtccattcagcatatagctattcagtactccattgaagaaattatgctaagtgagcaaagcaacataattactaagaattaattctgattatttggcactagagccaacagcaaccccagcacagaggaaagtcgcttttttttcaaatgcataaatttaaagtatgtatttgcatgcagttttaaatgggaggtatttgtcattgtgaaaagctgggaatctcaaacatagtcaacttaactaaaaagaagctaatacaggttgagcattcctaatccaaaaatccagaatccaaattgctccaaaatctgaaactttctgaatgctgacctgatactacaagtagaaaattccacatacaagtacttaacacaaactttgtttcatgcacaaactactaaaaatattgtataaaattaccttcaggcagtgtgtgtagttatatatgaaacatgaatttcatgtttagacttgggtccatgcccaagatacctcattaggtatctgtaaatatccgaaatccaaaaaaaagtctgaaatctgaaacacttctggtcccaagcatttcagtaagtgatgctcaacctgcgtaatggtctgcgggccagtgctcattttctgcctatgttgtacatactttaaattgtgtaaattaaaagtcaaagcaaagagtctatttttaaagaaacttacaataatctaaacatatacttcttatgattatgaatcatcctgcaaagctgaatgaagaattttaccaaaaatacaatgaattaatcatatatttgagagtcacagtgataggttcgactatattttgactgttgtgtagtggcaccgtttaggtagtattgtttctgagcatggtgctttttatacttgaaatatatttttgctttattttttattgatataattatatttgcactaatggctttctgaagaaaatattatagatgacattttttgtatatatatttattaagcttgggaacctggtcgcccagtgttttctctggacaaatgtgaaactggataaagtatggataaagtcttgagttcctcagggtaactgtgttgatgtctcccgtcctcttcagtaaggcttgaatatgattttactcatcattgattctgcatagtgtacccagcaagacttagaaggacactgaacctgtcagagattttaagaggcacattttagtcactttgaatatggtagtggtgggcgcggtgactgaagcctgtaatctcagcacttcgggaggccaaggcaagcagatcacgagatcaggagtttgaggttacagtgagctgatcgcaccactgcactgcagcctggatgacagagtgagactttcttgggaaaaaaaaaaatgacagtgaagcagacttttagaatccgagatgtcattgcagaattattggtataaaattcagctgcaaagtgaagaaattgaaatggcccacacgttgatatcctgtggcaggttatacccttcatgttagcaaagacgaagccacgtcgctgtgttaagagggacaggctgggccggctgcagctgtagtggaagtgagggacacagggaaggaatggggagcagcaatttggggacagtagactggagtcactttctgactcaaaaagggtcaagtacttattaaaaactatcttggttttctgttcagacttaggctcattttgatcattttaaggtcccagttgtcaaaaatatcaagtgaatttgtctcaggttttcagaaacaaaatttacaggaaggaagcaaaagccatgtcagtagccttgagctgacagctttaaagaaactggcaaacaggtaggttgtcctcatatagatccttccagtattctgaaaaacatccttttatttcttaaaaccagtaacccttacatttttcctataggatagttatttttgttgagatcaaatagacattctataaatgttataaattatgcttgcagttactcagcctatctaggcttaaggtttatcaatatttgaagttgaaacatcatcttatgaggtttagttttaggaagataaataaatatatcaaagtatttcataaagttgtatcaatgttccttctaacattagaagacttactgactgaggccatctgtgaacgactaggtgatctcagaatccttccagctctaataccctctgactaacactcacccagaattgctgtctgtgctggctgtgatctgcctccaggagcatacgccatcctgcgtgctgtgtccatcacagtgtctgtgctcggtgccttaccactgtccgtgtccttggacgctgactggacagagaggagcctgtctctcagggcacatgagtcgtcgtggcaggaggagacgggcctcagtcacagtgtcacagacccttgtcacagtggacactagtcattcctgccatgtccttgcagcccaggaggactaaaaagattttaatgaagtctgtgttactcattctgaagaaaagaacttacctgagaggagtaatatttttttaatatatattgggtcagggacagggatggagtggttgttttatgtttacatttttaataagtaaaatagaagatttaagaactaatatttatggtattgaactttaagtgtgatatattccttagaaaaacacaactttaataaaaatggaaactaa

SEQ ID NO: 2068 - DNA, 83522 bp, Homo sapiens; identical to SEQ ID NO: 2067

SEQ ID NO: 2069 - DNA, 83522 bp, Homo sapiens; identical to SEQ ID NO: 2067

SEQ ID NO: 2070 - DNA, 83522 bp, Homo sapiens; identical to SEQ ID NO: 2067

SEQ ID NO: 2071 - DNA, 80313 bp, Homo sapiens
tgggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcgggtgagcggggcggggggcgtctctgcccgtcggagacccggcgccgggagccgccccggccgggggaggcggatgcgggggagttacagcagctcgtcccgtaggcgccgggtccggacccgggtaacggggagaagccgacggcgccagccctccgggcctgcgccagacccagagcctggggagaggcggcgggcggcggcatctctcggggaagggggccggagtgattgatggatgattttttaggctttctgaggaaaatcagtttctgccacggcggaggtagacccttgccccgccccggtttctgcaggccctttcggatttggggtgccgaatggacctgctaagacgggaacgttagcgcgagctcttcacagatcagagtagcaggggtgtctggacgagctgcattgtcaggaagggtcggtctcagccctggagttttttcgaaagaagtgttggggagcgtgtgtttaaagtggacccgaaagaagtgttggggtgtgtgtgtgtttaaagtgaacccgagagaagtgttggggtgtgtgtgtgtttaaagtgaaccccaaagaagtgctggggtgtgtgtgaagtgaacccgaacgctggaacgtctttcttcgcctccatctagttgacttacaaaataaatacgcttgtaaaaataactagagcccactttccgactcccattagtttcctcttccactcctcatgtcctccaaaaaaaagttgaagcaaactacttagaaaagatagtctaacatatttgtacttgctattcctttttaaagcattacttcgtgttatgtatgttttcgaacacaggaaagagaataagaaagtaggtattatttggctttcttagttgtggcgaacagtgtctggtgcccgagttgttcatcatcatgtttgcagtgccgtcatcactgctcactgcagcctcgacctcccgggctcaggtgatcctcccacctcagcctcctgagtagctgggactacaggcagccgccaccacgcccagctaattttatatatatatatatatatatatatataaaatatacatatatatataatatacatataaatattatatataaaatatatatatattttttcgagacggtatctcgctcttgtctcccaggctggagtggaatgacacaatctctgctcattgcaacctctgcctcccaggctcaggtgatcctcccacctcagcctcccgagtagctgggactacaggcgcccgccaccacacccggctaatttttggatttttattagagacgggatttcaccatgttggccaggcaggtctcgaactcctgacctcaggtgattcgcccgcctcggcctcccaaagtgctgggattacaggcgtgagccaccgcgtccggccaatattttgtatttttttgtagagacggggttttgctatgttgcccaggctggtctccaactcctgggctcaagctatccgccgacctcggccttacaaaaggttgagattacaggcgtgagccactgcggctggcagtacttggtgtcttattttattttaaaatcttagattgagcacattttctatgctttgcagtcattaaaaatttataagtattacatatgattcactcattttggaaaaataaacagaactgttaaactaaagaagcgattctttccaaagaaacttttgctgtagtttaaaatagaagaaattaaatgcctgcttatttaatctctttttggaaacagttgaactgaatattttttagtgatttaaagtttcttgctaaggtaaatatgagcagccactttccttttgtgtgtgttctggtagacggcatgtaaaattatcattcacacctcagatttcctgcttctgtttaggagatggctatatggtatagtgatttcatattggtgtgagtcatttcattgttactacatcaagcctgaagctaaagaacaagttgattacaggagtctgtctagctcattttctcacctgcttttcagtaggtctaggagcaccgtgttgagtccttaaatattttattgactaagaaaatccaagtgcatttatgaagaataataagtaataccaaagaggtttttccttactgtgctctgagtttttaagtatggtgttgcctacactttaatagttttgtatagaaaccacattttttgttggttgatttttcatctggtcaaaacgtgtaaaaagaaaataaaaagattacaaggtattttataagctattagactagattcatttctaacatgtagtaatatcacttatgaaatataaaaaaaaatctttggcagaccttgctcgttacccagtctctgttttaaacagataatttaatgccaatgacatcatttattgagtgttcactatttgtaattcaccgtgttagatattttgaaatatactgccttgttaaatgcacacaataatttgtggattaaatactatccccactttacatgtgagggatcacctagagaaagtcatatggctatcaccactatatagtatcactggtaggattttggcccaggttatagctatcaccactatatagtatcactggtaggattttggcccaggttatagctatcaccactatgtagtatcagtggtaggattttggcccaggttcatctaactctgttctttccactgtaccatgcaacctcttcatatagaaataggtgttgctgttcctgtttttacagatggtggaaaccagcatttagagatgttcactaatttgctcaaagatctgtggctaaaggacagaggagacggtattagccaggagtttagtctagtttgaggtgactccaaaagccatagtctgtttttatggcaggtactttgattaatttggaaccaacttatggtagttattaggtatgcttagaccttatagaaaatttaaagccaagtaaaattagttgaatgctaatatataaaagttgccttgcatactgttttttcataatgtgtagcatgtacatggtagagctgttgtccttcaaattcgtatcctagggaacagcatatattgcccatatttataattagacatgattttgaacttattgggaacgttttcttgggactttctgtgctgtttattttgaaaggttaatctggctgggcctggtggctctcgcctataatcccagcactttgggaggccagggcgggcagatcacctgagatcggaagttccagaccagcttggctaacatggtgaaacccggtctcaactaaaaatacaaaaattagccaggtgtaatggcgggtgcctgtaatcccaactacttgagagggtgaggcacgagactcgcttgaacccaggaggcggaggttgcagtgagctgagattgtgccactgcactccagcctgggtgacagagtaagtgctgtcttaaaaaaaaaagaaaaaaaaatattaatcttttggaaaaggggaatatttatttgggaatgggtgacttgatccagtggacaaggaaagtcttagaagacatcacagaagacttcttgaagcagaaaggatataacttggatttgggcaagcagaaacaagaaggaaagctattttaggcagtggtggacagcacgcaaaaaatgttaagagtataagggacatcagttaattttgccagtccattattcagtcccttctggtaatagtactccaattttcctagggaaccacccctctcagttatatgaaccccaccctggcatagggtatgccagtgactcaggcctagctaatggtcagtcagtatatagtccattgctctggccatagtgattgttcagaggtgggcccattttgcaatcagcacacatgagtaactgaattttttgttgaactattgagaaagaggcatgctttgagccctggggttgctgagacaataggatgttagcctggaagttaccaataagtgggaagcagagccaaaagatggaagttctgatggcagtgtttgtacctttgggtcagccgccatgcctaaagtcagtgctatctctgtactttcaaattatgtgagctaataaattcttctttctgcttaaggtgagtaaaaaagttgttgttttttttttttttttttttttttgagatggagtctcgctctgtcacccaggctggagtgcagtggcatgatctcggctcactgcaacttctttctcctgggttcaagtgattttcctgcctcagcctcctgagtagctgggactacaggcgcccaccaccacgcctggctaatttttatatatttagtagagatggggtttcaccatattggccaggctggtctcaatctcctgaccttgtgatccgcccgccttggcttctcaaagtgctgggattacaggtgtgacccaccgcacccggccagaattttttgatgataaaaaggtcctgactaatacagtgaaactacccgtgatgatattgtggtgagacaaatttggtcaaaataaattattggattagagaatataagagctgcctttcgtatatgaggaagctagatagccaatagctttagaggtcagcattcattcaacagacatttattgactaaaggacttcggcagttattggtgtatgaagaggaccaagacactccctgccctgacagaactcaagggatctaatggggagatagacgggtggaaggattgtttgaattgtgcaataatagcacaactactatgttttaggcattatgctgggtaatgtagaggaaacaaaaatgaggccttacgaatatttttaaatctagtaatctggttgggtagctgcataacagaaagctgtgagggaatgaaatcctggtacactgagatcatactggacaatgaaaatgtacaaatgctgattgaatttatttaaaaaaggataggagtccaagatcactgttaaacctgtaagactagaaagatggtaatgctattgcttataatagtagctaacatttattgaggtcttaacatattccaggtattgtgctaagctgtgtgtgtctatatataacatgaacaaaaacaaccatagtaagttgtaaatactatttttgaccccattttacgtgtgagaaaattgaggctcaggagattaaataatttgatcaaggtctcccagctaataagtgacaaaactaggattcaatttctgatacatttgaccctaaaatttgtgttattgatcaataattataccgacaagttggtttcctgtaatttctttggtttgcccaatatctttgaagggttggtagcacatctagtgaatcatgtgggacaaatagaaacaaatagaaactagagctttagaatgtagagtgacactttaggaggctgaggtgggtggatcacgagatcaggagttcaagaccagcctggccaacatggtgaaaccctgtctctactaaaaatacaaaaaaatttgctgggcatggtagcacacgcctgtaatcgcagcactttggggggccgaggcgggcagatcacccgatgtcaggagttcaagaccagcctggccaacatggtgaaaccccatctctattaaaaatataaaaaattagctgggcgtggtggtgcatggctgtaatcgcagctacttgggaggctgaggcaggagaatttcttgaaccctggaagtggaggttgcagtgagctgagatcacgccattgcactccagactgggcaacgagcaaaactccatctcaaaaaaaaaaaaaaaaaaaagatgtagagtgaagttaattaaggctatggaataaattcaagagagtcatagtgagagtttataagattcttggaggaaggacgtagagaatggaaaaggtaggcactgtcaactcagggagataccagcattttaaaaggtggaaagaggaatcagtctgggaaaaaacagaaacagaaaaaagattcagtaactaggcctgtactagaattcatagaatcctaaaactaggccgggcgcagtggctcacgcctgtaatcccagcactttgggaggccgaggcaggtggatcacctgaggtgaggagtttgagaccagtctgcccaacacggtgaaaccccgtctctactaaaaatacaaaaaatagctgggtgccattggcaggcgcctataatcccagctactcaggagacaggcaggggaatcgcttgtgccggggaggtggaggttgcagtgagctgagatggcgcctctgcaccccagcactggcaacagagcgagactccatctcaaaaaaaaaaaaaacaaaaaaaacaaaaaaaaaaacaaaaccagaaaaatcctaaaaccagaaggaaccatagtgaccttctaagttatttcacaaatgagaagcaatctgaagctgggtgcagtggctcacgcctgtaaccctagcactttaacactttaggaggctgaggcgagtggatcacttgagcccaggagatggagaccagcctgggcaacatcgcaaacctcgtctcttaaaaaaatacaaaaattagacagttgtggtggaatgcatctgtagtcccagctgcttgggaagctgaggtgggagaatcgcttgagtctgggagattgagggtgcagtgagcggaggtcgcaccactgctctccagtatgggcaacagagtgagaccctgtctcaaaaaaaataaataaataaataaatgagagagaagcaatctcagattaaatgatattcttaacgttgtatagtgaggtgatactgttttacacaaggcaaataagagtcatagctgaagcttgaagaaaactcttgaatgaaatacagaaaatgagaaagcaaagactcaccattggtgtaaagcctacaggtgagagcaggatgctgtgggcaggtggactacaatcacacacagaaaaaggaaacattgacatgtggcgggtgagccaaagtaatgcagtgtcattggagctatgagaattaaaattttcaagaaatgaatactttctaggtaagaagaatgaggactgctaaaatgccatttaattttccaaggaggcagtctgtaactcacaaaattatggtttcattagtcttggaaatacggactagagtaccaggtcttaatttgagattgtgtttttcttggatccttgtttatgtctattttgtaacagtcacagtatatgcactatgaatttttctagaactgtactgtgtagtatggtagcaactagccgtaagtggttattaaaatagaaatttaaaacttggttcttcatttgcactagccacatttcaagtgctcagtagccacatatgtcattttggacagcaccttggaccaacctcctctctgtcatactggacagcacagataatagaactctctcatcactgcaggaagttaggttagacagtacgttagactcccctgagattggtcttagaagggaaggggaggtagtaggatggtttctttaggggaggtgagaagatgaaccatagaggaccactgaaccagttttgagagtacgggagtgacagcagtgctggggctgaggagttcccaggttccagttccttttacagtggctatatttgggagctggatggttaacgttacttcatgttagaacatcaagtatgactttaagtggtgtggttatatacatgtttcttgttctttccagttcctctgtaaaatatcccaggtgcgcttgggaaaaatgtatggtcaatgtggtaattcacacaaaggaatattattttgaattcctgaagcagccagcaatatcaaatgcagtgtgactaattttagaatcaaactagtagtaaaaatgtaaagcatttccttattcacttttaactttcttctttgctcttcacaatttctaaatttttattgtttgaaggaagtcttaaaccttggatttaaactggtttaactgatttcttatttaaaaactgggtaatagattttcccattaaaaacaggtttttggctaggcgcggtggctcatgcctgtaatcccagcactttgtgaggtcaagatgggtggatcacctgagatcaggagtttgagaccaacctgaccaacatggcgaaaccccgtctctactaaaaatacaaaaaattagctggctgtggtggcacgcgcctgtaatcccagcttcagctactcgggaggctgaggcaggggaattgcttatcccgggaggcagaagttgcagtgagccgagatcacgtcactgcactccagcctgggcagcagagtgagactcgctctcaaaacaaaaacaaaaaacaaaagaacaggccgggtgcagtggctcatgcctgtaatcccagcactttgggaggccgaggcaggtggatcatgaggtcaggagttcaagacgagcctggccatgatggtgaaaccctgtctctactaaaactacaaaaaaaaaaaaaattagccaggcgtgctggcaggtgtttgtaatcccagctactcgggaggctgaggcaggagaattgcttgaaccccggtggtggaggttgcaatgagccaagatcacgctgatcgcaccactatactccactccagcctaggcgacagagtgagactgtctcaaaaaaaaaaaccccacagttttttaaaaatgattttcatatcatagagagtgggaaggtaagccacagtcttcttaagatttccaataaatgcaacagattagatccagaatatttaagaatgtctatacacaagtaagaaaaagacaacccaggagaaaactgagaaaacacttgaactagtactttactaaagaggaattccaagtggccaataaatgtttgaaaaggtgctgaacctcatcagtaatcaagagattgaaaaataaaaccacagtgggtactactttacaagttgatgattccaagtactggaaagaacgtggagcagtggagacactcatacgatgctgtgggagcttgtgggagtgtgaattggtgcctcaactttgaaaatgctctggaacgatccaggaaggtttaaaatacacatattctgtgactcagaaattccactcttgagataaatctctcagagaaagttgtgtgtatgtataccaggatatatagtatgataagactgtccatagcattattcatatttgacaaaatagaaacaacttaagtgatgatcaccagtagaatggataaatcaattgtgtgaaaatgagctggccaagtgcggtggctcacacctataatcccagcactttgggagtttaaggtgggtggatcacaaggtcaggagttcgagaccagcctgaccaacatggtgaaaccccgtctctactaaaaatacaaaaaattagccgggtgtggtggcgggcgcctgtaattttagctactcaggaggctgaggcaggagaatcgcttgaacttgggaggcagaggttgcagtgagctgagatcacaccacagcactccagcctgggcaacagagtgagactccatctcaaaaaaaaaaacaagaaaatggatgagctataactatatgcagttgcaggaatgaaccttagaaacataatgtcgagaaagtgaagtgtgaagcataatatatacggtgcaaatatatttagtaaagttcaaaaacaaaaaatataagtgctaaaagtacaaagaaaaggaaataattgccataaaaatcaggataatggttacctctaggggagaaggaaaaagctgtgattaggaaagggagctttgggttgggagtcagggatatatttctgaagtattggaaatactctgtttcatgaccttggtggtgattatatggttgttcatgttatacttttaaaaaattgaattgtatgtttatgatttattcacttttcttcatttatgttcgacttttgttgaggctaacttcttcattgttaactcatgtatttctcatggcacctcttctttttggccatctctttttaaattctcttcctttctctctaccatccctcctccccagttaggcacttattgttttcttaataccctgtgcacatttttttattgtcacagtaaacaatatcatcttttcttctactagattggcagcttcttgaaggaggtatattagttttctgttgctaaatagcaaattattacaaatttagcagcttaaaatagcatccatttactatagttctataggttaggagtctggactcagctgaactcaaggtttcacaagactgaaattaacgtgttgtcaggatgggcttttatctggaggctttggggaacagtttgcttacaagttcattcgagttttggcagaattcagtctttgtggttataaaactgaggttcttatttcctttctggttgtcagcctcaggccactctcaggtcctggatgccacttgtattcttacaacatggccccctccatcctcaagccagcattggtgtgtcatcaaacacttctcgtgcttccagtttctcagacttcctctgctgctgctatccagagggttgatgtgatgagactgggtttaccaagattgtgcctcttttgattaattctaaagtcaactgattagtagacttcattacatcagcaaaatcccctcttccacataaggaagatactcagggtatgagatcctgtattcacagttccaggaattagagtggtgtctttgtccattttgtgctgctataacagcataccacacacagactgattaatttatgagtagaaatttgttggctcacaattttggaggttggaaagaccaagatctaggtgctgccatctagtgagggccttcttgctgtgttatattttgttgaagatttttccatgtatgttcatcagtgatagtggcttgtaattttattttttgtgtccagctttggtatcagggtaatgctggcctcgtaaaatgcgtttggaagtattcccttctctttagtttttttaagagttcgagaaggattgttattagttcttcatatgtttggtagaattcagcagtgaaaccatggcttttctttggtgagagacttactgattcaatccttactcattaatctgttcagattttctgtttcttcatgattcaatctcgggaggttctatgttcctaggaatttatgcgtttcttctgagttatccagtttgttggcgtataacttttgagtatttgttgaatgaatggatgggtgaatgataaagcgaaaagaagtgattgagagcctgttcactttcatagctttggaacagtgacacctgcctgctgtataaagtaactggtttcagtggggaccctgggagtttcaatcagaacattctcaaggataatactagtgagtatgcttctctttggtgtgaaaaagtcaagcattcagaacttttaaaattggtgtcatagaggataagagaaatgatgttacatgtgctaagagttgttttctcaaaataaatgtcaacttctaggtatttgggaactttcacagtggattcattgattataataaaaggaataaaaatgttaaaccttatatgtagtgaaggaggctttctctgtttatccagtgttttcaactttggtagttatatgtctcacttgtgtaaggaaaatcttagtcagataatgtggtcatgcttcttttagcctataaaatttgtggcttctggccatctattatcaagtgacaagctgtagcatattgattctcaggctttagtgttgtgcatagaatcacctggggctctttttaaaaaatacgcatccctgggtgagattactagagagattcaggagatccggggtggagtccattaaactacatttttaacaagcaccctgatggtactaggtgcaggtagttaagaaccacctgaaaaacatttccttagaatttgctactttagccaggtgtggtgatttgcgcctgtaatcccagctacttgggaggctgaggcatgagaatcacttgaacctgggaggtggaggttgcagtgagctgagattgcaccactgcactctagcttaggccacagagtgagactgtttaaaaaaaaaaaaagaatttgctcctttactctaaaagttattttggaggatagtggtttttcacatctggttctatggcatgccatagaaggttcgcaggaccttgtgagaaatgcagaattgcaggcctcatctcggaataagaatctgcatttgcatttcagtttaagaagcactgctgtaacgttaaccaggtaattctttttccaaagggtctcagtaagtaaataattggccttagttaatttaacccatatgatatggggcgaccaaattgaatactttcaacatcagtctattaaaaaatgaaaagggaccgggtgtggtggctcacgcctgtaatcccagcactttgggaggctgaggcaggtggatcacttgaggtcaggagttcgagaccagcctgaccaacatggtgaaaccccatctctaccaaaaaatacaaaaattagccaggcgtggtggcgtgcacctctagttagttctaggtactagggaggctgaggtgggagaattgctcaaaccccagaggtggaggttgcaatgagccaagattgtgccactgcagtgggcgacagcgtaagaccctgtctcaaaaaaagaaaaaaaaaaagacccactttgtgggtggcaataagcaaagaagaaagttatgacaccagttgccttgttcctaggatatgatgtgctgaacatatcatggatatgtacatggttagagtttgatgttagcaagtccttttagactgtgccttgcctcagctgcacccctccttaagttatactggaaaataaaaaaaccttcgtatgtcatcccagtaggtatggtaaggatccagagtgcagaaatcccatcgtgtatccagagctcaattatcttgtcctcactcctatcctgaggactggggctttccacccaaaattgttataccagaaacagggctctactactcattggtgtatttgtttctagtacctacttttaaaagactgttacttgctcagctgcttatcttgcttgtgaagacaatgtttagtaacacgaggagaactacagacattatcgtggtccaatcaacagtgaccatcacaggtttgttaattttgctgttttatcataatacttgcagttagtaaacacttccttattttctaatgtaagaatgacaaatagaacttaaagacatttccaatagaatctatctgtacctcgattatccactcctttttttttttcttttttatttttttgagacagagtctcactctgtcgcctaggctggagtgcagtggtgtgatcttggctcactgcaacctccacctcctggattcaagcaattctcctgcctcagcctcctgagtagctgagattacaggtgcgtgccaccacacctggctaattttgtatttttggtagagctggggtttcaccgtgttggtcaggctggtctcgaactcccgacctcagtgatctacccgccttggcctcccaaagtgctgggattacaggcgtgagccaccgcgcctggccaagaaagccattttttcaagtcattcagaatatgtgattgcttttcctgaggggcaaactgataaaacatgacatgttggactatccttgataacttttccagtaagacacttttttcttaagggtcttacctctatcatatttttgaaggagaagaacgtgcaacagaaaaatcaaggaggctttttcttcagagggctgggactaaaactgggtctggatttgggtgtaggcttgctaaagagggggacacgcctccaaactgaaaacctaatgacagccgacatgcagaatggtaagatctctaggcatctccctgcttggctgatatactcctctgattattggagtttttagagggggacacgcctccaaactgaaaacctaatgacagccgacatgcagaatggtaagatctctaggcatctccctgcttggctgatatactcctctgattattggagtttttagagggggacatgcctccaaattgaaaacctaatgacagccgacatgcagaatggtaagatctctaggcatctccctgcttggctgatatactcctctgattattggagtttttggagaaaatctaggggaaaagagaaaagattttaaggtatcggtacttacagaacccaaatgaaacagccaggtccctacactgtaccttacagggaagtgtacatacagagtttccacccagaatttcaatgttatgggttttttttgtttttgtttctgtttttttgagacggaatttcactcttgttgcccaggctggagtgtaatggtgcgatcttggctcactgcgacgtctgcctcccgggttcaagtgattctcctgtctcagcctcccgagtagctgggattacaggcatgtgccaccacacccggctaattttgtatttttagtagagacggggtttctccatattggtcaggctggtcatgaactcccgacctctggtgatccacctgcctcggcctcccaaagtgctgggattacaggtgtgagtcactgcgcctggcctatgtttttaaatatgaaaagaaaactaaatactactagatagttgaagaacatttctcttttttcttttttctaattttagtagagacagggatcttactgtgttgcccaggctggtctcaaactcctgagctcaaatgatcctctcacctcagcctctcaaagtgctaggattacaggcatgagtgcctggccttgaagaacatttctgacatcaaagagaagaacataacaaaaggaacccagagaaaacagacagtgctgacaaaagaaaaacttccaaaaatctggaatcaatatcctaaaagtcagaaaagaaggtactgcagacatgaaatataataagggtctctaagaaaagggcataggaatgccggacatggtggctcactcctgtaatcccagcactttgggagactgaggcaggtggatcacctgaggtcaggagttcaagaccaccctggctaacatggtgaaaccctgtctctactaaaaatacaaaattagtttggtgtggagtttcaccatgttgtccaggctgcccttgaactcctgacctcaagtgatccacccgcctcagcctcccaaagtgctgggattacaggtgtgagccactgcatccggctcctgagaccccatttttacaaaagatttaaaagaaaaattagcctgacatggttccgcattcctgtggtcccagctactcaggaggctcaggtcagagaatcacttgagcccaggagttccaggtttcagtgagctgtgattgcaccactgcaccctagcctgggcgacagggcgagaccctgtgtcaaaaaaaaaaaacaaacaaacatgcatacacacatacaagagttaaaagtgattgctttaggggagcaggtattgggagttaatgaggaattagacctctcctgtttgggtgctaatttttactttcagcctatatccttctacttgaagtgagtttcttgtaaataacatagagttgcattttttttttttttttgagacggagtctcgttctgtcgcccaggctggagtgcagtggcgcgatctcgggtcactgccagctccgcctctcgggttcacaccattctcctgcctcagcctcccaagtagctgggagtacaggcgcccgccaccacgcccagctcatttttttgtatttctttttagtagagacggggtttcaccgggttagccaggatagtctcgatctcctgaccctgtgatccgcccgccttggcctcccaaagtgctgagattacaggtgtgagccaccatgcccggccgcatcatgtttttaaatccactttgctaatctctgtattttggtcatttgatctgtcttttagataatttgtatttcatatcattgttgatgtgttagggcctaagtctgccattttatttgttgtttcctttgttttcctttctgtgttctttttcttgccttcctgtggggttcgtgaacattttttagaattccatttttatttctctgtagtgtttttgagtgtatctctttgtgtagctctctttgttgctgccctaggtattacatgagagaagtccaacttgtcagtctattggtatccttattttatgagtttgagtgacgtatagaaaccttacccccttcatgtcccttttctttccctgttatagttgtcttaaatattttctctataaatatttagaatcacatcaaacagtcttataatttttgcttccaatataatttggaaaactcaagagaaggaaagtcttttatatttacccatatttttgcttagtgttatgtactgaattttgtccgtcacccacaaattcatacattgaagtcctaactctcagtatctgcgattgtgtttggaggtagtacttttaaagaggtaattaagttcagatggcatcatttggctgggctgtaagtcaatacaagtgatgtccctgtgagaggagattaggacaaagacaaagaggaaagatgatatgaagactcagagagaagacagcatctgcaagccagtgagagagacctcagaagaaagcaaccctgctaacaccttcatctcagacttctagcctccagaatttgagaaaatacatttgtatcgtttcagctgcccactgtgtggtattttattgtggcagctctagcaaactcatacgctgtgtcctttcttggtgttttaagattcctttctttcaccacttactttctatttagagaacttccattactcattcttttagattacatctgctgctacagactctctcagttttcattcatctgagaatgtgttgatctcctcttgattcctgaaggacattttgctggatatatatacaattctgggtgaacagtctttcttttagtgattggaagatgttgggccaggcgcagtggctcatgcctgtaattgaaacactttgggaggccgagatgagcagatcacttgagcccaggagtttcaagaccagcctgggcaatgtggcgaaaccccatctctccaaaaattagctgggcatggtggcacatgcctgtagtctcagctacctggaaggctgaggtgggaggatcacttgagcccaggagatcagagctgcagtgagctgtgattgtgccactgcactccaacctgggtgacagtgagactgtctcagaaaaaaaaaggatgatgttctgccacttctttctggcttccatggtttctgatatgaaatctactgtcatttcaattgtctctctcttactgctttcaatattttttttttcttggccaggcatggtggctcatgcctgttatcccagcagtttgggaggccatggcaggaggatcacttgaggtcaggagttcaggaccagcctggacaacatagtgagacgtcttctctaccaaaaatacaaaaattagtcaggagtggtggtgtgtgcctgtagtcccagctcctcaggagactggggtgggaggatctctcgagcccaagaggtagaggttgcagtgagccatgattgtgccactgcactccagctggggtaacagagtgagaccctgtctaaaaaaaaaaaaaggactttttttctctgtcttccgttttcagaagtttggctatagtgtgtcttgtggatgtctttgggtttatcctctttggggtttgctcagcttcttgaatctacaggttcatgactcttgccaaacttaggaagctttcacttcagttcatttttcagcccttagaaatgctgaagtattcagccctgagctccttctcttttgccaggattctgatgacatgagtgttagattattgttacagtcccataagtccttgctctgttcagtctttttttttttttcccccaatctgttttctctctgttgttcaggctgggtaatttctgttctgtcttgcagctcactgattctttcctctctgccctccgctctgctgttgaacccatccattgagctttttctgtgtgtttgtttgtttccccttcatatcttctttcttgagaccttctgttttttgttgttgttgttgttgaggctttctggttttcatttgttacaagagagtctgtaattgctctctgaagcattcttaggatggtctagcatctctgtcatcttagtgttggcatttattgttttttatttggtttgagatcttcctggtccttagtattgtaaatgttttcagttgtgcattttggggattataagagtcattacagtctggcaaggatggaaatttaggatccccacgtaacctttgagtaggggtgaggctactcaaaggttgcatgggaagcctgtttttttccagtttttttctgagatatttgggtggaatagagcagttattatctaaaagttttctgtcttgctaagctaccctttcctggtgctttattattattttgttatttttattttttgagatggagtttcactcccaggttggagttcagtggcacgatcttggctcactgcagcctccgcctcctgggttcaaaggattctcctgcctcagcctcctgagtagctgagattacaggtgctcacgaccatgcccagcttatttttgtattttagaaatggggtttcaccatgttggccaggctggtctcgaactgctgaccttaggtgattcaccagcctctgcctctggaagtgctgggattacaggcatgagctaccgtgcctggctattttatttttaaacttggagaggtcagctccaagtctgggatgcatgaggcaaaaagaaaacccagggaattcattgctattgttccttgagtcctgaggttcctagccatcttctctcaaccttttatctgttttatgtatattatctcgggtttttagttataaattaaaattttacataattttagagatttttaaggtacatgtcactaacaagaggcagattacatttctactttgagtatacacatttaattttttaaattattgtggagaaaaaaaacagaaaaaggaaaaagtacatttgtttcatcttcccagaagcggaagtcactaaaatggcatttaaagttatataaatatactattttgataaaaataaaagttaacagtttttaaaagataacctaaagtcaggttaaaaaaaataagacttttgaatgaaaagcattagaaaaactatgttttgtgatctccctgggttacataattaatattaatagctaaaatgatttttattgcattatctcagtaaaattttcatgggaatggtaaggtggttgaaaacgaaaaggaaatacctaagcaaggagtgtttttaaatgtgacagatgtaaacagaaagtctgaaaagcgtaacccactctcatgactcatcacggggtcttcagtgactgcgctgccgtctatgttcttggtgtttaaactttggtctgtgggacgcaccatgaacagtatcattgtgatatgttacatagctatcaaataatattttaaattattacttttatataattctttagggactttttgaaaattactttttagtttatttcatactgattgtgtatttcagaaattttcatagtttgcatttaccatttctttatatgttaaagaatattattcctataatattctttacagttttacattgctcagtgttgaaaatctcttatacagattatttgtcatcatccctggccattttcgcattcatagtagtgtctgttctcacagaaaatgatggtactgtacatgtgggttttgcataatgggctgattgggtaaggatgatgtcactgcgtgggaccgcctggaggagttattagaagaacacaagacttttgactgctagcatttcttaataaatgccatactgttgaaaacattaatttgtgtttggactggaatgaaccttggttttcctggcttagttactgagatttaaagaaataagtcctaatgtcataattacatagccaaatagaatgaaatatgaagcatttttctccctggcagagagaaatggggttaagaaggaaagaagttactaactgccagtctctgttacacagttgtgagactaatttttgagatttgaagttcaggaatactttgaaattttgtttctgtaatttgtgtattattcattttattgctgagacataagatatggttattagaaaagtccataattttagagatttttaaggtacatgtcactaagaagaggcagattacatttcttttctactttgagtactacatgtttgattttttaaattgttgtggtaaaatatgccattttatccatttttaagcatctgttcagtggtattaagtaccttcatactgttgtgcagctatcaccaactaaatccacttccagaacttttttcattatcccagactgcaacactgtatgcgttaaacactaactcctcattacttcctggtaatcattctgctttatgtcttttatgaatttggctgttctagggacttcatataaatgaaatcatatttatcctttgatgtctggcatatttcactccataatgtttgcaaacttcatgttgtaccatgtcaaagaattttattcctttttgaatgtagaataatattccattgtatgcatataacacatttatggaaatatctgttcacccattggtagacatttggtttgtttccatcttttgactgttgtgaataatgctgatgtaaatattggcctacaaatatctgttcaagtctctgctttcagttttttttttttttttttttttttttaggtggagtctcactctgtcgcccaagctggagtgtagtggcgccatctcggctcactgcaaccaagctggatcatatggtggctctgtttttagttttttgagaaacattcaaacagcctcctgggttcaagtgattctcctgtctcagcctcccaagtagctgagattacaggcacatgccaccacgcctggctaatttttgtattttttgtggagacggggtttcgccatgttggccaggctggtctcgaactcctgacctcaagtgatccacccacctcggcctgtcaaagtgctgggattacaggcgcaggccaccacacccaaccagttcttttcattctattcccagaagtggaattgttggattgtatggatcataaatatacttccgtgtttgattttttgaggaactgccatattcttttccacagtggctgtttccacccagcaaagcgcaaaggttccaatttctccacattcttaacaacacctgttgttttttccttttttaataatagttatctgaatgggtatgaagtggtatcttatagttttttaaatttctttgagtacgtagtggctgcatatatttatggggtctgtgaggtactctgatagagccatacaatgtgtaataatcacatcagggtaaatgaagtatccattaccccaagcattgatgctttgtgttacaaacaatccatttatactcttttaattatttcaaaatgtacaataaatgatcgttgactgtagtcattcccaaaaagagaaaacagtggtaagcaaatgaatctcacagtaattaattaaatcaaaatgggtaatgatagaggggtggtttgtcatcatattcctttgtcctctgcattttctgaaagtttgcaagtgatccagatgcttaatcagactcaggttctgttcctttggcaagaccataggtaatgttccgttcttctaatgggaggcatataattttttttttttttttttttttttttttttttttttttgagatggaatctcgctctcttgcccaggctggagtacagtggctccatctctgctcactgcaacctctgcctcccaggttcaagcgattctcctgcctcagcctcccgagtagctgggattacaggtgtgtgccaccatgcccggctaacttttgtatttttagtagagatggggtttcaccatgttgggcaggctggtctcaaactcctgacctcaagtgatccacccgcctcagcctcccaaagtgctgggattacaggcgtgagccaccgcgcctggcctgaggcatgtaatttctgattatcttttgtaaagataacagtcattgatgttcaattctagatccattaattcataggggttttaaaattgtgatattctatcgttcttttttattcataactagaatacttttatacagagatgctcccatccatctattgtttactcagtgatacctttatatagggaaggcaggataaatgtttgatttttttctctttatttcctcaaatgtttgatttttccttcagttgcattagttcgttttcatgctgctgataaagacagacgtgaaactgggaacaaaaggaggtttaatggaacttaaaagttccacatggctgggaagcctcagaatcatggcgggaggcaaaaggcacttacttacacggcagcggcaggagaaaatgaggcaggaacaaaagtggaaacccctgataaacccgtaagatctcgtgagacttagtcactatcacgagaataacacggaaaaaccggcctccatgattgaattacctctccactgggtccctcccacagcgtgggggaattctggggaatacaattcacgttgagacttgaatggggacacaggcaaaccgtatcaccagtttacaagatagtgtattagttctctgtcatcttttttgggtgtgtgtcataaactcatgtagttcaatatatgtgatgaatttcagtctactgcagtcatctttatcaaagcttagattgcctcatctttggccattgggaacaaagatggttcctgagtctttgtgacctgaccttgatcatctttggtgaataaagggacagtgttttttgttttgcttttcaaaaacctcagcatattttctgtgcctttaggaaggtggattttagggatctatttgttttaggatatttggaactgattgatacgatctttgatataatttgtaagcagatatgccttagaagctgttttacttttaaagaataatagttttattttttagtttatgtggaaaatcaaaagatttcaataaaataagttccaaggactgattttaaacctaatttaatttttcttttagacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattaggtaagaatattgttttcttattttaaatttttggttttatgtgatcttttcgattttcccctttccctaaaatatttacctatatatatgctatctattcatatcagcagtttctgtatgtgctcttggatatattaacagtatttcctatgtccctccagtttctctctttatctttggctttgcagtacagatgctccctgacttactacagtgggattacatcccagtaaacccatctaagttgaaaatgcatttcccacataatccaccaaacattatagcctagcctagcctactttaaatgtgctcaaaacacttatcttaggctacagttgggcaaaatcttctaacacaaggcctattttataataaagtattgaatagctgatacaatttactagatagtgtagtaaagtgtggtttctactgaatgtgtattgcattcccaccatcataaagccaaaaaattttaagtcagctgttgttagttggggatgcctgtaattaacaaaccttactgagccatttgcctgaggagcttgcagcagtcttgtagcagtgcttctccaattacattttctaattagcttcattaaataagaataatagatctgaaattactttgtttcttgtgaccatgtatttttgcatattaagttccgaatgtatgaatgcatttattcaactagtctactccactttcacatcttaaaataactcttgttgttttatttcactataaaagttgcaaatgttcattgaatataatgtgcaaatgtggaaaaatataaaggaaattcatcaaaatgtatcttaattttataagtgatcttttccttctgtttttccaggcttttagtcaaatttttaaatgagttttcctcttatcatgaaacattctttaaaactatttttgtatgtaattattttgttgtacagtttatatactgttgaaaataaattttcctctgggatcttagtttcttccagtttttcaccatgataaaaataatattagtagagaattttgtatgtaaatgtttacttttctctttccttaagatagatgtctgggagtggaattgttactggattaaaaagtgtggcttatcatctcagtaaaagatcttacaaatggggagggaattggtcctaaggaataagaggttaaatttacatacgtaaagatcttatttatttttatcttgatagatgtgggttgtttttttttctttttcttttgagacagggttttactctcgttgcccaggctggagtgcaatggtgtgatcttggctcgccacaacctccatctcccgggttcaagccattctcctgcctcagcctcccgagtagctgggattacaggcacatgcctccacgcccggctaattttgtatttttagtagagacggggtttcgccatgttggccaggctggtctcgaacccctgacctccggtgatccacctgccttggcctcccagagtgctgggattacagacgtgagccactgcgcccagccgatagatgtgttttattattttacttttagttctgatttgcatgtttttgtataaataaaaattctttacctgtaacttagttggtgtgatctatgaaatcacaacttactgcttttttttccacagagctacattttcaccatttatgtgcatttgattataatattgtaatgatgagggaagtagattataagttttgtttataatcttcagaagtaaggaggatgatattatccaccttttaaaaaatcttttcctacctaaatgttactttaataaaataatactatgtttatgtagtacctcattatttacaaaggagttatattctgcaagagccctataagataggtagggagatactaagatcttcagtttacagatgagaaatctctgtaagatgcagattaagttcaacactgtgcctgtaaccataaagctgaccaccagtaaaacgaaggctagaactccagtaccctgtttgtttcttgcaagactcatatttgttattttactgagtatagcgtgagaaagagagaaaatttttcttcagtggtggactctgattcttctctctttctacttacccatttagtcggaaccaactgtcaacattgccggtacacttgtgtaatttgccattgaaagtcttaattgctagtaataacaaattggtgtcacttccagaagaaattggacaccttagacatttgatggaacttgtaagttaatatttttgattgtccaacatgtgtgtgtgtgtgtctgtgtgtgtgtgtgtatatatatatatatatatgaaaccttggagagagagatgtatacaaagtcataccatagtcttttatatggcaaagatttattattgatatatgtttttgacttattttccagtattggtaatgaatcatatactgaattttccgtactcaagtggttggcacacagaattaagaacggaaagtacaagcctaattggcccacacagatgggaaaaggtcattagaattaggttctaaccaatattaaatgatttctgtgtcattaaatttttgagatatgttaatataattgaatttttcaaaataaatttgtttgtatcatcaatattctgatttttgattagctcctgtaggggaatggcactacaaaggtcaggtttattttttgccttacattatatctttagacgctatctcccactctataaagtaaaatatacttcattgccatgtttgtttgtttgtttgtttgttttgagacagagtgttgctctgtcacctaggctggagtgcagtggcgcaatctcggcttactgcaagctttgcctcccaggttcacgccattctcctgcctcagcctcctgagtagctgggaccacaggcgcccgccaccatgcctggttaatttttttgtatttttagtagagacagggtttcaccgtgttagccaggatagtcttgatctcctgaccttgtgatctgcccacctcggcctcccaaagtgctgggattacaggcgtgagccaccgcgcacggccctgttgccctgtattttctaagacacttaattgaactccttcaccaaatcacttcttgagtatttaccttctgagcatgggaataacaattttctcatttaatcaccataataatattatgaattgattactaaaattattttcattttatagctgaggaagctagcactcaaataggttaaataacttgcctaaggttatataacagaaatagtatttgaaaccagactaccttaactctttctgaagtggtcaaatacaattatgtccattaggatttaggggtatggtttcgtgtaggtttattaacaaagatggaagatggttatcataaattaatacatatgtaatatagttggatcactttttccaggtagattatgaatataagaggttacgtgggagaatccacaaatatatttaaactagagtctacattctagaccactatttttggagccagttagaactaggacataaagatcagaatgtatgtttatcagcatctcttcagaacttgggttaaaaacatgaactagaagtaaactataattcaaattcttattttcaaatcatttaaacattttgtttctacttattcaatcctaaatacttaaaaggtagagatgtgttatagaagctgctttttgttttctacaaaagaggttaattgatatcctcagtcatataaggaacttgtggcagaataagaattagtgtcccagccaggcgcagtggctcacacttgtaatcctagcactttgggaggccgagaggggcagatcacctgaggtcaggagttcgagaccagcctgaccaacatagtgaaaccccatctctgctaaaaatacaaaaattagccaggcgtggtggcacgcacctgttatcccagcaacttgggaggctgaggcaggagaatcgcttgaacctgggaggcagaggttgcagtgagccgagatcacaccactgcactccagcctgggcaacagagtgagattccgtctgggaaaaaaaaaaaaaaagaaaaaagaatgagtgtccctaaagctctccattcccatctgatggttgttcagcaacatccttgttggttcgctctttttttcctcttcattaagtgaaagcaaactgctgttttcaacatacgtattttctgagagattatacattgctattaccttttggctcagactcgatttttctatgctttcaactttttttttttttctagctaggatttgaacctatatcctttcaacttcttttagaaccattttaatgcctagagcattggactcagaagtctagcttctggccgggcacggtggctcatgcctgtaatcgcagcactttgggaggctgaggcaggtggatcacctgaggtcaggagttcgagaccagcctggtcaacatgatgaaaccccatctctactaaaaatacaaaaattagctgggtgtggtggtgggtgcctgtaatcccagctacttgggaggctgaggcaggagaattgctggaacccgagagacggaggttacagtgagctgagatcgtgctattgcactccagctcgggtgacaacagtgagactccatctcaaaaaaaagaaaaaaaaaagtctagcttctgattctacttcaattattaattggtaggaaaagtaaaaatagtattttctctaaggatactttaaggaaattaacgtttgaggcttattgaaaaatttggcaagaggtctctttttattcttttttctttttaaaaaaaagaaaatagagacaaggccttaccatgttgcccacgctggtctgaaactcctgggctcacgtgatccacccacctcggcttcccagagtgctgggattacaggcatgagccaccatactccgcagcaagcggccttttctaaatagtaaatgtattgttttcttttagtcatattggaagaattttaagtgttaatgtggcagcttccctctgttcatataatgatgggtttacaaattattttggctgatctcagaattatggtattctgaatttattaatcttcgaacctgtaggtagtctcttttcagaaccattgaattaagctattaagtgagataccagaaggtctcccaaacatatctaattttatagacagtttaaagcagacaagtttgtaatgttaggacaatctttattttgtatcttttcgaaataggatgtgagctgcaatgaaattcaaactataccttcccaaattggtaacctggaggccttgagagaccttaatgtaagaagaaatcacctagtacatttgcctgaaggtaagaaactatgaaataagaaaccatgaaataattgttttattattttaaagctctctcagaccaatcaagacaaaaatgtataagggttacatctaggctgggcgctgtggctcctgcctgtaatgccaacactttgggaggccgatgagggaggattgcttgaacccaggaattcgagaccagcctgggcaatatagggagtctgtctctacagaaaattaacaaattagcccagggggctggcgcactcttgtagtcccagctactcaggaagctgaggtgggaggagtccctgagcccaggaggccaaggctgcagtgagctgtggtggggtcactgcactctagcctgagcaccagaaagagaccttttttaaaaaaacggggtggggagagagagagagagtgtgtgtgtgtctgtgtgtgtttgtgtgtgtgtgagagagtatgtgtgtgttacctccagtgtttgaaatctaatggtttatttaatagtgttatctgttccattgtggattttaaaagcctcttcaatgaaaaggtttgataactcttgacctttgattttatttttagatcttgtcaaccgatgtaattaataactcagggtagggtccctggaaatttcagtaagcatgactgtttgggggaaatgtaacatgtttggataaggggatagtgtagtataatgaaaaacatttctgcagttagcactcacttaaaaatggactttgacctgaacttaaccggtcactggagatgttcaaacagaggctaatgaaccatgtggaggtgatgtgtagagtgaatgataaatggggtgagagactgcgctaagagacgggttatttacttaggctgactacaagctctgatatatgtatttgataaaaatgattaaacattaatgaagtctagtttatcaatctttcacaaattaatgaaacagaatgctagaaaggaagatgaaaatgagagctattattttatgagatccagaatatatatttcttcctatatgtttctgctcatcacccagcagtaagagtcatcagctcatggcaagtcttgtctcaactgtgctctcatttactttcccctgcactattctctagattaatttgaatcaaatacagaaatttattggtaaacattccagaaaaacaaggaatcttctcaaggtattttcatgacagtgcttttctgggttctttgacaaaatatgacttacagtgtacaatcaatattttgtttgttttgagacagggtctcactcccattactcaggctagagtgcagtggcacgaacatggctcactgcagcctcgacctctcaggtttaggtgatcctctcacctcagcctcccaggtagcttagactacaggcacttgccaccatgtcacctactttttgtatttttagtagagacggggttttgccctgttgcccaggctggtctcaaactcctggggtcaagagatccacttgcctcagcctgtcagagtgctgggattataggcgtgagccactgcacctggccacaatacatgttgaattaactaatgatgttttcgctttccctgtggaattcaaatatttataccaatttgatacagcataatatttagttctaacatactagtggagctttgacattttggattccaagtaaatgtgtaagaacgtgaccttttcagtccacttttatatacttactgcaaccaaaaccttgcgtgtctttcctctcacttggcttgtccaggaaccttcacactttttatcctcagggccttccttattttctcctggttctgtttgctaccaactcaggaatgtaaatgaaggttagcaaaaccaaaatcatgacctctaggaccttataaccccaaatttctccctagggttacctctgtactcaggactcgcctactgtggttggtcttcaaagacttactcctataataatatttagtgtgaaatcaattaatgagaatattagggttttaatcaaaatgaaaattgagcatttcagatgacaatggaagcttaatagttttatcaactaatttatttctgtatcttattttgattgtagactgctgacaaaatggtttatcacacaaatagtttcaatttttttaacagtttattttataatctcagcacatatagttgaactgagttagcaagtgaagctttattccaacagctacattcgttcgtgtggaagtttgtgttacttaattggtaatttctaacattgcaatttggtacatgtcatatatcttttgttatattgccattttgatttaaaattaatttttaccaaataatatgttacatcattcaaaaaatattaaaaaatattaagaatcttttttttttttttttcttgagacggagtctcactctgtcacgcaggctggagtgcagtggtgcgatctcagcttactgcaagcttcacctcctgggttcatgccattctcctgcctcagcctcccgagtagctggcattacaggcacacaccaccacacccagctaatttttgtatttttacttctttttttttttttgagacggagtctcacactgtcgccctggctggagtacagtggagtgatcttggctcactgcaacctctgcctcccaagtagctgggattacaggtgcccgccaccatgcccagttaatttttttttttttttttgtatttttagtagagacggggtttcattatgttggccaggctggtctcaaactcctgacctcatgatccgcctgcctcagcctcccaaagtgctaggattacaggcgtgagccaccgtgcccggccttttttgtatttttagtagagacggggtttcaccatgttgcccaggatggtcttgatctcctgacctcgtgatccgcctgcctcagcctcccaaaatgctgggattacagtcgtgagccaccgtgcccagccaagaatcttaaatagtgtcgttcccctgcctcaaacttccctgcacaccaatttcaatggccaaaagtatgtaccttcattaaactcctttgactctttttttttttgagatagggtctcactctgttgcccaggctggagtgcatggcgtgaccagagctcaccgtagcctcgaactctgtgggctgaagccatcctcccatctgagccttccaagtagctgggactgcagacatgcaccatcacacccagaaaattttgtattgttttgtagagacaagggtctcaccatgttcccctggctggtctcctggactcaagcaatccacccacctcagcctcccaaagtgctgagattacaggcatgagccacagtgcccagactgctgacatatttctaactgatatgtttttatagctattgctggtttgggcaactttgacacttatgtcagcttcctattgtgatgatagatgaggatttagtttccttacactgtcaccataccatgcctttactgctttcctcccatcttcccagtgtagttttagcacaacttctgattaaattgttactcagtgttcacattactgtaattatgtaaacattgttccctgccaattcaagtgatgtactctgattttatttcctttcttgtacatgtttttttctttttttttttgagacagagtcttgctctgtcgcccaggctggagtgcagtggcatgatcttggctcactgcagcctccgcctctcgggttcaagcaattctcctgcctcagcctcctgagtagctggaattacaggcgcccgccaccatgcccagctaatttttgtatttttagtagagatggggtttcaccatgttggtcaggctggtctcgaacccctgacctcgtgatccacccgccttggcctcccaaagtgctgggattacaggcgtgagccaccacgcccggctttttttttttttttcccctggaggtaatagtttcttatctttttatatgcttatttttatgtgtgtctatggctaattccaccctctttttccagcaggctttctggtcagaccagattctctatcccttttttccctgcacttccacctcactgagccctttttttctcttctgatgtggactggctgttctctagtattgctgcccagctttttttttttttgagacagtctcactctgtcacccaggctggagtacagtggcgcgatctcggctcacggtaacctctgcccccccgtcccgggttcaagtgattctctgcctcagcctcccaagtagctgggattataggagcccgccaccacgcctggctaacttttgtatttttagtagagatggggttttaccatcttggccaggctggtcttgaacttctgacctcgtgattcacccgccttggcctcccaaagtgctgggattacaggcgtgagccactgcacctggcctgctgcccagctttctttcttctgtgttaaatactctgagtcctagactctggatcttcctcagttactccctgttttgctggaggacatctcctagtagcttcccaagaacacgtcatgggagaacatatttttgagacttcactggaaaataaatgtctttattctatgttcccccttgattgtttgattataaatccaggttgaaaactattttctttcaagacttttaagtgttttttcactttccactttcagtgtttaaaattgatggttgaaaatctgatgccattcattcttaatcccagtattttgtgaccagcttttgctctctggaagattttaagatggtccctgtttatctgctgctctgaaattttatgttaatgtgccatagcatgagttgttttaatttaatgtgctggatacttggtgggcccctttccaaaccagagatccatatcttccgttttgggaaattgttttatatctttttttttttttttaaataattttctttcttctggtttctctgtcccctttttgaattattttgaattggatgttattagacctctttgttgatcctctttgatttttttttttttttttttttttttttttttttgagacagagtcttgctctgtctcccaggctggagtgcagtggctcaatctcggctcactgcaagctccgcctcccgggttcacgccattctcctgtctcagcctcccgagtagctgggactacaggcgcccgccaccacgcccagctaattttttgtatttttagtagagacggggtctcaccgtgttagccaggatggtctcgatctcctgacctcgtgatccgcctgcctcggcctcccaaagtactgggattacaggcttgagccaccgcgcccagctgatttttcttatattttttattattcatttctgtgtcattttgtgttaccttatggtaaaatagttccaaccattcttatgaatttttaattgctaccattatattttttcatttctacaaactcattctgtgatttttaaaaaatattccttttatgtttcagtgattaaagaccttctctttctgaaactaaagatagtctagcttttcaaaattttcttctgctttctataaaatacctgtttcttctgagttcctttttttggttagttagttggttttgatgttggagatgtctaaatgtctgtggatcatatactatctttatatggctgattagaagttctcagtatactgggcagaaattgtataatggtaattaaacaacaagctgtgtattttattagaagaaattctgtatcattatataaaggccttttatatgggactgtgaagtttatccagagaaagaagctccatttcttcttcgttattgtgtatattcttaagtacagccattcctgggatgaagtaggatagggtggggtgagaaggtgctgaggtcttaatgttaagtgtgtagactttgacttaactcctccatttttagctggcaactcctcctgacttttgtcatcctattgtgcctgggatcccttagttccgagcatttttgattcaatttcactagaaaataacttgctgattcctgggaacattggagaaggatagtgccccagctgtgttagtgggggctgttgacccaggcatttaactgttctttatgtagagtgttatctaatccttttgttatcctcaccttcttgtggtatcagggcctccagcttctgagactttctgtagttctgagcgggtcaaagctgctttttattagtaatcctgtctataggcaactggatctcatttttaccactttgctaccacttttctcatttttaccactttgctaccagttaatcactaaaagagaatgggagtaaatatctatgttaaaatcacatttaactagaagctttgtaaaaattctctagttgtaaaacatcattaattgttcatttccattttaccttcttgcagagctggcggagttgcctttgatacggttagacttctcatgcaataaaattaccacaatccctgtttgttatcggaacctcaggcacctacagacgatcaccctagataacaatccactacaatcacctcctgcacaggtaaaccatagtggaagcatcaggtaaaccatggtggaagcatcaggtaaaccacggtggaagcatctggtgaaccatagtggaagcatcaggtaaatcatagtggaagcatcaggtaaaccacagtggaagcatcaggtaaaccatagtggaagcatcaggtaaaccatagtggaagcatcaggtagaccatggtggaagcatcaggtaaaccatggtggaagcatcagataaatcatggtggaagcatcaggtaaaccatagtggaagcatcaggtaaaccataatggaagcatcaggtaaaccatagtggaagcatcaggtaaaccatagtggaagcatcaggtaaaccatagtggaagcatcaggtaaaccatagtggaagcatcaggtaaatcatagtggaagcatcaggcaaatcatagtggaagcatcaggtaaaccatagtggaagcatcgcatggactttttttggacaaaggatgaaatttaaaatttcatgtacatttatcattcggttagaaaataatttcttttaaaatggattcacatacatatgtatttttgagaagccttgaattaatggattagaagataatgtttccagaagtatttttcctttctctaaattggtatttctttttaaattgaagaattcttccctaaatttttttctaataaaattttagttaatttcttaattttttcttgtaaaattttagttaatttctttatttttttctagtaaaatttgagtgtagacaccataaatgctagagacaggccaggtgtggtggctcatgcctgtaattccagcactttgggaggccgaggtgggcagatcatgaggtcaggagatcgagatcatcctggccaacatggtgaaaccttgtctctactaaaaatacaaaaattagccgggtgcggtggtgggcgcctgtagtcccagctactcaggaggctgaggcaggaaaatcacttgaacccaggaggtggaggctgcagtgagctgagatggcgccactgcactccagcctgggcgacagggtgagactccgtctcaaaaaaaaaaaaaaaatgctagagacagataaaaatactcagctttcagagctaaaaactatcagtagatttctttttctgatcattgttattataaccttcctaattctaaagtcacaaattcctactttagacagtttggtcatttgtttaccagtgactgaagtgaagctatacagtaataattataaagtagctttacatgtagatgctggacatcctacaacctagaaatttttgccaactcattattttccctcagctcttttatttttttatttttttgtgagaaggagtctcgctctgttgcccaggctggagtgcagtggcgcgatctcggctctctgcaagctccgcctcccgggttcacactattcttctgcctcagcttcccaagtagctgggagtacaggtgcctgccaccatgcctggctaattttttgtatttttagtagagacggggtttcaccgtgttagccagaatggtctcaatctcctgacctcatgatccacctgcctcggcctcccaaagtgctgggattacaggtgtgagccaccgcgcccggcccccttagctctttttaactctgcagtttattgacgattttgtacaagcatatgttactctttttttttttttttttttttgagatgaagttttgctcttgttgcccaggccggagtgcaatggtgcgatctcggcttactgcagcctccgcctcctgggttcaagcgattctcctgcctcagcctcccgagtagctgggattacaagcgcctgccaccatgcccggctaattttttgtatttgtagtacagacgggatttcaccgtgttggtcaggctggtcttgaactcctgacctcaggtgatccacccacctcagactcccaaagtgctgcaattacaggtgtgagccactgtgcccggcggcatatgctactctttatggcaactataaaactttatgagtaaacttcctaacaatagaagggtcttataagcctcaagaatttgtgttttgacttctgggacaagtagcaacagaaatatatgtaatgtttcatgatttcctgctcttctctctcaaagcagaatcaaaaacatagttgtatatgattgttggattcctaaaagtaaaagttgcttcatgtaatctaatgaggagaaatgctttaaatctctgactatgcaaactagtcagtgtgataagtttacttggtatttgaacagtataatcaaaagttatttatttatatattactgaaatgtattagtgactagaaaatgaaaacatatttaccagttaaacacctaaaataacacttaaccaaataatataatttattagtttttaaatattactgtatgtacttgatagaaatgcctccctttcccaatgtatgttacataaaatgttgatatgataaaaaggagcatacttcagatgagtaataatttggctacatctgtgtgactttatttagatatgtataaaaggcaaagtccacatatttaaatacctgaacatacaagcttgtaagattgctccagatctgccggattatgataggagaccgttgggttttggctcctggtaagtatattctgtccctttatctatcatattttttgtacagagaatcaaataaaatggatacttaaatttgcctgaatgtttgactaaagggaaataacctgttttaacactgttattctcagaatgcttgtattgtaaagttgattacctagatctggcaaagtctagttctaagggtttctcaaccttggcactgttgacattttagatcagataattctttgttgtgatgggctgtcctgtacattgtaagacatttaccagcatccttggtgtctgcccattagatagatgccagtagtaccctcgcaaagtctccaaatgtcaccttggggccctccagttgaaaactactggtctgagtgacttgaacgctaactttagctctgctgctgaggtaactagccgaaggcaagtcattcctactttttgagtttcattttttctacaaggagtcaagagttggatttgttgaccattaacatcacttcaggatcttttaatctatgagtccctcagctacacagcctgtgacttataaggtcatctgcttggcagtcccaaccatctggaacaatctcttttttttgaaacaaggtcttactatgttgcccagcctggtctcaaactcctgagctcaagcattcctcccacctcagcctcctgagtatggagcagtcttaagtagcaagaattaaattcttaggcctttaaacaagcaggatagatgtttcagtcaaagtgaagtaatgtttatggactttactcaaaagagaacctctcaggccttctcttgaacctctcaaattttgcttaaaagcacagtcctagtaaactcgcctcattggacgaacaagaattgcagaggtgtgattgttttgaagctggataataatgagtacatgaggtctcatgctattctgtttgctttgtttctatttggaatttttcatattaaaaaattaaagcccatttagttctaatagttaagtgactgccacatttcttgttttttagaaaattgatctgtttaatttcaaattttaattgttaaaataacaaactttgcagtaacagagtctcttttcggcagccatgaagaactgtactcaagtcgcccttatggagcccttgattcaggcttcaatagtgtggacagtggtgataagagatggtcagggaatgaagtaagtgttttttatgttccgtgtgttataacacctgattaagagaaaacagaatgatgaaaatgaaaagcgtcttaactggattcagtttctcactacataaaatacagaaaagtcaaggtggaggcaagattcccaccctctccagcagaattggcattctgcgtccttaccggctttctgtcacgtggatttccgcctgtttcctcattgcctcatggaaatagtttcatatcatagaaaggcaaacaggagctgagccagttgaaactgaagcctacaatctgaggtggggggtaatctcgagcagaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttctgctcttaaaaattactgtgtccacagaggtctacagaagaaaaaaagtaaaaaaataaataaaaattactaatgtgtaatattttagctatgcattaagttattaagtaaacttttgttagcaagactgataacctactatttataacattgttttactgtgaattgaaaccaaattaattttagaccacatcccatttgaaatttggaattacttgtgtttgtatgtcttggtgggtgggttcataaatgtggctgtatcaatacagatatatatgtagatattttaaatctatatatatataatttatggagtcatgaatcttttatattttttgagacagagtcttgctctttcacccaggctggagtgcagtggcacgaccatggctcaagcagtcctcccacctaaacctcctgagtagctgggactacaggcttatgccaccatgcctggctaattaaaaaaaatttttttttagagacatgctctccctatattgcccaggctagtctcaaactcctgggcttgtcattcccatcttggtctcccaaagtgttgggattataggcatcagccaccactccagaccagatttttatttttttgaaataggatctcgctttgtcgcacaggctggagtgcagtggtggaatcctgtctcattgcagcctcgaactcctgggctgaagcgatcgtctcgcctcaacatcccaagtattaggattacaggcatgtgtgagcacatctagctaatttactcctggcctcaagtgatcctcctgctttggtctcccaaagcgcatggattacaggcatgatctgccaggctctaaaatgattgtttttaatgtttctgcttcttttttaagcctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacacctggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcagaaactctttctttctcgagtccagtttactcctaccttttctcttttttgtgtgtggcctttgactttctcttgagttgactgtgttcggttttccacctgccatctcctcacggagatattaagccccagacctaaaacacgaaaacacaaagatgcacctttcagtctttaaaaattggtcttcgctctttgtctcacaaactgaaactactgtgtttaaaacagtaaggagctgtccaaagaaaaatggtagaggtctctatttcaataattatcatcaattgctacattctttagtgaactaggactaaggttttctggagcctatttttgtgagtggccatgaactaaataataaacacttgtgtgccaggcacgttggctgatgcctgtaatcccagcactttgggtggccacagtgggcggatcgcttgagcccaggagttggagaccagcctggccaacatggtgaaaccccgtctctactaaaaatacaaaagttagccgggcgtggtggtgcacacctgtaatcccagctacttgggaggctgaggcaggagaatcgcttgaacgtgagaagcagaggttgcagtgagccaagattgcaccactgcactgcagcctggatgacaaagggagaccctgtctcaaaaaaacaaaacaaaataaaatataagtaaaattaatttaattttttttttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagctgggattacaggcacctgccaccatgcccggctaatttttatatttttagtagagacggggtttcaccatgttggccaggctggtctcaaactcctgacctcgggtgatctgcccgcctcagcctcccaaagtgctgggattacaggtgtgagccaccgcacccagccagtattatcattcttttttttaaaaaaagggccttggtttttcctatctgaatacttttgaacaccgtattttttgttggtaaagagacatacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactataaaaaaatagtatttctttaattcattgtattgttttgtaataatatttttaaaattctggctgcctgttacgtatggtagtctttatgacttctgtgtcataaagctttcgtaaaatttagcatctgtgaaaatgtgatgaggcagcattattttagatggtttcacaaccagtgaagtatctttttattttcctgaacactatctaaaaatggaatgttaaaaactaacctatgtgaggtgttaaacactctactattatttaattttattataatacttgtcacatacatagaccattcctgtctgaacatggtatgattttttttttaattaaaccaatgtcacattcattttgtcatgaaaatttcgtgtgcctcttagaataattttagataattgcagtatcataaaactaggatggggctggacatggtggctcacacctgtaatcccagcactgtgggaggccaaggcaggtggatcacttgaggtcaggagtttgagaccagactggccaacatgaagaaacgctgtctctactaaaaatatatattaaaaaaaaaaaacttagctgggtgtcatggcaggtgcctgtaatcccagccactcgggaggctgaggcacgagagtcacttgaacctgggcagcggacattgcagtgagccgagattgtgctactgcactccagcctaggtgacagagcaagattctgtatccaaaaaaaaaaaactagggtggtaagccactggtacagcgtcctaggagagatttgtgtttattgtttaaagtggtgtagcttggcctggtggctccttcctgtagtctcagccactcgggaggctgaagtaggaagactgcttgagcccggcagtttgaggccggcctgggccacatagcgacactctgtctccagataagcaaaaattttaaaatggtgtcttcactaaaattagagaaattatttttgcatcagagttgtagaattgtagtttattatttgggatctcatgtccagactttaagacagtcagttgttagccctttgaagtaactcaccaaaagtttctaatgatgtgtgatatacctgtttcttggaggtagatgctatttcttggaagtagatggtaagtagttttatgtttgatttgtagatatcctttttgggaaagttgttttcttatttttcccttgatgaataaccattttgatgattatttttggtgttgaaacaagattgtattgcttctataggttttcctttgataacctttaatcctctacctttgatttataattttatttttcagtgcgtggtctgtattttaaaccagtttaattttcctcagtaatactttttgaaaatgacgttttactctttggtttgtagataagtaaaattgccaataatattttccttttaaatacggtattttaccataaatagaaattactttttgttttgtcttgatattcaccgacacactcaagactgtttgtatgagtatgataagagacaatttgttgtgatggataaataaagaaatgtaacctgcccagtgaactcactattaccagaaatattcaagagaaactgagcaaatgttagggtagggtaggtgggaatttctgtcctaaatggaagtctgttagtgacctcttcggttcctttctaattctaacatcttattattcagtaaatattactgtgcttggtcactgtaatgtatataatacagtgagaaggaaatctactttcttataaaataaaataaatgtttgtggattgtgaatgtttttgtttattaaagcagcagtatagcatatgatgcttttaaacttaaagtttacatttgaagagtctattaaaatgttttttagtgtaatatataaattaaatgacaaattggatgtgaactgtgtaatcgcagtgttctggattaatatactaaatttatttatttctgtcctctggcctagggttcaccagtaaagccagtagccattagggagtttcaaaaaacagaagatatgagaagatatttacatcaaaacaggtttgaaaaaccaattctacttaatttgtttctgtcttaatcatgagagcataaagtaattttggttttatgcagatctgtgtgtaataaagatgtttacatggcatgtatttagaactgagcgacggtgtgcttttttgtactcatgccatagaaaaggtaaaaactgatttgattctaaattgagaccatctaaatcattacctacacagttaatcgatctgaagatacttagtagcaatgagattttgtggtgaagctatatggattcatgcacaaaaagggctaaaagaatttcaggactgggcatagtggctaacacttgtaatcccaacactttgggaggccaagacgggaggcttgcttgagcccaggagtttgagaccagtctgagcatcattctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaatacaaaatacaaaaaacgaatttcgagagttctaattttttttaacttacatttttgactggataacagagagaaatagtcagagacagtgatatgtatcaccagtcctgtctccgttaatacactctttccactgtacttggtgcctctcagaatattttgaaaattaggccctgtgcggtggctcatatctgtaatgccagcactttgggaggctgaggcaggtggatcatttgaggtcaggagttcgagaccagcctggccaacgtggtgaaacgccgtctctactaaaaatacaaaaaatagctgggtgtggtggcacacgcctgtaattccagctacaggtggcacatgcctgtagtctccaggctgaggcaggataatcgcttgaacccaggaggcggaggttgcagtgagccgagatcgcaccattgccctccagcctgggtgacagactgagactccatctcaaaaaaaccaaaaaaagaatattttgaaaattagcttgatcgtttagagcactgcttctcattcttgaattccagaatgtttcttgccatgaagaatttcacagtagttggaaatttcagcctttagttctttgccttctggttttatgaagtcttggtacacctattcttaagtgacggtgaatttacgtagttcttatacttgacaaggtattaaaggtaactcgggggactgagctatagatggaataaatgtgtagggagaaaaaagacagacatcactgtgacatttatactcttatcacttaactcatggagatttaattaaatttgatatgctttgaaatttatttcagaatgtcttttcagttgccacgtgtccttttattgagagtgtagtcttttaagattccagttttatgcaggagtttccagttacattccccaccttgagtgggcctgcattttatatctcctgcccctctcacgtcctgcatccatcataggtgaagctcaagagctccaggatttagtagaaaccctcaaggtaaaagctggctctttcactcagttaccttatgtgttagttttctgttgcttgtgttacaaagttagcagtttagaacaacacctctttattatattatacttctggaggatagagcctgggcaggccccgctgggttctctacttagaggccaaagtcagggtatcggctggcctggattctcatgtggagactgtggaggagaattcattttcacgctcctacatcttggcagaattcagtttgatgcagttaccggtccccattactgaggtccccattattttcctggctgccagctggtggccattcttggtgtttagagcccactcacattccttcttcatggctccctccatcttcaaaccaggaatgacaggccaaatcctccttatgtttggaatctttcttacttccctttctgccacatctcgcaaattcttttgcttttaagggctcgtgattatattaggtcaacctggataatctccccattttaaggccagctgattagtaaccttaatttcatctgcaaagccttttttaaatgtaatacaacagcattcactagagtaaggccagggaccgagatcgtggaagccaaaagtctgcctaccgcatcttagtccagagttcctgtttttacttctttttgaaggtctgtggattctttattttcatggcaccttagcaatacattttaaaagcttgttttattttattcagcattttggttatttccattggaagagtcattcagggcgtttagtctgccacagtgctggaaactaaagctaggattacatgttttgttttgttttgttttgttttgttttgttttgttttgtgacagggtcttgctctattgccttaggctggggtgcagtgttgtgatcatggtcactgcagcctctacctcccaggctcaagcaatcctcccacctcagccgctggagtagctgcaacttcaggcgtgtgctacatactcagcaaattttttgttatttttaggagagacagaaatctccctatgttgcccaggccggtctcagactcccagattgaagtactaaccctcctgctttggcctgccaaagcgctgggattacaggtgtgagccactgcacccagccatgattactgtttaactcggggttccatagcacagtccttggataagaactccatacttgatcctagtaaccagttaggctctaggatcaatatatacttcatgtttttaattagcaggtatttgtgaaatatctactatgtgccaagttcctttccagatgttgggatatagctatgaacttagtcaaaattcccgcactcctggagcttacattcaagtgaaatgttgaattcgaacctaaaaagacacagtcgcctcagaatgactgacagctctcagaccagcaagacttgtctctaatctgaataacatgttaacaaaaagactctacctcagcagtctgtcagttacagcaactcaaaaacattgagtgagcataaggaatcctctgctagtgagctgaaaaggaaagcttgcttacccgtttttttcttccagttcttttcccctaccctcatccaacacatacatttcttcccacctaccactcccctaccgctacccacatagagtctaccctactgggagatcataaacatagggagatacaataaataaaaagtgtgaatgttttgtagtatttgccaagatggattatgtaaatttgaaattgaaactagcaaaaattatgttttaaaaaaattgttaaaataattttttatgggctgggtgcagtggcttatgtctgtaatcccagcactttgggagcccgaggccagcagatcacctgagctcaggagttccagaccagcctggccaacatggtgaaacctgatctctactaaaaatacaaaaattagccgggtgtggtagcttgcacctatagtcctagctacttgggaggctgcggcaggagaatcgcttgaaccctggaggtggaggttgcagtgagccgagattgcaccactgcattccagcctgggtgacagagcaagactctgtcttaaaaaaaaaaaaaaaaaaattatagggcctacttataatttgaatagcattttagttcaggagagatgataataccagactaggttctgtaaagtgtgttatagcttctataagaagcaatatagaattaacatttagataaaacctggaagtttttttgtttcatgttatatagacacagccagaaaagctactcacattaattatgtgattttgtaaataaagaaaaacagagaaggcagtttagtctgccttatactggccaggtgtaatacacctgtattacctgtatagtgctgggtgtaatcccagcactatactggccgggtgtaatacacctgtaatcccagcactttgggaggccaaggcaggtggatcccctaaggtcaggaattcaagaccagcctggccaacatggcaaaaccctgtctctactaaaaatacaaaaaattagttgggcgtggtggcatgcacctgtaatcccagctacttgggaggctgaggcaggagaattgcttgaacttagaaggcagaggctgcagtgagctgagattgtgcccctgcacgccagcctgggcaacagatacgccatctcaaaagaaaaaaaaaaagtctgccttatagagataaaagtctggtttacttagctcaagtaagttcaagatttaaaggagatacatacatgttacctgcatttttgtttttttatgtctcaatattccacactttttcgggagagggtgctactgtcattcattcaagcaatatttcttaagcactatagtggttctgtctctgttccaaatccctgatattttagagttactttttagtggatgtagacaaatatatgtaacaagcatgtttcaggtactgctaggtgctatgaagaaaaataaagcaggataaaagagatggtagggtgagggaagagtgcaagtaatgttagatgccatgataatatttcagtagaaacctgaaaaagagcaaacattatggatgtctaggggtgaaacgttctaggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgagaatggttgttgtttttgtttttttgagacacgtctctgtcacccaggctggagtgcagtggtgtcatcatagctcataagcagccttgatctcctggactcaagatcctcccgccttggcctcccaaaatgctgggattaaaagcatgagccactgtgcctagccttgaaaacagtgtttgaagaagtatagagaggaatgaataacatcacttactgctcataggttttttgtttttttttttcccagatggagcctcactctgtcgccaggctggagtgcagtggcgcgatcttgactcactgcaacctccacctcccaggttcaagcgattcccctgcctcagccttctgagtagctgggactacaggcgcgcaccaccacacctggccagtttttcgtatttttttagtagagacggagtttcaccatgttgaccaggatggcctcttatctcctgactttgtgatccgcccgcctcggcctcccaaagaagtgctgggattacaggcgggagccactgcacccggccctgctgataggtttaataaggggaggactaagaaatagctattggatttggggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagctgagatcgcaccactgcattcaagcctggacaacagagtgagatgagactctgtcaaaaaaaaaaaaaaaagaaagaaagaaagaaacataggtagaaagaagatttaaaggagatacatacatgttatctgcatttttgttttttatgtctcagtattccatgctttttcgggggagggtgctactgtcattcattcaagcaatatttcttaagcactagaaagtgcttaagaaagtagaaagaaagtgtgtattaaaaaattgaaaagcggctgggcatggtggctcacacctgtaatcccagcactttgggaggctgaggtgagtggatcacctgaggtcaggagttcaagaccagcctggccagcatggtgaaaccccgtctctactaaaaatacaaaaattagccgagtgtggtggcgcatgcctgtaatcccagctactcaggaggctgacgcagaagaatctcttgaacctgggaggtggaggttgtggtgagcgagatcgtgccactgcactccagcctgggtgacagggcaagactctgtctcaaaacaaaacaaaacaaaaattgaaaagcatttttaaagtttagtgttcaggttagggcacataaacacacttgagttggtttatttggtcctttctatgttttgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcactcggaggcctcggtgggtggatcacttgaaagctcaggagtttgagagcgacctgggttaacctagcaaaacccggtctctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaaaaaaaaaaaacaaaaaaaacaaagacagctgggcgtgatggctggagcccaggaggtcaagactgcagtgagccatgatgatgggttttttttggttgccctaattagcacactgatttcagtgcctgtagatcagcctgataggctaatcatcatagttttggaggccacgtcctaaacgtcagacagtaactaatcttgccagttttagtttcagacacaaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttccctaaattgatagggaatattggtaacgtgatcctcatttttacttttgtatgcacaataacgctttggttccagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaaaaaaaaaaaaaaaaaaaagtaggcaaatcttttgaccaatagcaaaaatactaaaattaatattcctacaagcagaagttcacaaaggtacctccctccctcaaaaccttgtctgccctgagatgtttcttctttttgtgccttttcaaccctcataagaattgttaatgtactaatggccatgttctcttgtcctcctttatctctgtcattgtattttcacacaagtcatctaatactatacatactatatctcctaatttgtctaaccatttctctttcccttaagtccctgcttgatttgttactacatacaaacttttttatatagttctcttgaaactaacggaaatactttattggtttattcttaataggtcatttggaggtgttcaggtttcacagatgaggaagctgtaggtctaggaagattaagcaatgtggtcatttatagtacatttgttttcttaatcaggaggcaaacctagacttctgaaagcctaacttggttcgtccatttgacttgatagacctttatggaatgctggttgtacaaggaatataaagatgcataaaatacaagccctgcccaccaggcacagcttagaccttatcagggaaataaacacaaataaaacagaaaataaggcagcttataatgaaagtgctagttttatattcaagacagtagaagacttagagaacaagtatcatcagaattgacctcaaaaagaaattatagggaccctgaagagtgagtaggtaggatttagccaggaagaaaagactggatgatggtgtaaaggggggttcgttttaggctgaggaaatctaaacaggatgggagctgggaatggccttgtgtgatttgtagatttaaaataatggcacttgcaggaaacaccagctggcctggagagtttgtattgaagacttatgggaaaaatgaattattgagatgatgataatcgtacttaaaacttattgaatgcttattatgtagtaggcactattttaagtacattatatatatttactcatttaattctcccaactctctttaggtaccattttttctttttttttttttttttccttttaattacatttattttaatgctgaatttactcccgtgccgtaagtttttgtttcttcagtttcttctgggatatctttttcttctgggcaacctcctcttctggtttaggaacaatctgttccttttccataaggatcatctcaatgtggcagggagagctcatgtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccaactccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacagattacctcaggctgcttagggaaagagcccattttttctttttatgaacaaggaaacacgctcagagagaataacagtttactaagattaaatactcaggaagtggcaggattaaaatcctgtgattagaacaaggcaggttggctctgaagcctattctgtgagcacagtctatgctgcctctcggtaataatggttaacactgaatcttaagtgctgttctatgtgttttgcataaattaacttactcagtttgccttccgtagaagtcacacagccagtaagagatagtcaacttgtagagagtcttgattaaatgtcaaattagtgttggatcttgatctattaagtaaaagagaacacttgagtttcaaagcaggaaaaaacatgagaagagagagacttctgaaaaactaattgacttgcgttagaactggttaggaagaaagactagaaagaggaaaatgaagaaggaaattgcaatagttagactagggtgcaaaataaggcataaaaaccagatggtttctaaaggtcctaagggttggcagtattgcagtgacaagagcctaaattcagaaatctctgcatttgaatccagctttgccacttgccgtgcgcttgactttcagaaagctactgagccattttatgctgttaggttcctcctgtgtgtgatatttaactattaaatattaactatctcagaattattatggatatacctaatgcttaatactagtatggtagatgctatatcccctattactataataaaatggatttgctgaattacctataagagagatggtgaataaatcacagatggtgaataaatcactgaagagggtgaaaaaaaagaagctcccaaagcaaggtttggaggctgaaagatggtttcaaatgagggtctagcattgtggaaagaacacaggctttgcagtcggaaggcaggcccaaaccagttatgctgctgacgaacttggagaccttgcacgtgccgcataacctctcttctcgattttctcatctctaaatgaatatgatgatgatattttatctcacacagtagaagaatcactgaaatactgtgtacacagtgacatacagtagagcacgttgtaaagcagggaccacaccaatgctataatgttattattagattattagacatcacacgttggagaaaatagccagttagtatgggacattgtgagtttgtttttgaatgtgtcagatatgaggtggagtggggtttccaagtagagagtttccatagacagttgaaaacacaaacctgagatttgcttctagctaaggttattagcattcgagtgatactaaagccattagagggagagaataagttcatcgagtaagaggtcaatattctgattataaatgtgtttgtgtagatatatgtatagtttttaaaatttctagctaaacattttctaactagtaaatctagaaaaatgctataaacaagaggtaaaaaaattaatttgagtgattattttagtaaatagaatttgttatttgcagtgttccaggctctaaccaacttccttttttggggggttttgggattatacagcaaaaagcatcacaaagtccacaaaaacagcacccgctcctagatggcgtagatggtgaggtaagttgatgtaatctccttttctttggagttgattatttttgcaatggaaatgaaatgtttacatgtaattgtcatgttttcagtgctcggaatattgccatttttctttttccacctcacaatattctccttatgagggagatgatacaagccaaggagtttactagaatctatagatcaaggcttttttcagctatacacatccatctagagatgatatttccctccctgacccccaccagaggcaccgtccccgtctcctccacttttgaagcgttgtgtgtagagtcctgggagctttacctggtacaggtaaatggagtggctactaaacaaaaaaagactcttacataggatttcagattcagtgctatcaatgataacacttattttataatatcaaatagtacatttttcttacagattaacagaaaataaatcacttaaccttttaaaaatctacacacctcttttgatctgttaaaatgaagcttactaaatgtttttcttgtagttggctttctcattaaccattttccctttaaaaacctaccagttttttctttttctttttctttttttttgagacagagtctcactttgtcacccaggctggagtgcagtggcgcgatactggctcgctgcaacctccgactcccgggtccaactgattcttctgcctcagcctcccgagtagctgggactacaggtgtgcaccaccacgcctggctaatttttgtattttcagtagagacggggtttcactgtgttggtcaggctggtctcgaactcctgacctcataatccacctgcctcggcctcccaaactgctggaattacaggcacttaattccactgcgcctgacccagtttgttttaatttatgatcattacctccttgaaaaatgcataaaagcgttgtttcatgtgaattttgactttgcttttcataaaataagttatttgaaaacctaacacgtggggctttacaagcaacaattttcagtgtttttaaagcacaggagtttctggtatggaaaagtgtattgtttgaaatgttttcaattgtccattagaaaggtttttaaaaagttttatcagacatagaactacttctgtttttttatgttagaacattatatatttgtataatacctcaaagattggctccagcatgttcacttgtcttttcttcacctggtaataatactaacacattttcgacaaccaaagtttgataaatttaatgtgtgttttcttttttaccccaatatttccttcttgatgattgttttcaagtaattcattctcaagaaaactaaagctccacaggaaaataacataaacagttctaaaaattgtaattgtacttttcattttgcttaagaaagaaaatgaagagatacttagactagaaattatgactctgggcttcttgtttgttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagttttatttgggtgtttattattttattttgtatttttaaatttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctcaagctcctgttaatatcagtttacactgacattgtcttcgttctgcccctcaagctcctgctagtatcagttacactgagattctcttcaggctacccctcaagctcctgctagtatcagttacactgacattctcttcgggctacccctcaaactcctgttgctttcgtctatatcaggtctcattttaaaagaatatgaggctcattttacctcttcttcctccactcctagttttcctttttatatttgacattggcagtagttccagtacctttgattaaaaagcaggcccaggaaatctaaaccccagaagtatacacagtgtattaccattgtcacagttttgctctttggtatatttttatcttcattatttgctgccttaagatagattttgtgatacatataatacattgtgtgttacatgctgcttttgttaaataaaaatatgttaattctcattaaaaatacagttgtatttatttcattgaccatatacataccttttcctaaacacctgtttgttttcttgttcatttatctcatagtttagaaatttatggtcctagtttaaatttttaaaaattacttataaagacttcactatttttaagctcttggcattttgttgttttaataggtaaaaccttatccagggctctttgtgaaagtattgtcttctctgatttccactctccatgtggcaaatgagaaaaattgtcatgttttgagcacctcttacctgtaatcaaaattctatgtaatactttaaatttttgtctttttaattgacaataattatatagatacaatctatctctaatacagctaaccagttgttatgttggttggtgaaagataaaggattcgaagaaaagggaaattccaccttcccctcttatagtcattaggagtttcacagaggcagagatgaaatgccggttcctcctttaggttgatgcagaatcctcatgtcctaattataatatatataatttggattaatgttgaaaagatattgtttttattgatgccagttctgcttggttaaaacccctcatcgtaggaacaggactcactagtttcaaggctactatgctaacaatgttgatgttctgttttatttctgcataaaatcatttttcagaaatcatgcctctcatttcttgattaatgtggcatgaggtattgagactatcctgaattatacaagtggaaaaactgtgtccatgggtttttgtcccccaaatattctcttcctgccctgtcagtagcttagtaaaccatttgaaagatcgtcagtgacctttccttttctcatttcactagtcagatctgcctgcctgacatttgctaacataaatgctgccttctgtttcttctctttctcatttgaaatgtagtcgctgtcagggttgaatcaagtgggctgtgctgctaccctgcctcattcttctgccttcacgcctcttaaggtatctcttgttattgtaattcaccaggaagtttggggaggaggtggatataaggtcttgaattttttggtgaattgatctaacaatctgaaatataggatcgcataaatatacctgtttatggaactatttgtttaacattgatttcccttgaaattttttgaaagttttatgatgctagagatagtcatagagctcacattaattcttcgtattcagattgtttgatgtgtcattctgatttttttatcaaaggtgtttttcttgtgagttattatttcactttggttagtatataatattgaattaactctgttgtctaatgtgcatgcaaaataatttgagtccaaaaaaactatcactaccaaaaccttctacagtaggggtcaaccaactatggcccctaggccacctgtttataagtaaagctttatttttacatagccagtcccttttgtttatgcattgcctatggctgcttgcacagtaaacagctgaggtggaataattgtgaccaacatcatatacctacaagcctaaaatatgtacagtctggccctataagaaaaaaaatcgcaaacccctgctttttatcagcaataatgtcataagagatgatacattccaccttctggaaaaatttaatctaaactctaaaaattaagaacctgtagtattttattttttgaaggcctctaggagtggtaattccatatttgttatcactggatatgtacaaaatgatcaataattctcactgtcaagaagacctttgtctaacttacaactgtcctgctgtggtttatacttcttttctttccagagtggagattttctagttatttagcattttttaatgtaagaatcctttttttttttacacaaaatacaatatttttttaatgtaagaatttaaaaacaattacgatgccatccttagcttcttcctaaataaactcagattcttttacatgcctttcccagactgttcatctttaatgaattttcacaagttctgtgccctccattctggcttcatggtccaaactagaaatacatccctcgttagagcttgctcatttagggtgatttttaaatttttggtcttcattttgctcagtatccactggaattctcaaatattttagttatacctcttctatgtgttgagacagggtcctgctctgtctcccaggctggatcctccctccctagcctcctgagtagctgggaatacagatgcgcaccaccatgcctggctgactttttaagtttttgtagaaacaaggtctcactgtattgcccaggcgggtctcaaactcctgggctcaagagatcatcctgcctcggcctcccaaagtgctaggtgtcagccactgcgcccaacctccttcaacttctaaatgacagttactttccacgtgttgtattctttattttttcttgaatatttaattttgctgtttgaatatttttacttgtctcatgtaccagaatactttcaaattgttgcattgagccaggtacactggctcacacctgtaatcccagtgttggtagcccgagggggaatacaattgaggccaggaactcaagactgcagtgagctgtgatcacaccactgtaccccagcctgggacagtgcaagactgtgtctctaaaaacattaaaaccgaattcttgtatcatgtcctttttttttttactttttaatttttgtgggtacatagtaagtgtgtatatggggttcatgaggtattttgatataggtatacagtgcataataattatatcaggtaaatgggctatccatcacctcaagcatttatcctttgtgttacaaacaatccagttatactcctttagttatttttaaatgtacaattaaattattgactgtgatgaccattttgtactatcaaatgctggatcttattctttttattttttttggacccattaactgtccccatttccttcccccaccctcccactacccttcccagcctccggtaaccctcagtttagtctgtctgcattgtgcttttttaaatgctgaccccaactttttttttttttttttgagacggagttttgctcttgttgcccaggttagagtgcaatggcacaatctcggctcactgcaacctctgcctcctgggtttaaagcgattctcatgcctcaggcttccgagtagctgggattacaggtgcccaccaccaagcccggctaataacctcaactttataacaactgtaaatctgagaaacctcctctggttattgttgagcatgccctacatacctggatgcctcctgaaaaaacttcataattctcttccatgtgaaccctttgctagccgttctcaactgggatccttactggaacaacacagaaaattatttcagcaactttttttcaaaatgatctcaaggaaggtccataactggcaccattctagatgtatgggagagaagttaatttgttgtactccatgaacaccttcgggcattgtggcttattcagagtcataactgagagttgttttgactgtgccaaaagttgtgtggtccagacagaccacagtgtcttgttctacagtgactgtcatatgagattaaaaataaaacttcactagatttaagatagataagtcttttttttctatccgacctgctgtactgtcaaattattattttaaaagatttattctttatttttttagtatctctattactttcacagcaattatacattatacttatgaatttatttcttttattgcttagctaggcttaaaagttgagtttatatcagttctgggtttttttttctttccattgcctcaattctctagtgagagattatttcttaaccttttttttgctctccagttttccaagagttcccaaatgtagttaatggcctcacagtgatttaagctaatgatttttagtatcctagaatgcaagtcacttagatttatagctttaataaaaatacatttcagaaaccatttttacacgtctcctctcctctggctttgttttcatcacgcccagtagtatattatctgttgctgtttctttcttttttgttttcctttgagacggactcttgctctgtcgctcaggctggagtgcagtggtgagatctcagctcactacaaacctctgcctcccagtttcaagtgattctcctgcctcagcctcccgagtagctgcgattacaggcgcatgccaccacgcccagctaatttttgtatttttagtagagatgggattttaccgtgttggccaggctggtttcaaactcctgacctcaggcaatctgcccacctctgcctcccgaagtgctgggattacaggcgtgagcctactgcgcccggcctgttgctgtttcaaaccgaaggagagaacattcgctgcccttcattgttgtttcagctcttctcatctcataaagttgcctgttaactttctccttttattccttaatacttttaaatttctagtctatgtcctgttaataggaagtgttttttaaatttctagtctatgtcctgttaataagtgttttttaaatttctagtctatgtcctgttaataagtgttttttaaatttttgaaaatattttttcctccattgtctagaataatctctaccttgaatgtttctctttttgtattattggtccttgaacatgtctttgtttaaccaattttctacttattcacaaccctggaaaataaacatagtcttttacttccttgtaaagatatctggcttttgcctcatttacctgttcattccttttaccagtttctgttactcttgtttgaattaaatttcttatttaaatttccattttttctcaacacccagaacttagtttacttgcatctataaacccgatgaacgtgtcttttccacttaagatgtgaacacactgccttacgagctcagctcactgtttaaatcttagttctccacctgtgatatcaaactaaggaattgttaccagaaaattgtctccaagtgagtcttgagaattttctcaacatatggccttggtttatttatttattatttatttatttatttttagcagttaaaattatttgtcctcatttatctgacccaactgtaagtagcgatgtaagagttctgaaaatattgaaaccaatggtagggaaagtatgggagcagatttgtatgtttgtgttaattttagagtcattatgtccagaaatgtgccttagtcgtatcataaagttataatatatttagattatatttcaaggcaattagatgtcaaggcctaaaaaactattaatgttattctagcttttcttttatttatttatttattttgagatggagtctcactctgttgcccaggctggaatgcagtggcgccatctcggctcactgcaacctccgcctccatgttcaagcgattctcctgcctcagcctcccaagtagctgggactacaggcgccaccaccatgcccacctaatttttgtatttttagtagagacggggtttcaccatgttggccaggatggtctcaatctcttgaccacgtgatccacccacctcagcctcccaaagtgttgggattacagatgtggcccatcgcgctcggcctattctagcttttcttaactgtactcccctgccaagtcttcagcagctttaacctagtcaacctacatttctttgtaaattagcttaactacatttccctttctttaggtaagctttgtaactgtttggctagttcttcctcctttttacagttcttttggtcaatgaattgaaaatgtcttggactcaaatactagtgtagaaaatatatctatcatctcttaaacatcttctctcctaaccgaaattaggaaacctatattactttttaaaaatattaaattttattctccagagaaaaaagtactttagaaactattatggagaaatactattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactcgggaggctgaggcaggagaatcacttgaacccgaaaggcagaggttgtggtgagctgagagtgctctattgcactctagcctgggcaacaagagcgagactccatctcaaaaataaaaaataaaaacagctgggcgtggtggctcatgcctgtaatcccagcactttgggaggccgaggcaggcgaatcacctgaggttgggagttcgagaacggcctgactaacatggagaaaccccgtatctactaaaaatacaaaaaaattagctgggtatggtggtgcatgcctgtaatcccagctacttgggaggctgaggcaggagaattgcttgaacccgggaggcggaggttgtggtgagctgagatcgtgccattgcactccagcctgggcaataagagctaaactccatctcaaaaaaaaaaaaacaaaaaacaaaaaaacaaaaacttggcttttaaaaatacagaattaattcatttcaccaaatcctcatttctttttcttcttcttctttttttttttttttttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagaccttgtctcaaaaaaagagagagagagggagagagagagtctccctctgtcacccaggctggagtgcagtggcacaatcattactcactgcagtctttaattcctaggctcaagcaaccctccctcctcagcctctacaggagcacaccacaatgcctgaccaattttttagacgttttgtagagacagggtctcactatgttgcctaggctggtctcaactcctgctctcaagtaatcctcgcacctcagcctcccaaagtactgggattacaggcatgagccactgcacctgacccaaattctcacctctagacttaatcgtgaaggagagttacctgttttttgtcttttataatttcaaaattaccataaaagtagaaagtatttcttcttgaataacaattattgatatatgtctgtttctccacagagtgatgacagacctaatgctctattaagttcacctgcaacagaaacaggtaatagacacaaaggtgcaattaaccacatcaagattataattctttatttttttatttaaaaaataataataaatagagacgaggcctttctgtgttgaccagggtggtctcaaactcctgggctcaagggatcctcctgccttgttctcccaaagtggtgggattacagatgtaagccacagcacccggctaagattataattttttaccaagattttcctaaattacttgttagagagctgtggctgctttttctgagatagaaatcagatacagaattggaaaccactgggtttttttttttttttcccatttttaaattaaattggttgctcagctagtcagccatttgatatgaataagtgaacaacagccgtaggtctgcgggagactgttcaatatgataacattcattctgcctttattgataacaccaaaaataacatgacaatgtaaaatacatacaagcggtcctcctggtttcatgattattttctgtaccagacttttcatcattaaatagaattattttatatcattgccatgtttattttttacttgttacttttgtaacttgtatgtctgctattatattttcatctcctttaatctcattttatttttcatgctaatttagttcatcattcccctgcatattcttttcctgctgctatccagagaaatcagcctcagcgccctgaaagcttccttttccgagcaggtgtcagggcagaaaccaacaaaggtaggtggtggtgattttaaaagccaggagcgaggggaggtttacacaacgacgctagctgttagatggatgcttttaaacttctgcatatagtataagacaaagctatcagctcggcaaaagcatgtgtctgtgatctcactgatactaaagcaggaaaatcttatctgaatttgtttggatgagaaagtttcttagtgccacctaaaagcaggttatagagtgtttgaacaaataaaatgcgctttcgaggctttagagaatgttctttgtcttggtaatgaactctttttcacatttttctattgataaaagctgttttcttaaaacaataattgttttaaaatctactttaagtctcatgttcttttagttaataatgacaaatttctccctggtccccaaagaagttacctgggagtggaaacaaacatttcaagtcaaaaataacaacttttatcatggtggtgtgtgcctgtggtcccagctacttgggaagctggcggggaggattgcttgagcccaggacttcagggttacaatgagttataattaaaagcaccactgttctccagcttggccaacagagcaagactctgtctcttaaaacaaacaaacaaacaaacaaacaaaaataaggtcaggcgtggtggctcacgcctgtgatcccagtgctttgggaggccaaggcaggcagatcacttgaggtcgggagtttgagatcagcctggctaacgtggtgaaaccctgtctctattaaaaatacaaaaaatggctgggcacggtggctcacacttgtaatcccagcactttgggaggccaaggcgagcagatcacgtcatttgaggagttcatgaccagcctggccaacatggcgaaaccccgtctctactgaaaaaatacaaaaattagccgggtgtggcagcaggcgcctgtaattcctgctactcaggaggctgaggcaggagaattgcttgaacttgggaggcagaagttgcagtgagccaagatggcgccactatactccagtctgggcggtagagtaacaaactggccaggcatggtggcaggcgcctgtaatcccagctactcgggaggctgaggcagagtcgcttgaacccaggaggtggaggctgtagtgagctgagattgcgccactgcactccagcatggatgacagtgtgaaacttatgtctcaaaaaaaattaaaaaataggccaggcgtggtggcacgtgcctgtaatcctcgcactttgggaggccgaggtagatgggatcacttgagctcaggagttcgagaccatcctgtgcaacatggcaaaaccccatctcttaaaaaaatacaaaaaattggctgggtgcggtggctcacacttgtaatcccagcactttgggaggctgaggcgggcagatcacgaggtcaggagatcgagaccatcctggctaacacggtgaaaccccatctctactaaaaatacaaaaaaaattagccaggcatggtggcaggtgcctgtagtcccagctactcgggaggctgaggcaggagaatggtgtgaacccgggaggcagagcttgcagtgagccgagatcgcaccaccgcactccagcctgggtgacagagcgagactccgtttcaaaaacaaaaacaaacaaacaaaaaaaggcatggtggtgcaggcctgtagtcacagctacttgtggggctgaggcgggaggatggattgagcccaggaggttgaggctgaagtgagtcaagattgcgcgattgcactccagcttgggtaacaaagtgaaaccctgtctcaaaaaaacaaaaaaaacacaacttaccttcaatgttaccaacagatgcattcacagtaagatttaaaagtcaaactacagatgcactgctggtgagagtgtaagaaagcatggaagactgttatcagtcagcctctgtacccacagattctgtatttatggattcaaccagtcatggacagaaaaatcttcagaaacaagacaacgataataaacaatgccacaataaagaaataatactaattttgaaatacagtatagtaacaatttatatagcatttacattgtattaagtattgtaagtaacagagatgatttaaagtatagtataaaggaggatatgcatagtttgtatgcaaataatactacattttatatgagtgacttgagcgtccacaaagtttggtatgagagaggtggtttctggaactaatttcccctggatactgacggatgactgtgtaccctatgaccagcagttttacttttgagaaatatgtacacacgtgtaccaacaacgtgtacaaaaatattcatagcagcattattcataatagcctgaaactgaatgtccatcaagagaatggataaatgaattgtggtatatttgtacaatggaataccatataagcaatgaaaatgaaccaattcctatatacagcaacatggataaatctcataaacttaccattgatcaaaggaagccagaagcaaaagaatacatacaatacagcataatttatacaaagttcaaaaatgaaccagaccagcctacagtgttagaagtcagggtgcggttttgagcacgttgggtacttatgggcaaggagcatggaaggggctcctgggattggtaagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttttaaaaagtcaatccagaaagtggaaagcaatatactgtacttgcaggaagtagaaaccaatatactgtacttgcaggaagtagaaagcgatgcactgtacctgcaggaagtagaaagcgatgcactgtacctgcaggaagtagaaagcgatacactgtacctgcaggaggtagaaagcgatgcactgtacctgcaggaggtagaaagccatgcactgtacctgcaggaagtagaaagcggtgcactgtacctgcaggaagtagaaagcggtgcactgtacctgcaggaagtagaaagcggtgcactgtacctgcaggaggtagaaagccgtgcactgtacctgcaggaggtagaaagcggtgcactgtacctgcaggaagtagaaagcggtgcactgtacctgcaggaggtagaaagccgtgcactgtacctgcaggaggtagaaagcgatgcactgtacctgcaggaggtagaaagcgatgcactgtacctgcaggaagtagaaagcgatacactgtacctgcaggaggtagaaagccatgcagtgtacctgcaggaggtagaaagccatgcagtgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatacactgtacctgcaggaggtagaaagccatgcagtgtacctgcaggaggtagaaagccatgcactgtacctgcaggaggtagaaagcgatgcactgtacccgcaggaggtagaaagcgatgcactgtacccgcaggaggtagaaagccatgcactgtacctgcaggaggtagaaagcgatgcactgtacctgcaggaggtagaaagccatgcactgcacttgcagggaaactgtgatgaggcagagccggatgttctcctagcactgccagttgcctttctgtcttacatattaatatttttataggtcatgcttcaccccttcctccatctgctgcacctaccactgattctacagattccataacaggacagaattcaagacagagagaagaagagctggaattaatagaccaactgcgtaaagtatgtacattacctttgatttacactttttcagtattactgctatagatcataatcctgtgatcacgtcttcatttgacacatcatttttatttattttttttttagacggagtctcactctgtcacccaggctggagttcagtggcatgatcctggctcactgcagcctatgcctcgtgggttcaagcaattcttctgcctcagcctcctgagtcgctgggattacaggcgcccatcactgcacccagctagtttttgtatttttagtagagaaggagtttcaccatgttggccgggctggtctcgaactcctgacctcaggtgatccactggcctcgacctcccacagtgctgggatggcaggcgtgagcttccgcgcccggctgtaatttttaacagattagtgctgggattgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctac

SEQ ID NO: 2072 - DNA, 5671 bp, Homo sapiens
gggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaa

SEQ ID NO: 2073 - DNA, 60850 bp, Homo sapiens
ctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaact

SEQ ID NO: 2074 - DNA, 70942 bp, Homo sapiens
atctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttgtctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagacgccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagcccc

SEQ ID NO: 2075 - DNA, 32028 bp, Homo sapiens
atccaatagcattgacttttattcattcatgttaagtcacctgaaatgatatctgttgcatttaaatgctcattaatgtaaatggctgaacaaatccatttcaatggatactcaatatcccacatagataagtcacttcaacacagcctcatgacaactcccacaccaaaacagtactttattttgcaaattttgacccattattactcccatgttgttttttttcagctgtcaagtgtacaaggtgaagagaaatttcagttagacaggggctgcacctggaaaataaatttcttaaactccataaacacatttcaaaactgctgggtcccaaaagtccatctatgaactctagggctgccagtatcatgtgcagcacattaaagctacactatccaaatagcttattaattctgcataaatcaggtcaagcaatgtgtcaacctgtaacagactgtgcactttaactgaacatggcaaaatattcactctttcgaactttacatcatcatttgatgtcaaacaatgaagcaaatcccaacagtatatacaaaaaacagctttgcatttacaaaagattgtttcccatactgattaatccaggcagctaactcattggtttatgcaactttattgaagaaaaataaatcaattactagcagagctattagttgatcactcatccattgacaacttgcatcatttattcagtgctatattaaacagtgtattggaagatagattaactaatagctccaagcctcctaacaatttaaatgaaaattacaaaatgtttgagaccctattttggaatacaaagggtgtttgacttccaatttccattctctgtagaacaagaacaggtcattcctttattgacatgcataaaatacatcacattttctgttctgctgatgctataaattcaataccaattctccagccacatcagttatgagcataaagcatatcatgtaacctcaaatctctaacagtggaaggcttaaacaagaatggatgctgctagaataatgctgtatcctttgatgtgacaactgagcatccatctccctccccctcagatgatttcttcagcatgttagagcagtgaggaatggttttagtctcataaccaagttagagtgaagacattggccacataatacacatgctccatttttttttttaaaaattctgagtcttgggcaactgttctcttgtaactactttacagtttctaaaagcagttattgtccaaagctggaagaacttaagtcttctcagatgagcatgtgaatgaatggagggaggtaaacaaaaaataaaattaaaaaagatgaggtctgataggggagcagccggataagaaaatcaaaaaaggaacagtaatttaaagtttattccagctataatgcaggttattctgactttaaggtagcatcacatggcatacttctgagtccattcccgagatattctgttgtacctgtaaataaagatgttatttttaaaagttaaaataaagaattcctaatactttaaatggaagggaaagatttccattttatcatctccagactcatcatgaagtcatctctaatgactatgattagaataaaagccaacaagggagaaatagcactggtactcaaagcaatgtgggaaatgagagcctgatgctctgaaagtagtattttaaaaacaactaagaaagcagcactgaaaattgggaggctaacaaaaatcaaaagaccctttctttctctaccaccgagctcatgctctaattttaacgtgaagaaatttttacagttcattatggacaaatgttaaaatagtatacacattctatctatccacagaaatttccaccaaggccagaactaggcttttactagaacaattttatctgaatcctagagtttgggaaattacttggtcctggatattacaagaaaaaatggctttgggacttaggtagaggcagaaggggaagatgacactgggcagaatgacaaagggcagtaattttcaaaaggggtgtgtgtgtgagtggttgtgttcatcagaatcacgtgttacttttaataagtgtggtaactgaggctaataagcaccactgagacctgttgagtacaacaagggcatcttcgtttaaaaagatcaacaggtaattcacacacaagcaaggttattactcaggaagactactaacattgataaatactatcagcttccccctggattatactcatgccatagactacttacaacaacaaaaaacagtgataaccttaagaaaggaatatatatatatatatatatatatatatatatatatatatatatatgcacaggagaatttttatattgtttaaatattaactagctttatttcaaaccaagaaccaaatatggtccaacaacttttctaaactttttaaaaagttctttctaccaattcattgtcatctcctaaggatactctctcaaaaagccagcactttaaaacaaaggctttatttagcatacagggagccacaaagtacagctgacgctaatgcatgcttgtcagtaatgaacatttagtttagatgcttaggcttaaaagtgtttttcccttacattactatctcctggcaaaatttgaactaaaccaccacattctgtataggattggtacaaagtctcaagctaaaatttaaacaccatgatagtttgaaaaaaaaaaaagatactacataaattcccatttcttactagtgctattgtaactgctttgccatgcaatactttcaagcagtaacggctaccagatatttactttcacgttaaacagagaccaagcagttaaatgtacagttttcagaagactgccatatttgttaccttttgttagttaatacagtgccttaacgcatgcagcactcaagtgctggcagtaccataataagcgcaccatagagtgcagatcctcttaccctacaacatagcgtatttctctgtccactctcttgctaacctattgtacctaattgaacaagtacacttagcattaattataacatatgaaagttataatggttaagttgaacataaatataattcaaatatttgagaaatttagaccaaatttttacaatagtactaacatttttggaaaaacatgcttggggtaaagaaaaatttgctttcttccccaaaagttgagaataaagtgatactgtttaacacgctaggaaaaaaaaaacaacaataaaacattttagaggggagcattcactgtcacataagctaaagcctagttaagtttttttaaataaccacatttcaatagctttctccatattttaactattatcttactaaatatcaagtcttcttggcactgtcacaagcaaagtataagcctaactcattaagtaaaaccacttttataataactttttaacatacttacttatctctgtctgttttatagatccgtgcaatctctggcactagggggtcatctgggtttggatcacatagcagtgaacaaatggataaaagaactgcaagaaaacaaaaacatctgttacccagtttcaggagtttggataaataaatttttctaaaccgtgtattacaaaactcaatcctcaaaagacttttattagtttgtatctttatctcaatgagacacagttttacagagattttgtttcacagaagacaagctcctggtaagtaagaagtgctaaaaacagggttttgtggcatgaaattcactgcagactagccataaaaatagtttctaagataggcaactgatgccatattaatatatatattttaaataggcataaatgatattagaacttgagtttcttggtactctgtggctgggggggggggactttagcaagaatatgcaggtaacactcatgccatattcatagccattaggcatgacgaaaaatccattcttagccgctgtcttggcaatttctgagaaaaaccctcaagtgctccactaaatgtctccttgaacttgtaagcaagaaaccatattcccaagagtactagttaaatacaatgccaaaatctctttagtactaagtgagtcatcagctctagttcttaccttaaccagctcaacatactgatgcataagatgtcaagcattaaagaacatagatcgcattcacctttgagtgccggtatgtgccagcaacatatatgtggggtgctgtattaaaatgttaagatataaatgctctgaaaggttctgaccggttttttttaaaaaaagcaatagtataaaaaagcacccttgtcacatatttattgactacagcaaatttaatttccaaaccccaaatacagcagaatataaaattacctaatataggagacttggctatacaataactcacagaaaaaaggtagcttcagttgtgactgctagtttaataagttagcaaagtatggctgccaaaaaagtaagttgctttaacgacaaaacaataccaattcaatctgcccttacaaaaacagttttcagtgttactgtacactcccagcagtagtagaaaaacttggaaactgatatttaggtatgtagcatgatttgaaaagaaattagaaagcatccaagaaggtgaaaaacaggtgtaaaattttaaaaacactcgaattatggcagcatctgcctaagttgtttctttttctcccttaagtgattctactcaataaagtttgggaaatgctactgctacagtctctctccatgagattcaagtgcagtatatacacatatgaaacttttatacaatgccttgccttttgaaaaagcttttttgtacttactgaactcataaaatcaaaaaacaattaatggtgaaatagtgttaattattacaacttcacctgggatattcatgcggagaccggaaaacttgttacatataacgtaacagatgcctattaagagaccagaattgatctacagatctttcgaagattatataattttagactgtcattaggtagaaacaacctatcatggttacataaaacatgactgaagatttgtctaaaaattaacccaggaaagcaaaatcagaattttcctagagtggaaacctcagaattcaaaagctctattaagtttaggtatatcataccattcttggtaaaaaggccgcaagttagtgtgagatgtccaagtggtttgggattgaaaaatacagaagtctattaaaataaattttgctattataagatgagatgaaggtaactcattaggcaaataatgcctactcaccacaatttgaattttaacaacttctcacaaagtatctttaatcaacaccactaaaagaacaaaaattataaaaataactttattgcttccccatctcttaccaaaaagctgccataataaaaatactcagataagtagatctaagaatgaagctttattagacaatgagaacagcttatttcactagaaatatttacctttagaaattgttaaagcaggcgaccactgtgatcttagaatatcgagacaaatgctgccattactgttaatatttggatgataaattcttgttgtaaatgcaacctaaaacaaaaacttttaagtattttattcaaataaaaacaaacatcttttaaagcaaaacttaaaataatcaagccacaatgttaaaaatgtcatctattagcatagaagttctaaatattatagaaactgatttttacaatctgaccacaaccccctgcctcctctttttacaacagaaacctaaacttttggataaaaatttcattactcatatgatgtaaagttctaaaggttactgtggccctaccatatcatgaatcaaagggcaatttaaaggtatttaacacattcatttataaaagccctaacttttggatgtaaccaaaatttgtagaccatctcatttaaagtttcattaagttacacaggtacacctgagtctgcatttccaccgtacataaaacataaacttgaatcacaaaaatggaaaccatcacattgcacctataacattactagagattgttatagtgacatgtttatgacctttgtatattaccttttctagttattcatacaggttgaatttatgttaatgactgaaaagtgaaggataatatgcttttaatacctataaaccagtgcactaagcaactctaagttttcacaaatttacacttacgtatacaaaactataagcataataagcatatgctgtaacaatacgtgcaaatataaattgaagttggacatttgatgcttacaagacaacaaaagcccaaaaatcagaatctgtgtaacaataatacagatgagggcggaagcttccacatggtctgaatcttgcaacattaaagaaaaggcaaaccttattcctatttacaaagctcaaactgaggtctagctctttaaaccaaaggttaagagtcagcatctatacatgagtgcaattcaacatatatatacagcctacacagaaccctatcttccaagaatgctctattcctttgaaataaagcataaatctatactaacagattttgagggaaaatacttgccttaggtggtttgaaggggtagtctgtaggaaaatgaattgtcaaaaagaatacaccgccttgatatgggctgtcattctgtaaaaagaaaagtatgcttaactcaaatttaaaatattattgctaaatattccgtaacatttgtttccaagcatttctctaataatgaacccaaatcacctatttacactgcaataaataatctattccatgaaaattcagtctatagtaatagaaaaaaacttaaaacttatacagtaataaaccctaatttacctagtcattttacacgtcaccaaaatgtttttttaaaaagttatccagaaacgcaagtattctagatctcaattctcaaaagtacaacacagcaataaagcctacataatcatgtttcagaataatctgtaaacaaaattttacacatgtagattatttcttccaatagccagatgtgtacaaatggcttcacaacagtccattctgcccactggcaaaccaaatgttagctattccaggtaacacacacacaccaccttcaagaggagaacagagaaaagcctaagcttctcattttaatcaataccagaaaatacatgcattgcccctattttatgcatgagaaaaatgaggcttaaagaacttagtctagtgtacaaatggtaaatgatagaaccaagattcaaacacaagtcttttgaagaccacttaatgatcaaagatactgacctactcaggaatttaaagttaaaatgtggaatgcctaactgcttctgggtatgcaaagaaccaatccgaagacatgttttacaacttacatgaactgggtttttaccaacactgactcccctctattagaaaggctttgtatatacagctatatatgagcctttcactatgcccattctggatgtcaggcacataaaaaacaggcctgacactaacacagctcatctaattcctacccttctgtaaaataaataaacattaattcaattaatctaaccccttgctatatactgtatgtgtgttaagggatccaaagaacaattttttttatcttgatgagcttacactgatagacatgtaaagtaactgcaatgaaatgttataggtatcatgaaatatgaacaagggacacgagttcaaagaagaaaggtcaatttattaatgaagaatcaggttcaaagaaatatacaactagtaaatggaagagcttttatttatttgagacggagtctcactctgtcgctcaggcttaagcgcagtggcacgatctcagctcactgcgacctctgcctcctgggttcaagcaactctcctgcctcagcctcccaagtagctgggattacacatatgcaccaccacacccagctaatttttgtatttttagtagagactgagtttcaccatgttggccaggctagtcttgcggcctcctgaccttgtgatccacccatctcggcctcccaaaatgtgctgattataggtgtgagctactgtacccagccagagcttatttaaagtgagtccttctccatctcccaagtcttccccctttttttttgtaggggtggagggcggggggaatgggaacgggaagggggacaaacaagacgtagaatatcatcttgctgtttgttgcccaagctcgagtaaaatggtgcaacctcagctcactgcaagcgccgcctccccaggttcaagagattctcctgcttcagctgcctcagtagcttggattacaggtgtgcaccaacgtgcccagctaattttttatttttagtagagatggggcttcaccatgttggctgaactcttaactcctgaccccaggtgatccgcctgcctcagcctcccaaagtgctgggattacaggtatcagccaccgtgcccagtcctttttcatattttctacaaaatatggaactagaaaaacactcaggtcacttagaatgtgacctgagtttattagattaacatgtctttattaaatagttatattaattttgaatagatgcttcaaatagcatatactttcacctgatccaatactatacaagatatgttttttctgtgtaaaattaacaatttaaaggtaatcccaaacactaaagttgtttttgttttttttgagacagggtcttgctctgtcgcccagactggagtgcagtggcacaatcttggctcactgcaaccctctgcctcctgggatcaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataacctaattccagaagttctttgtaagctttcatttcaattttcataaaatcaaatgctgtctatgactgcttctgaataaaggcaatctgctgatgggatttaggcaaagccaaatttcgtttcgtttgttcgaaaaaagaactttataaagaaggcaaaatatttcaatgttacaatttaacactaaagttctgccatgccaaaagaggaagaactacgaggttcagagataatgaaactaggcaatataaaaaattgagaccctatgatatttaaattctattatgaatcagcagcaaactacaccaaaaagaaacaaaatccccaaagaataaggaacactgtgatcagcaaatcgactcaaatcgtacaagtccagaatttatgttagattttttcagaaaccttctacttcttttgctctcatcagtgcaaagttgctccctcacagtgcctcagctcttctgtggcaataaaacgttggtattcttttttttttttttttaaagtggtgctgtcgcccaggctggagtgcagtggtgtgatctcggctcactgcaacctccacctcccaggttcaagtaaattctcgggcctcagcctccaaagcagctggaattacaggcatgtgccactacacccagctaaaaatgctggtattcttataggttgattttctactcttaactgctgacccataaaaatttgagttgcaaaatatatctctggtcagttattcattccagggcatatattcaaatgcctactgatatttctacttggatatctctacttggatatctcatgtcatgcgtccaaaactgaaacttgtctcaatcccttttttcctgttttttaatagcaagccataactgaaagccataaaccaggatctcatcatcaacttcttcctctcttatctcagaatcaagatagttatcaagtaagatctttaaaatttcttgaattagcttctcctttatgcccactgtcactaccatcttagttcatgatgttatcttcagcctagattatggcaatagcttactaatgattatccctccatcctaatgataaagtggtcttttaaaaatgttactcccctgcttgaaatctatgatagtttttaagataattccaactcctaagtacatacggtgctttatgatctgggtgcccatctagtttcatcttctgtctcttctatagaacatgttctctactgcacataaaatattatatggataacatatctttttctcttccctacttggaatattcttccttataatatagcccttcctttgtcttatctgctccctacccttcttttatacctctttaagcacatagttaccattatccacccatatatctaacatttacttatatttctcttttattagactacaaagctcctcaacgagtaaggttaaaggtggaaaaagtcttcaggtatcagtaacctacgtgggaaatgacataataatacacttgaaaaaaaagttgaaaaaataatccttatggaccaaataaaatagtacctatggaccaattattttaattcagatagtttttctggttgactatgctcaggctgccaaaggttacatttttcagatactttcacatttttcacaggtactctcttctacatctctgtcatagattaggtgggagttagtgttgttctctaaatccactttttctggatttccaataaaaaaaaatttaagcaagtaaatatcagaggcaataggtaaggaagtcaatttcttctaattacatcaattcttgttggaaactaaccttaatacagtaccccacgcccccctccccaaaaaaaaccacgcacacaaaaaactagcaatgctgtcatttctttcgaaggtttagtttttagtcaatagttgtgcttccgaagtagcttaccttcagaaagaataagccagtacatatgattattaaagccaagcaattttgctgcataactaatgatctaaaggatttcccaacaactcactaaaatcaaagttactctattgaaactcaaaattagatggtatattccctacagtcaggaatcttcagttctgtggcactggcaccactttaagggacctaagtagtagtccaaagcaaaagtgacgttgttaactgtccagttctcccactaaatctgtaatttatgggttgctttaggtcacaactgcttgctacatagagcaaccatactcacaaaataagctactatttatcttatacagtgatgctttgtcacaaagaagtattgagaagccaaaagaacaaaatgagttgtttcattggtgcactccacagtaagcatatagttaactatttaaagctggcatctaaattatgtgcttacttatgtacaagacaatacccgtactttgggtggatttttataatctttgactccttcttgaaatttacccaaccaacagtgagaactaacctttttaactgaaaacatatttcagtgagtactgctaccaaagcaaaacccagcagttgtggttaatcaggttaatatttaaatggttctgaaaatcacatgcttctgtttgtaaaagcagaaaactgctagtcattatattaaaaggttgctgaaaaagttcagcaaggaatagccatcacctgaaatatatatttaaaaaatgaaaaaaggtaaatgttttctcaaaataacagcaaattaagtaaactgctaaaaaatctgtcagaataagcaacaccattctctaaaaaaattactaccatacactcatcattcatgtttccttttgattgtctataggtatgttccttgccttttgggaaaaactagtgtgttgttcaaaataacaaagtctaaactgtcaagcagaaaaaccaactagttttaaagagttagtttattctgcacaccatccaattagaagttttaattaccaacgcttctgtgctttcttagtattgacaatttttataatgaaactatcaactaccctctgaatcaaagatgagctttattttaaggcattttatagcattctttgaaaactggtaatccaaaatgggaaaattctagaggttgcaaaagcaactgctttacaaaacactaggcagataatatggaattgacctagtaggcactgtggtaaacacatatcccatctaaaaaagggaggcagctgtcattccatcccaagccattactgcttatggaatgtgggcctactcagaaggcttttatttgaagactgccaactttcaaaaatatcgtgtgggccaaactgggtaactcaacatttaactgcgtgtattaaaattaaacaatattgctaccaaattagataaaagtaagtacttttaataactacaaagccaggattgtgcatttcgttattacaggactatttttactgttttaaatgttactttgttttaaaatgatccaggacgtttcaaagtattaaacttaatatttgcacccctgccatgtcttactttgatttagtttttctacctttagggcactaacattttaattactctaaattaatcctccctgctacaatttcccattaatttatcctactcagcacttcattcaccaatcacttattttccatcttgtcacacttcagcacttgttttaggtatctgtctcctctaatacagtgtaagttccctataagatcgacagggatgtttattatgttcaatttgtatccttattacctggcacacagtatgtactcacatttgagacagaaaaatgactaaagttagaatcagaattactaaataaatacttgttgattcgactcatctactaactctaagagcattttttcctttagaattctaaatattacttactgaccattatctcacctagtacattattgctctttatgttgcttataaaaccaccaaaaagggaagacagttttcaggaagatacacatgtaacttagaaaacaaatccttaagcgccttagcaagttaaaaaaaaaaaaaaaagttaaatatttgtgtaagatacagtcttaccccaggatgttttagtgcgctctaattctctgaaattcttagatggtatccataattctgaatattcaattatccagcatatagttgcttatctacccaggatagaaaggaattttgctatattcaaaatatcactttctgcctaaatatattcaaattttgcataaactgaagttctataaagaatcaaatatcaaaatacaattaagctagattattggcagctgcagtaacagaataagatctctgagtaacacaacgcatggcagatcagagccagtaactttgtctctataaataacaggaagttccatgacaatgctttacacagtgctatgtagaaaaactgaactgagatacagagatgtttggtaggtcatagagatggctatactctagaacgtgaacacagggatagacacaaagtacacgtaacaaatgactaactcattatgttttttctttcaaatgcagtacaactatggaatatccaaaatagaattaactatatgataaaataaacctacagaccaagttaaaaattacaaccaaatcaatgctggattttcacttaaaactaaatttaaaaattcttaatacttacaggtcccataattgtggcttgccaatgaaacactagaaaaagaaaaaaaactctggttatctaaaaatgcacaagcttaaaaaaaaattaggcataaaaatcaacttgcaagttacttactatcatccccaactggacctgcagaacattgtgctggagggtcacgggccaaatcactaagttcctacaccaagacagaaaatgggtgagtcacataagcttaatttaagaaaacaagcgagtccactgctttcagttactttcaccctatttttaaaggcacactccatcacaattcacataaataatatattccattaggagagagaacatgcctgaacatatgctgagacaatcatcttagctagagttcgtaaaaatatatatgcaaacacattgatacaaaattttttatttacataaaagccaatctcttacaaaccgaaatagctataattagatattctcatagtttaagagcttagaccagagagagctcaacattcacgttatttgttgaacttccaagaccactttcagaggccctcaactgtcttaaattctttgttcttcctgaaccatccttcctccccaatccactaactctattttctacctgaaaacaaaccaaaaaaactctcatggggctaagtaccttttttgttttctaatctccttattctctcaactcaaccttttttttttttttttttaaactcagcatccatttttaactattgaaatttttttttttttgagacggagtctccaggctgcagtgcagtggcgcaatctggggtcactgcaagctccacctcccaggttcacgccattctcctgcctcaggtgcccgccaccatgccaggctaattttttgtattttttagtagagacaggatttcactgcgttaaccaggatgggtctcgatctcctgacctcgtgattgaaattctgaccctgaagagcgtacttctgtaagtagaaagacgtttgctcttaacatatagtctgcacaattcaatatgaacgttttatttccaacaagtatgtagttcactgttccatgacttgtgcataacaatatgaattatctactatgaaaatatagtttattagaatatttttaagatggtacagctccatcttaccaatgatataaccaatgtctaataatcacaagttaaaaaaaaaagacaataaatagaaccaatgttaatacattactgccttcaacattttcaaactaacagtttctcttaagtttagtctatggcataagtcagtacacccattaagtctagggactactatatcttctatatcccctttctcatataaacatggaaataacacagaagggtaaggtttgggattccatttgaacagcagaagaccactaggtacgtggctcatgcctgtaatcctaacaccctgggaggcaaagacagggatcgcttgagcccaggagtttgactgagaccagcctgaacaacaaagggagacccccgtctcttcgaaaatgttagctaggcatggtggtgcatgcctggggtcctagctactcagaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacattggctcacgcccgtaatcccagcactttgggaggctgagaagggtggatcacctaaggtcaggagttcaagaccagtgctgctaacatggtaaaaccccatctctactaacatcacaaaaattagccacacatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaacccccagaaaagctgaacgtattcatatacaaaagaccaagtactagaaagcaaaagaaaggatgcctaaataaaaaagatacaacagagaagcagaggcgagaggacagcttgagcgcaggagttcgagaccagcttggataacatagtgagaccccattctccataaaaagaaaaaaaaattacgataaagccagtatcaactgtctaccacaatatcaatgcatccgtgtataactaaaaacattaatcttcttttggtctactagaacaacttattccctataactacaggaatttaaaaatggaaacagattttcaaagtgggtacatgcactttttttcctcaactgtgatcttttgccttcctgtgcaaaatcaaggacacaaaatgcagaactttcagtataagctctctcagaagggtgcagggaatgggaagaagagctacaaatcttaatttaacaaggcatagtggcatgtgcctgtagtcccagctactcggaaggctgaggcaggattaagcccaggtgtttcaggtttttgtgtgttaaatgatcatgctggtggagagccactgcactctagcttggacaacaatgtttaatgcctattttatactggcttcagatgattattttcattcactacatcaaatttaaacacagtgacaaatttatgtaagggtcccactatggcactgacttggttgggggaaataaatgagtcctctaaattttgttcattttgttaaatccaccggaaatctttaaaataggctctcaacaaactgaggggccagaacaaaaaacaacccagcttccaagtcttttagaaaattagaatcattgaatagatagcttgaaaaatcagataatgttgacatctttccctgcaaaactgaggaactgaacaaatcaaacaatgtatgcaccaacagtacacaagcctgtaactgtgctttaaatatttcaatttgtgggaaagctctttcaatggagctgctatttttattgggtaagtttgtattctgtagcagcatggaataaaattgaaatttcgagaaacactgaaaaagaaaagagactacataaagtgtttttgtcttattaaaaaagaattgagactttgtcccatttaacaggatttgctctaagcttttaagacaccttagctcccagagggcattttgccatttaaaaaattatagtattatagactacagtcaatgggggttattaatttaaaccttattaacctcaaaagtgctactttcaacaagattaagtaagactattagagatattagcaaaacagcactgagaaacagggctaggaaactagagtacacaaatcggactaagaataattgtactacctttaaaaatgttaagatgatcaacacaaagttttaactgctctaatagtatcttttttaaaaaatgaagttttgattaaagttgtttagttaaaagtccaccaatcctctccccttttaaaaaagtgatgggaatctcactatgttgcccaagccggactacagtggctattcacaggcggaatcacaatcataaggcactatagcccagaactcctgggctcaagggatcctcttgcgtcagcctcttaagcagctggagttgcaggtacgcatcactatgtacagcaatttgttgaacaataaatgtacatttttaattgtaaaattaaacaatgaattttgttgattgactccatgtgggaagaaaaggtgacgctaagatttttggcctgagcaaagcatgagattggcattaagtaaaatggtcaacttacaggtgaagcttgtgggcagatgtagagataaagtaagtaaaataggataatgtaagtaaagactcaattcgaaaagtatatatacaagttgagaacaggctgggaacaaatacaaagtatcattaataaacaaatgatgtttatagccattcaacttggtgagagcactcctggaacagaaggtcctaggagttaacactggactaatttaacgctaagaaagggaaccttggccagtaacctgaaaagttaaaaagaaataaagaatgtgaagaaaggctttgtcacaataaacaacactgcaggaaaattaagaggcaaatatttgcctcttatattcaaaatacacttcagaaaatggccagttgttcgggaatggtcagtctagattaatgccataaaacaaacaacaaaaatagagtagacaaggagaattgtcctgatatgctgtgccaattcactttggaaactcatcacaactacttacaaggttgccagagatcccaagattcacaattttaagactgtatatcacacaccctttatatgcttgtctgtatagatataccctcatgtcttccacatattcagaaatggaagaaaattcattccaaatactattgattctgatcagtgggaattacagaaattcatatcgcagttcaacaatctgtaaaagaaactacatggcttttggccttcaaaaaattgtaacagaaaatattaactgaaccaaatcagtatttcagaagcttttttttttttgcaacttaaattatccactattaagaaaatgactttttttttgagatggagtctccctctgtcatccaggctggagtgcagtggtgtgatcttggttcactgcaacctcctcctcccaggttcaagtgactctcctgcctcagcctcctgagtagctggaattacaggcacatgccaccacacctggctattcttttttttttttttttttgtagttttactagagatggggtttcaccatggccaggctgatctcgaaatcctgacctcaagtgatccgcctgcctcggcctcccaaagtgctaggaatacaggtgtgaaccactgcaccaggcctgcagtcttacttttaatcttacacaggcctactttttctcatggttctcttctcatctctgaaataggaatcactacctggcacataatggactggtacttaacaagcagaccatgtgtagaccacccatcctgaaccaagattcctgggcaaggctcttaattcatctgttactgaacaaaagcaaaactgctccacacatgggccacataatatagccacttgtttatttaaatttttgacctatgtgataaatcctgatgctcagttgtctaaaaatgtctttgtaagcatctgaatatacctaatactgaaataagagtttaaaaagctgacaacacaatccaagttttacatttatttactcataattaactcaataaacatactagattttacatttaatatatgttaaaatggctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagaagtgcgccaccacacccggctaattttttgtatttttagtagagacggggtttcaccatgttggccacactggtctcgaactcctgacctcaggtgatcaccttggcctcccaaagtgctgggattacaggcgtgagccaccgtgcctggccagaataaatattaagataaaatattttaattttaaaataaaaatcaatgtaatcatggttgttctaaacacaatacccaataatgttggaatacttcattataaataaaactaaaggtcagaaaactatgaagttgacctagaatataaacaccatactacttcaacattacacatttcaattacaaagaaagtaagaaagtatttcttatagaataaatgagttttcggcacactgatatttatccatcactaagcctttaaatgctagcattatcatccttttagagtgaaggtataatttcagctagttaacactgggtttcagctcttcactcctgtaatttcaggttcttgttactctcctaacatttctaaatgccttactttcgaagttctccatcaccaagacatctctttagtaataatcaaagagataaaatcagcccaatacacttacctactttaaattcaatatagaaaaatgacctaagtattttaacaatcaaaacaaaggtcttttttaaagatacaaatgctgttcttatttcaccattttctttcttgccatttaaatagtatctaatattactatttaaagtaccacttagtacccaatagtaacaaaaccatgcacaagcacttacctttgagctaccaaataatttttgtaacattatatgcccacagaatgagcaagacagtatcgtaggaaaaaaaagtgagaaaagagtaagtcatagcagatgctctttgtagctagcagacattttgtctactcaataaaccatcttactcatgaattccttttcccttactccaaatcatgtgactgtagtcctgggtcagccatcattaaccaattatttggacatgactaaccacagaattttgttccctcagctgggacccaactattagtccattgtccatcccaacctaagagtttccaaatcaaagggacattcttccttctataatcaagagctataagaatgtgacccatagctgttgacaggcacgtgtcatggacttacatggtaaagtcaaaagctaaagagaccatattcaacagcagcaataacaaagagctgactttccatacagatgtgcaattttggttcctgaggttgtagcttgctctggttcctacacctattccattcattgttaactatcccagtttccttctaataaatcccttatttaatctggattatattaaggagttaaaaaatatatacagcagtagtgagagaccaaatctgaataccaattatgtagattttatgccacttcaaacacaatttagtttttgagttttgctgaaaaacatgtaagaaatctaaatgaagctaagtcttaaaattgaattaggagtaacaaggttaactttcacactggaggttaatttaaatccatttctaaaatgaaaatgtaatgttaatttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaacaacaaggagtaagagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaactgtactcttataaccactttacggaaatagagctcatcttctctgttttacagttgagtcccttaagagaggggaaagaaatgattacattcaagcatagaacatgttcagctttaggataggtgaactaagtgtacctactaacaacttaaaaatttggactaggggtaagtttcaaaaaggttcctttctcaacagggtgtccttgcaaagataatttaatgtttggcaaactgagggaaaaaaattctcaactgcaccaaactattactcaatgctccagaatgaacacgatatggaaaactaatgttttccttagtatttatttccgcataaccatccaccgttagtctgtatctcattattcgtacgtagtgtgaatccagtactatttttcaagttacatggcctgagaaaatgattctatcccacagcaagaccatttactggactggaaatcaatttccaacgacacccatactcagcatttttaaaagtaattttgtctacgatagtcacctaacaaaatgtttttagagcctaaagtttcacaggcttcagggacaaaaacactaaaaaattacacaattgaaattttcagcttattccttcctagcagtctagaggaagaggaacagtgccaagaaccagaaggaacagctctcacacggcacctgtaaaatttttttatactgtgctgactacccctcacctaaggggaacagcattactcaactattaaggccactgaaacaggaaaatgtttggttggggacactgacttactttaggaattgctcaaggttccactcacgttgaagggacactaagatcaagcacatacaatcagggtacaacactaagaaactgtactagctataaaaagaacaaaaggttggacatttcttttccacagagtgctcttttaggaaactttctccttttagtgtcatcttcctctgagctgcttctcctcaaactttctgcacacttggctagtgtgagaatccagaccttctcactggaaaaaatacttgtatttaaaagccttaaaaaacctataggaaaagaagtcaaggagacccctctgccttctttctaagctaggtaaatgagaccctctcaaagctctcacatggtctagttcgcctcattagttaaaacactacaaagaaatttgagacagcaacagactttacacaactgagttgtttgcctatttcctgaagacctggtgggcaccatggtagaaaatagggcaggatttttttcaccaaaaaaatctctctaaaaggcaaccaacaggtacagcttaagccactggtgagtgttctcatctggaagtacatgatttaagcagtaatgggtttggtcactatttttttttttattctgaaacattccttacatgagatttttaatacaaagcctgcaaatggtttatcttgaggaagacctttactgtagtcactatgggatatgggatttaacagttgattgttggagatgttaaactatgctttctgcttctctattctctatcttcctcattcaatgataagtggtactagcagtggtgaccaaccacaggctacaaagaacagtaggccaaggtattgaaaacattaaagacctgaaaggatgctaggagaaacataagaatgtcccctcccttgctgggcgtggtggctcacgcttgtaatcctagcactttgggaagccaaggcaggcggatcacctgaggtcaggaattcaagaccagcctggccaacatcgtgaaatcccatctctactaaaatataaaaattagccgggcatgatggcgggtgcctgtaatcccagctactcgagaggctgagacaggagaattgcttgaacccaggagacggtggttgcagtaagccgcagttgcgccactgcactctagcctgggcagctgaccaagactccgcctcaaaaaaaaaaaaaaaaattccctcctttcaaagagcttataaattggaaatactaaaaatatttattcacaaatatttatgaatattatgaatattcatgaagctacagagcagccatgttccaggagcccaataagtatctgaacattcggttaactttctttcaatgacagccagtatctgttcatcagatcaacataaccaaaaggtagcatttatgaaaacaaggttttaagtgtcaaccctattaaagcgtaacgccataaataacttattctaggtttcatccccccaaggcttgtcaaaattcaaaagcctatatagtggcaaggccaagttcatggattctacctttaagacagtaaaattatcaccacgatgttccacaaatcatttgttatcccaatctctaccatctattttgcacgtcatcacacaaaggtcatacagaggacagaacgcagtagtatagatacatttcctctcagcactttccggaaaactaaaagcttatgccattactaaaggttaatttcttgtattctatttgagagtctatttctttcagaactaaagacaagatttacatgactcaaaagacaagatttgtatgactgtgaatcagcattataaaaacagcccttgcctcaaaaacctatactgagcaacacaaaacactgctttggggactggaagagatgataaaatgaggtgggaaacaaagggagtaagtgccttaagaaattttaagaatcatcctcaagaagactttacaaccaacctagaaaaatacaaaggtgcgaaccaacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggattaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcgattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaagatatttggtgaatgcattcatttttaattatgaaataacactgctatggtagcaagctcaagaccacaacatttccaagaatggagagttttatttcattaatttcaaaatactggttttggcaaggggaattaagtcattataataaaagacaaaccacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccctgtatctgtggttcttaatcagagaggagcttcagaatcacctagaaaattttcaaaattatgtgtttccagggaaaatgatttagtaagtctaagacccccatgcagctgtatttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaaaatttttttaaaaactccaaatgttctggaatataaatgtaattcatgtcacacccaacaatatataatattcagtaagctcttctatacgctaacagatacaagaaaactgctatttaaaaaaagaatgcaaaaaccaacctaggtttgagattttaatctgaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatctagtgacacagtagttcatcccagtgatggagcattcaactttttatttgtataaataacaaaaactagaatcaacactgcagatgagcatgatgaaagaaaagtatgcagtgtcagtaatgcatcctttttcaaattaaacaaatactgaggtcctattattatcagcatccttcagtcacaactatcctacacagaaagtgagctggctatcaacaagctttgaggaccatatatgaaacacatgcaagacagtttacccagcctatatactagttggggacaataaatatattttgttcactctaagacatcctaagcagttaactggcacatgttagttttcagtgcttgaagagactaccccaaaagaattaaatccacttctactttcaaaatattattagccaaaatcttaactcacaaattagctataacctaagagtaaagctaactcccaattacttagatgtataagtgggagagcaaagcagcttatttcaggtaacaaactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggcaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaaggatgatatcaaactgtagttgttaagagcacatactctggaccaggctgcctaggttctaatcccaactgtcacaacatgaacctgggtcatcttcttaacctctatgcctaagtttttcaatttcgagatggagataatcttgaaattatctcagtggaagtggtggtaggagggaaacgaagatcaaatgagagttttttaaccctttacccatggtttccctgctagccgcttgcttataatcatatataaacactaaagtcatacttccagaaataaaaacccttacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatacattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacagctgaaaaaccaaaccacatgcacacgtcaaagtttctgtaagttgaatcaataatgttcacataaacactggtttttccaatatgccaagtttttatgttgtgtctatattacataaatcttcaaaatatttacaaaaggagacaacctggttaactaagagtactaaactagaaatcaaagttcttaaacaaaaacggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttagccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatttcaaaataatttttactttaatccttaactcctaaaaagcgtttcttcctcttttctttcatttcacaaagatttaaatttgtatttcgcataacccaaaatgacgatgttatgaaggcccaaaacaaaattcacgatttcatatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaagaaataaaggaagggagacttgatgtgtattgctatcctcgcagcgagctattctgtgtcacccctgacgccaccgtacactcactccgccttccagcgcgctcccgcgcgcgcccgcccagccacctccaccacgcgcccgcgctgtccctgaggctccggcttaggcgcgaggacgcgcccattccccctcctcctccagcaggagaggccgcggcttccccaaccttcccaccctaacccaccgcacccaataggctggccgctcaagccgcccaggtcccgcactgcccctcttacccggccggccactgggccggcctcccttccctgccctagccgtccacacccacgcgtacagaggggccggggcctccctcaagctgcggcctcggcctcctccccgcgcggcagctggtgcctccccggccctacggggctcacgcgcacgacacagccacaagatgtccgctctgacggaactactgccagctgccacgctccgcccctccccctcctcctgcctcttcaccgccgcggatcagtccgccaacgccgccgtcccgagcacaggaccgatgtgaggccgaagccagacggcttgcttcccacgtccggggccgagtgaatacgtgtcaagcccttttccttctccttctcggaacagcaccttcttactaaacagatcggagattggaccaggagggcgggggagggaggaagatcatgagctggggggagggtgaacgagtggcggaaacccttaggctcagagaagcatcgagaaccggaaggagaccatgggaggaaggtaaaggaagcagccgctgcgcgatccagccccacgcccctccccacagcgtcccccagtttcctcacttggt

SEQ ID NO: 2076 - DNA, 31628 bp, Homo sapiens
atccaatagcattgacttttattcattcatgttaagtcacctgaaatgatatctgttgcatttaaatgctcattaatgtaaatggctgaacaaatccatttcaatggatactcaatatcccacatagataagtcacttcaacacagcctcatgacaactcccacaccaaaacagtactttattttgcaaattttgacccattattactcccatgttgttttttttcagctgtcaagtgtacaaggtgaagagaaatttcagttagacaggggctgcacctggaaaataaatttcttaaactccataaacacatttcaaaactgctgggtcccaaaagtccatctatgaactctagggctgccagtatcatgtgcagcacattaaagctacactatccaaatagcttattaattctgcataaatcaggtcaagcaatgtgtcaacctgtaacagactgtgcactttaactgaacatggcaaaatattcactctttcgaactttacatcatcatttgatgtcaaacaatgaagcaaatcccaacagtatatacaaaaaacagctttgcatttacaaaagattgtttcccatactgattaatccaggcagctaactcattggtttatgcaactttattgaagaaaaataaatcaattactagcagagctattagttgatcactcatccattgacaacttgcatcatttattcagtgctatattaaacagtgtattggaagatagattaactaatagctccaagcctcctaacaatttaaatgaaaattacaaaatgtttgagaccctattttggaatacaaagggtgtttgacttccaatttccattctctgtagaacaagaacaggtcattcctttattgacatgcataaaatacatcacattttctgttctgctgatgctataaattcaataccaattctccagccacatcagttatgagcataaagcatatcatgtaacctcaaatctctaacagtggaaggcttaaacaagaatggatgctgctagaataatgctgtatcctttgatgtgacaactgagcatccatctccctccccctcagatgatttcttcagcatgttagagcagtgaggaatggttttagtctcataaccaagttagagtgaagacattggccacataatacacatgctccatttttttttttaaaaattctgagtcttgggcaactgttctcttgtaactactttacagtttctaaaagcagttattgtccaaagctggaagaacttaagtcttctcagatgagcatgtgaatgaatggagggaggtaaacaaaaaataaaattaaaaaagatgaggtctgataggggagcagccggataagaaaatcaaaaaaggaacagtaatttaaagtttattccagctataatgcaggttattctgactttaaggtagcatcacatggcatacttctgagtccattcccgagatattctgttgtacctgtaaataaagatgttatttttaaaagttaaaataaagaattcctaatactttaaatggaagggaaagatttccattttatcatctccagactcatcatgaagtcatctctaatgactatgattagaataaaagccaacaagggagaaatagcactggtactcaaagcaatgtgggaaatgagagcctgatgctctgaaagtagtattttaaaaacaactaagaaagcagcactgaaaattgggaggctaacaaaaatcaaaagaccctttctttctctaccaccgagctcatgctctaattttaacgtgaagaaatttttacagttcattatggacaaatgttaaaatagtatacacattctatctatccacagaaatttccaccaaggccagaactaggcttttactagaacaattttatctgaatcctagagtttgggaaattacttggtcctggatattacaagaaaaaatggctttgggacttaggtagaggcagaaggggaagatgacactgggcagaatgacaaagggcagtaattttcaaaaggggtgtgtgtgtgagtggttgtgttcatcagaatcacgtgttacttttaataagtgtggtaactgaggctaataagcaccactgagacctgttgagtacaacaagggcatcttcgtttaaaaagatcaacaggtaattcacacacaagcaaggttattactcaggaagactactaacattgataaatactatcagcttccccctggattatactcatgccatagactacttacaacaacaaaaaacagtgataaccttaagaaaggaatatatatatatatatatatatatatatatatatatatatatatatgcacaggagaatttttatattgtttaaatattaactagctttatttcaaaccaagaaccaaatatggtccaacaacttttctaaactttttaaaaagttctttctaccaattcattgtcatctcctaaggatactctctcaaaaagccagcactttaaaacaaaggctttatttagcatacagggagccacaaagtacagctgacgctaatgcatgcttgtcagtaatgaacatttagtttagatgcttaggcttaaaagtgtttttcccttacattactatctcctggcaaaatttgaactaaaccaccacattctgtataggattggtacaaagtctcaagctaaaatttaaacaccatgatagtttgaaaaaaaaaaaagatactacataaattcccatttcttactagtgctattgtaactgctttgccatgcaatactttcaagcagtaacggctaccagatatttactttcacgttaaacagagaccaagcagttaaatgtacagttttcagaagactgccatatttgttaccttttgttagttaatacagtgccttaacgcatgcagcactcaagtgctggcagtaccataataagcgcaccatagagtgcagatcctcttaccctacaacatagcgtatttctctgtccactctcttgctaacctattgtacctaattgaacaagtacacttagcattaattataacatatgaaagttataatggttaagttgaacataaatataattcaaatatttgagaaatttagaccaaatttttacaatagtactaacatttttggaaaaacatgcttggggtaaagaaaaatttgctttcttccccaaaagttgagaataaagtgatactgtttaacacgctaggaaaaaaaaaacaacaataaaacattttagaggggagcattcactgtcacataagctaaagcctagttaagtttttttaaataaccacatttcaatagctttctccatattttaactattatcttactaaatatcaagtcttcttggcactgtcacaagcaaagtataagcctaactcattaagtaaaaccacttttataataactttttaacatacttacttatctctgtctgttttatagatccgtgcaatctctggcactagggggtcatctgggtttggatcacatagcagtgaacaaatggataaaagaactgcaagaaaacaaaaacatctgttacccagtttcaggagtttggataaataaatttttctaaaccgtgtattacaaaactcaatcctcaaaagacttttattagtttgtatctttatctcaatgagacacagttttacagagattttgtttcacagaagacaagctcctggtaagtaagaagtgctaaaaacagggttttgtggcatgaaattcactgcagactagccataaaaatagtttctaagataggcaactgatgccatattaatatatatattttaaataggcataaatgatattagaacttgagtttcttggtactctgtggctgggggggggggactttagcaagaatatgcaggtaacactcatgccatattcatagccattaggcatgacgaaaaatccattcttagccgctgtcttggcaatttctgagaaaaaccctcaagtgctccactaaatgtctccttgaacttgtaagcaagaaaccatattcccaagagtactagttaaatacaatgccaaaatctctttagtactaagtgagtcatcagctctagttcttaccttaaccagctcaacatactgatgcataagatgtcaagcattaaagaacatagatcgcattcacctttgagtgccggtatgtgccagcaacatatatgtggggtgctgtattaaaatgttaagatataaatgctctgaaaggttctgaccggttttttttaaaaaaagcaatagtataaaaaagcacccttgtcacatatttattgactacagcaaatttaatttccaaaccccaaatacagcagaatataaaattacctaatataggagacttggctatacaataactcacagaaaaaaggtagcttcagttgtgactgctagtttaataagttagcaaagtatggctgccaaaaaagtaagttgctttaacgacaaaacaataccaattcaatctgcccttacaaaaacagttttcagtgttactgtacactcccagcagtagtagaaaaacttggaaactgatatttaggtatgtagcatgatttgaaaagaaattagaaagcatccaagaaggtgaaaaacaggtgtaaaattttaaaaacactcgaattatggcagcatctgcctaagttgtttctttttctcccttaagtgattctactcaataaagtttgggaaatgctactgctacagtctctctccatgagattcaagtgcagtatatacacatatgaaacttttatacaatgccttgccttttgaaaaagcttttttgtacttactgaactcataaaatcaaaaaacaattaatggtgaaatagtgttaattattacaacttcacctgggatattcatgcggagaccggaaaacttgttacatataacgtaacagatgcctattaagagaccagaattgatctacagatctttcgaagattatataattttagactgtcattaggtagaaacaacctatcatggttacataaaacatgactgaagatttgtctaaaaattaacccaggaaagcaaaatcagaattttcctagagtggaaacctcagaattcaaaagctctattaagtttaggtatatcataccattcttggtaaaaaggccgcaagttagtgtgagatgtccaagtggtttgggattgaaaaatacagaagtctattaaaataaattttgctattataagatgagatgaaggtaactcattaggcaaataatgcctactcaccacaatttgaattttaacaacttctcacaaagtatctttaatcaacaccactaaaagaacaaaaattataaaaataactttattgcttccccatctcttaccaaaaagctgccataataaaaatactcagataagtagatctaagaatgaagctttattagacaatgagaacagcttatttcactagaaatatttacctttagaaattgttaaagcaggcgaccactgtgatcttagaatatcgagacaaatgctgccattactgttaatatttggatgataaattcttgttgtaaatgcaacctaaaacaaaaacttttaagtattttattcaaataaaaacaaacatcttttaaagcaaaacttaaaataatcaagccacaatgttaaaaatgtcatctattagcatagaagttctaaatattatagaaactgatttttacaatctgaccacaaccccctgcctcctctttttacaacagaaacctaaacttttggataaaaatttcattactcatatgatgtaaagttctaaaggttactgtggccctaccatatcatgaatcaaagggcaatttaaaggtatttaacacattcatttataaaagccctaacttttggatgtaaccaaaatttgtagaccatctcatttaaagtttcattaagttacacaggtacacctgagtctgcatttccaccgtacataaaacataaacttgaatcacaaaaatggaaaccatcacattgcacctataacattactagagattgttatagtgacatgtttatgacctttgtatattaccttttctagttattcatacaggttgaatttatgttaatgactgaaaagtgaaggataatatgcttttaatacctataaaccagtgcactaagcaactctaagttttcacaaatttacacttacgtatacaaaactataagcataataagcatatgctgtaacaatacgtgcaaatataaattgaagttggacatttgatgcttacaagacaacaaaagcccaaaaatcagaatctgtgtaacaataatacagatgagggcggaagcttccacatggtctgaatcttgcaacattaaagaaaaggcaaaccttattcctatttacaaagctcaaactgaggtctagctctttaaaccaaaggttaagagtcagcatctatacatgagtgcaattcaacatatatatacagcctacacagaaccctatcttccaagaatgctctattcctttgaaataaagcataaatctatactaacagattttgagggaaaatacttgccttaggtggtttgaaggggtagtctgtaggaaaatgaattgtcaaaaagaatacaccgccttgatatgggctgtcattctgtaaaaagaaaagtatgcttaactcaaatttaaaatattattgctaaatattccgtaacatttgtttccaagcatttctctaataatgaacccaaatcacctatttacactgcaataaataatctattccatgaaaattcagtctatagtaatagaaaaaaacttaaaacttatacagtaataaaccctaatttacctagtcattttacacgtcaccaaaatgtttttttaaaaagttatccagaaacgcaagtattctagatctcaattctcaaaagtacaacacagcaataaagcctacataatcatgtttcagaataatctgtaaacaaaattttacacatgtagattatttcttccaatagccagatgtgtacaaatggcttcacaacagtccattctgcccactggcaaaccaaatgttagctattccaggtaacacacacacaccaccttcaagaggagaacagagaaaagcctaagcttctcattttaatcaataccagaaaatacatgcattgcccctattttatgcatgagaaaaatgaggcttaaagaacttagtctagtgtacaaatggtaaatgatagaaccaagattcaaacacaagtcttttgaagaccacttaatgatcaaagatactgacctactcaggaatttaaagttaaaatgtggaatgcctaactgcttctgggtatgcaaagaaccaatccgaagacatgttttacaacttacatgaactgggtttttaccaacactgactcccctctattagaaaggctttgtatatacagctatatatgagcctttcactatgcccattctggatgtcaggcacataaaaaacaggcctgacactaacacagctcatctaattcctacccttctgtaaaataaataaacattaattcaattaatctaaccccttgctatatactgtatgtgtgttaagggatccaaagaacaattttttttatcttgatgagcttacactgatagacatgtaaagtaactgcaatgaaatgttataggtatcatgaaatatgaacaagggacacgagttcaaagaagaaaggtcaatttattaatgaagaatcaggttcaaagaaatatacaactagtaaatggaagagcttttatttatttgagacggagtctcactctgtcgctcaggcttaagcgcagtggcacgatctcagctcactgcgacctctgcctcctgggttcaagcaactctcctgcctcagcctcccaagtagctgggattacacatatgcaccaccacacccagctaatttttgtatttttagtagagactgagtttcaccatgttggccaggctagtcttgcggcctcctgaccttgtgatccacccatctcggcctcccaaaatgtgctgattataggtgtgagctactgtacccagccagagcttatttaaagtgagtccttctccatctcccaagtcttccccctttttttttgtaggggtggagggcggggggaatgggaacgggaagggggacaaacaagacgtagaatatcatcttgctgtttgttgcccaagctcgagtaaaatggtgcaacctcagctcactgcaagcgccgcctccccaggttcaagagattctcctgcttcagctgcctcagtagcttggattacaggtgtgcaccaacgtgcccagctaattttttatttttagtagagatggggcttcaccatgttggctgaactcttaactcctgaccccaggtgatccgcctgcctcagcctcccaaagtgctgggattacaggtatcagccaccgtgcccagtcctttttcatattttctacaaaatatggaactagaaaaacactcaggtcacttagaatgtgacctgagtttattagattaacatgtctttattaaatagttatattaattttgaatagatgcttcaaatagcatatactttcacctgatccaatactatacaagatatgttttttctgtgtaaaattaacaatttaaaggtaatcccaaacactaaagttgtttttgttttttttgagacagggtcttgctctgtcgcccagactggagtgcagtggcacaatcttggctcactgcaaccctctgcctcctgggatcaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataacctaattccagaagttctttgtaagctttcatttcaattttcataaaatcaaatgctgtctatgactgcttctgaataaaggcaatctgctgatgggatttaggcaaagccaaatttcgtttcgtttgttcgaaaaaagaactttataaagaaggcaaaatatttcaatgttacaatttaacactaaagttctgccatgccaaaagaggaagaactacgaggttcagagataatgaaactaggcaatataaaaaattgagaccctatgatatttaaattctattatgaatcagcagcaaactacaccaaaaagaaacaaaatccccaaagaataaggaacactgtgatcagcaaatcgactcaaatcgtacaagtccagaatttatgttagattttttcagaaaccttctacttcttttgctctcatcagtgcaaagttgctccctcacagtgcctcagctcttctgtggcaataaaacgttggtattcttttttttttttttttaaagtggtgctgtcgcccaggctggagtgcagtggtgtgatctcggctcactgcaacctccacctcccaggttcaagtaaattctcgggcctcagcctccaaagcagctggaattacaggcatgtgccactacacccagctaaaaatgctggtattcttataggttgattttctactcttaactgctgacccataaaaatttgagttgcaaaatatatctctggtcagttattcattccagggcatatattcaaatgcctactgatatttctacttggatatctctacttggatatctcatgtcatgcgtccaaaactgaaacttgtctcaatcccttttttcctgttttttaatagcaagccataactgaaagccataaaccaggatctcatcatcaacttcttcctctcttatctcagaatcaagatagttatcaagtaagatctttaaaatttcttgaattagcttctcctttatgcccactgtcactaccatcttagttcatgatgttatcttcagcctagattatggcaatagcttactaatgattatccctccatcctaatgataaagtggtcttttaaaaatgttactcccctgcttgaaatctatgatagtttttaagataattccaactcctaagtacatacggtgctttatgatctgggtgcccatctagtttcatcttctgtctcttctatagaacatgttctctactgcacataaaatattatatggataacatatctttttctcttccctacttggaatattcttccttataatatagcccttcctttgtcttatctgctccctacccttcttttatacctctttaagcacatagttaccattatccacccatatatctaacatttacttatatttctcttttattagactacaaagctcctcaacgagtaaggttaaaggtggaaaaagtcttcaggtatcagtaacctacgtgggaaatgacataataatacacttgaaaaaaaagttgaaaaaataatccttatggaccaaataaaatagtacctatggaccaattattttaattcagatagtttttctggttgactatgctcaggctgccaaaggttacatttttcagatactttcacatttttcacaggtactctcttctacatctctgtcatagattaggtgggagttagtgttgttctctaaatccactttttctggatttccaataaaaaaaaatttaagcaagtaaatatcagaggcaataggtaaggaagtcaatttcttctaattacatcaattcttgttggaaactaaccttaatacagtaccccacgcccccctccccaaaaaaaaccacgcacacaaaaaactagcaatgctgtcatttctttcgaaggtttagtttttagtcaatagttgtgcttccgaagtagcttaccttcagaaagaataagccagtacatatgattattaaagccaagcaattttgctgcataactaatgatctaaaggatttcccaacaactcactaaaatcaaagttactctattgaaactcaaaattagatggtatattccctacagtcaggaatcttcagttctgtggcactggcaccactttaagggacctaagtagtagtccaaagcaaaagtgacgttgttaactgtccagttctcccactaaatctgtaatttatgggttgctttaggtcacaactgcttgctacatagagcaaccatactcacaaaataagctactatttatcttatacagtgatgctttgtcacaaagaagtattgagaagccaaaagaacaaaatgagttgtttcattggtgcactccacagtaagcatatagttaactatttaaagctggcatctaaattatgtgcttacttatgtacaagacaatacccgtactttgggtggatttttataatctttgactccttcttgaaatttacccaaccaacagtgagaactaacctttttaactgaaaacatatttcagtgagtactgctaccaaagcaaaacccagcagttgtggttaatcaggttaatatttaaatggttctgaaaatcacatgcttctgtttgtaaaagcagaaaactgctagtcattatattaaaaggttgctgaaaaagttcagcaaggaatagccatcacctgaaatatatatttaaaaaatgaaaaaaggtaaatgttttctcaaaataacagcaaattaagtaaactgctaaaaaatctgtcagaataagcaacaccattctctaaaaaaattactaccatacactcatcattcatgtttccttttgattgtctataggtatgttccttgccttttgggaaaaactagtgtgttgttcaaaataacaaagtctaaactgtcaagcagaaaaaccaactagttttaaagagttagtttattctgcacaccatccaattagaagttttaattaccaacgcttctgtgctttcttagtattgacaatttttataatgaaactatcaactaccctctgaatcaaagatgagctttattttaaggcattttatagcattctttgaaaactggtaatccaaaatgggaaaattctagaggttgcaaaagcaactgctttacaaaacactaggcagataatatggaattgacctagtaggcactgtggtaaacacatatcccatctaaaaaagggaggcagctgtcattccatcccaagccattactgcttatggaatgtgggcctactcagaaggcttttatttgaagactgccaactttcaaaaatatcgtgtgggccaaactgggtaactcaacatttaactgcgtgtattaaaattaaacaatattgctaccaaattagataaaagtaagtacttttaataactacaaagccaggattgtgcatttcgttattacaggactatttttactgttttaaatgttactttgttttaaaatgatccaggacgtttcaaagtattaaacttaatatttgcacccctgccatgtcttactttgatttagtttttctacctttagggcactaacattttaattactctaaattaatcctccctgctacaatttcccattaatttatcctactcagcacttcattcaccaatcacttattttccatcttgtcacacttcagcacttgttttaggtatctgtctcctctaatacagtgtaagttccctataagatcgacagggatgtttattatgttcaatttgtatccttattacctggcacacagtatgtactcacatttgagacagaaaaatgactaaagttagaatcagaattactaaataaatacttgttgattcgactcatctactaactctaagagcattttttcctttagaattctaaatattacttactgaccattatctcacctagtacattattgctctttatgttgcttataaaaccaccaaaaagggaagacagttttcaggaagatacacatgtaacttagaaaacaaatccttaagcgccttagcaagttaaaaaaaaaaaaaaaagttaaatatttgtgtaagatacagtcttaccccaggatgttttagtgcgctctaattctctgaaattcttagatggtatccataattctgaatattcaattatccagcatatagttgcttatctacccaggatagaaaggaattttgctatattcaaaatatcactttctgcctaaatatattcaaattttgcataaactgaagttctataaagaatcaaatatcaaaatacaattaagctagattattggcagctgcagtaacagaataagatctctgagtaacacaacgcatggcagatcagagccagtaactttgtctctataaataacaggaagttccatgacaatgctttacacagtgctatgtagaaaaactgaactgagatacagagatgtttggtaggtcatagagatggctatactctagaacgtgaacacagggatagacacaaagtacacgtaacaaatgactaactcattatgttttttctttcaaatgcagtacaactatggaatatccaaaatagaattaactatatgataaaataaacctacagaccaagttaaaaattacaaccaaatcaatgctggattttcacttaaaactaaatttaaaaattcttaatacttacaggtcccataattgtggcttgccaatgaaacactagaaaaagaaaaaaaactctggttatctaaaaatgcacaagcttaaaaaaaaattaggcataaaaatcaacttgcaagttacttactatcatccccaactggacctgcagaacattgtgctggagggtcacgggccaaatcactaagttcctacaccaagacagaaaatgggtgagtcacataagcttaatttaagaaaacaagcgagtccactgctttcagttactttcaccctatttttaaaggcacactccatcacaattcacataaataatatattccattaggagagagaacatgcctgaacatatgctgagacaatcatcttagctagagttcgtaaaaatatatatgcaaacacattgatacaaaattttttatttacataaaagccaatctcttacaaaccgaaatagctataattagatattctcatagtttaagagcttagaccagagagagctcaacattcacgttatttgttgaacttccaagaccactttcagaggccctcaactgtcttaaattctttgttcttcctgaaccatccttcctccccaatccactaactctattttctacctgaaaacaaaccaaaaaaactctcatggggctaagtaccttttttgttttctaatctccttattctctcaactcaaccttttttttttttttttttaaactcagcatccatttttaactattgaaatttttttttttttgagacggagtctccaggctgcagtgcagtggcgcaatctggggtcactgcaagctccacctcccaggttcacgccattctcctgcctcaggtgcccgccaccatgccaggctaattttttgtattttttagtagagacaggatttcactgcgttaaccaggatgggtctcgatctcctgacctcgtgattgaaattctgaccctgaagagcgtacttctgtaagtagaaagacgtttgctcttaacatatagtctgcacaattcaatatgaacgttttatttccaacaagtatgtagttcactgttccatgacttgtgcataacaatatgaattatctactatgaaaatatagtttattagaatatttttaagatggtacagctccatcttaccaatgatataaccaatgtctaataatcacaagttaaaaaaaaaagacaataaatagaaccaatgttaatacattactgccttcaacattttcaaactaacagtttctcttaagtttagtctatggcataagtcagtacacccattaagtctagggactactatatcttctatatcccctttctcatataaacatggaaataacacagaagggtaaggtttgggattccatttgaacagcagaagaccactaggtacgtggctcatgcctgtaatcctaacaccctgggaggcaaagacagggatcgcttgagcccaggagtttgactgagaccagcctgaacaacaaagggagacccccgtctcttcgaaaatgttagctaggcatggtggtgcatgcctggggtcctagctactcagaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacattggctcacgcccgtaatcccagcactttgggaggctgagaagggtggatcacctaaggtcaggagttcaagaccagtgctgctaacatggtaaaaccccatctctactaacatcacaaaaattagccacacatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaacccccagaaaagctgaacgtattcatatacaaaagaccaagtactagaaagcaaaagaaaggatgcctaaataaaaaagatacaacagagaagcagaggcgagaggacagcttgagcgcaggagttcgagaccagcttggataacatagtgagaccccattctccataaaaagaaaaaaaaattacgataaagccagtatcaactgtctaccacaatatcaatgcatccgtgtataactaaaaacattaatcttcttttggtctactagaacaacttattccctataactacaggaatttaaaaatggaaacagattttcaaagtgggtacatgcactttttttcctcaactgtgatcttttgccttcctgtgcaaaatcaaggacacaaaatgcagaactttcagtataagctctctcagaagggtgcagggaatgggaagaagagctacaaatcttaatttaacaaggcatagtggcatgtgcctgtagtcccagctactcggaaggctgaggcaggattaagcccaggtgtttcaggtttttgtgtgttaaatgatcatgctggtggagagccactgcactctagcttggacaacaatgtttaatgcctattttatactggcttcagatgattattttcattcactacatcaaatttaaacacagtgacaaatttatgtaagggtcccactatggcactgacttggttgggggaaataaatgagtcctctaaattttgttcattttgttaaatccaccggaaatctttaaaataggctctcaacaaactgaggggccagaacaaaaaacaacccagcttccaagtcttttagaaaattagaatcattgaatagatagcttgaaaaatcagataatgttgacatctttccctgcaaaactgaggaactgaacaaatcaaacaatgtatgcaccaacagtacacaagcctgtaactgtgctttaaatatttcaatttgtgggaaagctctttcaatggagctgctatttttattgggtaagtttgtattctgtagcagcatggaataaaattgaaatttcgagaaacactgaaaaagaaaagagactacataaagtgtttttgtcttattaaaaaagaattgagactttgtcccatttaacaggatttgctctaagcttttaagacaccttagctcccagagggcattttgccatttaaaaaattatagtattatagactacagtcaatgggggttattaatttaaaccttattaacctcaaaagtgctactttcaacaagattaagtaagactattagagatattagcaaaacagcactgagaaacagggctaggaaactagagtacacaaatcggactaagaataattgtactacctttaaaaatgttaagatgatcaacacaaagttttaactgctctaatagtatcttttttaaaaaatgaagttttgattaaagttgtttagttaaaagtccaccaatcctctccccttttaaaaaagtgatgggaatctcactatgttgcccaagccggactacagtggctattcacaggcggaatcacaatcataaggcactatagcccagaactcctgggctcaagggatcctcttgcgtcagcctcttaagcagctggagttgcaggtacgcatcactatgtacagcaatttgttgaacaataaatgtacatttttaattgtaaaattaaacaatgaattttgttgattgactccatgtgggaagaaaaggtgacgctaagatttttggcctgagcaaagcatgagattggcattaagtaaaatggtcaacttacaggtgaagcttgtgggcagatgtagagataaagtaagtaaaataggataatgtaagtaaagactcaattcgaaaagtatatatacaagttgagaacaggctgggaacaaatacaaagtatcattaataaacaaatgatgtttatagccattcaacttggtgagagcactcctggaacagaaggtcctaggagttaacactggactaatttaacgctaagaaagggaaccttggccagtaacctgaaaagttaaaaagaaataaagaatgtgaagaaaggctttgtcacaataaacaacactgcaggaaaattaagaggcaaatatttgcctcttatattcaaaatacacttcagaaaatggccagttgttcgggaatggtcagtctagattaatgccataaaacaaacaacaaaaatagagtagacaaggagaattgtcctgatatgctgtgccaattcactttggaaactcatcacaactacttacaaggttgccagagatcccaagattcacaattttaagactgtatatcacacaccctttatatgcttgtctgtatagatataccctcatgtcttccacatattcagaaatggaagaaaattcattccaaatactattgattctgatcagtgggaattacagaaattcatatcgcagttcaacaatctgtaaaagaaactacatggcttttggccttcaaaaaattgtaacagaaaatattaactgaaccaaatcagtatttcagaagcttttttttttttgcaacttaaattatccactattaagaaaatgactttttttttgagatggagtctccctctgtcatccaggctggagtgcagtggtgtgatcttggttcactgcaacctcctcctcccaggttcaagtgactctcctgcctcagcctcctgagtagctggaattacaggcacatgccaccacacctggctattcttttttttttttttttttgtagttttactagagatggggtttcaccatggccaggctgatctcgaaatcctgacctcaagtgatccgcctgcctcggcctcccaaagtgctaggaatacaggtgtgaaccactgcaccaggcctgcagtcttacttttaatcttacacaggcctactttttctcatggttctcttctcatctctgaaataggaatcactacctggcacataatggactggtacttaacaagcagaccatgtgtagaccacccatcctgaaccaagattcctgggcaaggctcttaattcatctgttactgaacaaaagcaaaactgctccacacatgggccacataatatagccacttgtttatttaaatttttgacctatgtgataaatcctgatgctcagttgtctaaaaatgtctttgtaagcatctgaatatacctaatactgaaataagagtttaaaaagctgacaacacaatccaagttttacatttatttactcataattaactcaataaacatactagattttacatttaatatatgttaaaatggctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagaagtgcgccaccacacccggctaattttttgtatttttagtagagacggggtttcaccatgttggccacactggtctcgaactcctgacctcaggtgatcaccttggcctcccaaagtgctgggattacaggcgtgagccaccgtgcctggccagaataaatattaagataaaatattttaattttaaaataaaaatcaatgtaatcatggttgttctaaacacaatacccaataatgttggaatacttcattataaataaaactaaaggtcagaaaactatgaagttgacctagaatataaacaccatactacttcaacattacacatttcaattacaaagaaagtaagaaagtatttcttatagaataaatgagttttcggcacactgatatttatccatcactaagcctttaaatgctagcattatcatccttttagagtgaaggtataatttcagctagttaacactgggtttcagctcttcactcctgtaatttcaggttcttgttactctcctaacatttctaaatgccttactttcgaagttctccatcaccaagacatctctttagtaataatcaaagagataaaatcagcccaatacacttacctactttaaattcaatatagaaaaatgacctaagtattttaacaatcaaaacaaaggtcttttttaaagatacaaatgctgttcttatttcaccattttctttcttgccatttaaatagtatctaatattactatttaaagtaccacttagtacccaatagtaacaaaaccatgcacaagcacttacctttgagctaccaaataatttttgtaacattatatgcccacagaatgagcaagacagtatcgtaggaaaaaaaagtgagaaaagagtaagtcatagcagatgctctttgtagctagcagacattttgtctactcaataaaccatcttactcatgaattccttttcccttactccaaatcatgtgactgtagtcctgggtcagccatcattaaccaattatttggacatgactaaccacagaattttgttccctcagctgggacccaactattagtccattgtccatcccaacctaagagtttccaaatcaaagggacattcttccttctataatcaagagctataagaatgtgacccatagctgttgacaggcacgtgtcatggacttacatggtaaagtcaaaagctaaagagaccatattcaacagcagcaataacaaagagctgactttccatacagatgtgcaattttggttcctgaggttgtagcttgctctggttcctacacctattccattcattgttaactatcccagtttccttctaataaatcccttatttaatctggattatattaaggagttaaaaaatatatacagcagtagtgagagaccaaatctgaataccaattatgtagattttatgccacttcaaacacaatttagtttttgagttttgctgaaaaacatgtaagaaatctaaatgaagctaagtcttaaaattgaattaggagtaacaaggttaactttcacactggaggttaatttaaatccatttctaaaatgaaaatgtaatgttaatttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaacaacaaggagtaagagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaactgtactcttataaccactttacggaaatagagctcatcttctctgttttacagttgagtcccttaagagaggggaaagaaatgattacattcaagcatagaacatgttcagctttaggataggtgaactaagtgtacctactaacaacttaaaaatttggactaggggtaagtttcaaaaaggttcctttctcaacagggtgtccttgcaaagataatttaatgtttggcaaactgagggaaaaaaattctcaactgcaccaaactattactcaatgctccagaatgaacacgatatggaaaactaatgttttccttagtatttatttccgcataaccatccaccgttagtctgtatctcattattcgtacgtagtgtgaatccagtactatttttcaagttacatggcctgagaaaatgattctatcccacagcaagaccatttactggactggaaatcaatttccaacgacacccatactcagcatttttaaaagtaattttgtctacgatagtcacctaacaaaatgtttttagagcctaaagtttcacaggcttcagggacaaaaacactaaaaaattacacaattgaaattttcagcttattccttcctagcagtctagaggaagaggaacagtgccaagaaccagaaggaacagctctcacacggcacctgtaaaatttttttatactgtgctgactacccctcacctaaggggaacagcattactcaactattaaggccactgaaacaggaaaatgtttggttggggacactgacttactttaggaattgctcaaggttccactcacgttgaagggacactaagatcaagcacatacaatcagggtacaacactaagaaactgtactagctataaaaagaacaaaaggttggacatttcttttccacagagtgctcttttaggaaactttctccttttagtgtcatcttcctctgagctgcttctcctcaaactttctgcacacttggctagtgtgagaatccagaccttctcactggaaaaaatacttgtatttaaaagccttaaaaaacctataggaaaagaagtcaaggagacccctctgccttctttctaagctaggtaaatgagaccctctcaaagctctcacatggtctagttcgcctcattagttaaaacactacaaagaaatttgagacagcaacagactttacacaactgagttgtttgcctatttcctgaagacctggtgggcaccatggtagaaaatagggcaggatttttttcaccaaaaaaatctctctaaaaggcaaccaacaggtacagcttaagccactggtgagtgttctcatctggaagtacatgatttaagcagtaatgggtttggtcactatttttttttttattctgaaacattccttacatgagatttttaatacaaagcctgcaaatggtttatcttgaggaagacctttactgtagtcactatgggatatgggatttaacagttgattgttggagatgttaaactatgctttctgcttctctattctctatcttcctcattcaatgataagtggtactagcagtggtgaccaaccacaggctacaaagaacagtaggccaaggtattgaaaacattaaagacctgaaaggatgctaggagaaacataagaatgtcccctcccttgctgggcgtggtggctcacgcttgtaatcctagcactttgggaagccaaggcaggcggatcacctgaggtcaggaattcaagaccagcctggccaacatcgtgaaatcccatctctactaaaatataaaaattagccgggcatgatggcgggtgcctgtaatcccagctactcgagaggctgagacaggagaattgcttgaacccaggagacggtggttgcagtaagccgcagttgcgccactgcactctagcctgggcagctgaccaagactccgcctcaaaaaaaaaaaaaaaaattccctcctttcaaagagcttataaattggaaatactaaaaatatttattcacaaatatttatgaatattatgaatattcatgaagctacagagcagccatgttccaggagcccaataagtatctgaacattcggttaactttctttcaatgacagccagtatctgttcatcagatcaacataaccaaaaggtagcatttatgaaaacaaggttttaagtgtcaaccctattaaagcgtaacgccataaataacttattctaggtttcatccccccaaggcttgtcaaaattcaaaagcctatatagtggcaaggccaagttcatggattctacctttaagacagtaaaattatcaccacgatgttccacaaatcatttgttatcccaatctctaccatctattttgcacgtcatcacacaaaggtcatacagaggacagaacgcagtagtatagatacatttcctctcagcactttccggaaaactaaaagcttatgccattactaaaggttaatttcttgtattctatttgagagtctatttctttcagaactaaagacaagatttacatgactcaaaagacaagatttgtatgactgtgaatcagcattataaaaacagcccttgcctcaaaaacctatactgagcaacacaaaacactgctttggggactggaagagatgataaaatgaggtgggaaacaaagggagtaagtgccttaagaaattttaagaatcatcctcaagaagactttacaaccaacctagaaaaatacaaaggtgcgaaccaacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggattaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcgattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaagatatttggtgaatgcattcatttttaattatgaaataacactgctatggtagcaagctcaagaccacaacatttccaagaatggagagttttatttcattaatttcaaaatactggttttggcaaggggaattaagtcattataataaaagacaaaccacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccctgtatctgtggttcttaatcagagaggagcttcagaatcacctagaaaattttcaaaattatgtgtttccagggaaaatgatttagtaagtctaagacccccatgcagctgtatttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaaaatttttttaaaaactccaaatgttctggaatataaatgtaattcatgtcacacccaacaatatataatattcagtaagctcttctatacgctaacagatacaagaaaactgctatttaaaaaaagaatgcaaaaaccaacctaggtttgagattttaatctgaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatctagtgacacagtagttcatcccagtgatggagcattcaactttttatttgtataaataacaaaaactagaatcaacactgcagatgagcatgatgaaagaaaagtatgcagtgtcagtaatgcatcctttttcaaattaaacaaatactgaggtcctattattatcagcatccttcagtcacaactatcctacacagaaagtgagctggctatcaacaagctttgaggaccatatatgaaacacatgcaagacagtttacccagcctatatactagttggggacaataaatatattttgttcactctaagacatcctaagcagttaactggcacatgttagttttcagtgcttgaagagactaccccaaaagaattaaatccacttctactttcaaaatattattagccaaaatcttaactcacaaattagctataacctaagagtaaagctaactcccaattacttagatgtataagtgggagagcaaagcagcttatttcaggtaacaaactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggcaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaaggatgatatcaaactgtagttgttaagagcacatactctggaccaggctgcctaggttctaatcccaactgtcacaacatgaacctgggtcatcttcttaacctctatgcctaagtttttcaatttcgagatggagataatcttgaaattatctcagtggaagtggtggtaggagggaaacgaagatcaaatgagagttttttaaccctttacccatggtttccctgctagccgcttgcttataatcatatataaacactaaagtcatacttccagaaataaaaacccttacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatacattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacagctgaaaaaccaaaccacatgcacacgtcaaagtttctgtaagttgaatcaataatgttcacataaacactggtttttccaatatgccaagtttttatgttgtgtctatattacataaatcttcaaaatatttacaaaaggagacaacctggttaactaagagtactaaactagaaatcaaagttcttaaacaaaaacggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttagccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatttcaaaataatttttactttaatccttaactcctaaaaagcgtttcttcctcttttctttcatttcacaaagatttaaatttgtatttcgcataacccaaaatgacgatgttatgaaggcccaaaacaaaattcacgatttcatatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaagaaataaaggaagggagacttgatgtgtattgctatcctcgcagcgagctattctgtgtcacccctgacgccaccgtacactcactccgccttccagcgcgctcccgcgcgcgcccgcccagccacctccaccacgcgcccgcgctgtccctgaggctccggcttaggcgcgaggacgcgcccattccccctcctcctccagcaggagaggccgcggcttccccaaccttcccaccctaacccaccgcacccaataggctggccgctcaagccgcccaggtcccgcactgcccctcttacccggccggccactgggccggcctcccttccctgccctagccgtccacacccacgcgtacagaggggccggggcctccctcaagctgcggcctcggcctcctccccgcgcggcagctggtgcctccccggccctacggggctcacgcgcacgacacagccacaagatgtccgctctgacggaact

SEQ ID NO: 2077 - DNA, 73229 bp, Homo sapiens
atccaatagcattgacttttattcattcatgttaagtcacctgaaatgatatctgttgcatttaaatgctcattaatgtaaatggctgaacaaatccatttcaatggatactcaatatcccacatagataagtcacttcaacacagcctcatgacaactcccacaccaaaacagtactttattttgcaaattttgacccattattactcccatgttgttttttttcagctgtcaagtgtacaaggtgaagagaaatttcagttagacaggggctgcacctggaaaataaatttcttaaactccataaacacatttcaaaactgctgggtcccaaaagtccatctatgaactctagggctgccagtatcatgtgcagcacattaaagctacactatccaaatagcttattaattctgcataaatcaggtcaagcaatgtgtcaacctgtaacagactgtgcactttaactgaacatggcaaaatattcactctttcgaactttacatcatcatttgatgtcaaacaatgaagcaaatcccaacagtatatacaaaaaacagctttgcatttacaaaagattgtttcccatactgattaatccaggcagctaactcattggtttatgcaactttattgaagaaaaataaatcaattactagcagagctattagttgatcactcatccattgacaacttgcatcatttattcagtgctatattaaacagtgtattggaagatagattaactaatagctccaagcctcctaacaatttaaatgaaaattacaaaatgtttgagaccctattttggaatacaaagggtgtttgacttccaatttccattctctgtagaacaagaacaggtcattcctttattgacatgcataaaatacatcacattttctgttctgctgatgctataaattcaataccaattctccagccacatcagttatgagcataaagcatatcatgtaacctcaaatctctaacagtggaaggcttaaacaagaatggatgctgctagaataatgctgtatcctttgatgtgacaactgagcatccatctccctccccctcagatgatttcttcagcatgttagagcagtgaggaatggttttagtctcataaccaagttagagtgaagacattggccacataatacacatgctccatttttttttttaaaaattctgagtcttgggcaactgttctcttgtaactactttacagtttctaaaagcagttattgtccaaagctggaagaacttaagtcttctcagatgagcatgtgaatgaatggagggaggtaaacaaaaaataaaattaaaaaagatgaggtctgataggggagcagccggataagaaaatcaaaaaaggaacagtaatttaaagtttattccagctataatgcaggttattctgactttaaggtagcatcacatggcatacttctgagtccattcccgagatattctgttgtacctgtaaataaagatgttatttttaaaagttaaaataaagaattcctaatactttaaatggaagggaaagatttccattttatcatctccagactcatcatgaagtcatctctaatgactatgattagaataaaagccaacaagggagaaatagcactggtactcaaagcaatgtgggaaatgagagcctgatgctctgaaagtagtattttaaaaacaactaagaaagcagcactgaaaattgggaggctaacaaaaatcaaaagaccctttctttctctaccaccgagctcatgctctaattttaacgtgaagaaatttttacagttcattatggacaaatgttaaaatagtatacacattctatctatccacagaaatttccaccaaggccagaactaggcttttactagaacaattttatctgaatcctagagtttgggaaattacttggtcctggatattacaagaaaaaatggctttgggacttaggtagaggcagaaggggaagatgacactgggcagaatgacaaagggcagtaattttcaaaaggggtgtgtgtgtgagtggttgtgttcatcagaatcacgtgttacttttaataagtgtggtaactgaggctaataagcaccactgagacctgttgagtacaacaagggcatcttcgtttaaaaagatcaacaggtaattcacacacaagcaaggttattactcaggaagactactaacattgataaatactatcagcttccccctggattatactcatgccatagactacttacaacaacaaaaaacagtgataaccttaagaaaggaatatatatatatatatatatatatatatatatatatatatatatatgcacaggagaatttttatattgtttaaatattaactagctttatttcaaaccaagaaccaaatatggtccaacaacttttctaaactttttaaaaagttctttctaccaattcattgtcatctcctaaggatactctctcaaaaagccagcactttaaaacaaaggctttatttagcatacagggagccacaaagtacagctgacgctaatgcatgcttgtcagtaatgaacatttagtttagatgcttaggcttaaaagtgtttttcccttacattactatctcctggcaaaatttgaactaaaccaccacattctgtataggattggtacaaagtctcaagctaaaatttaaacaccatgatagtttgaaaaaaaaaaaagatactacataaattcccatttcttactagtgctattgtaactgctttgccatgcaatactttcaagcagtaacggctaccagatatttactttcacgttaaacagagaccaagcagttaaatgtacagttttcagaagactgccatatttgttaccttttgttagttaatacagtgccttaacgcatgcagcactcaagtgctggcagtaccataataagcgcaccatagagtgcagatcctcttaccctacaacatagcgtatttctctgtccactctcttgctaacctattgtacctaattgaacaagtacacttagcattaattataacatatgaaagttataatggttaagttgaacataaatataattcaaatatttgagaaatttagaccaaatttttacaatagtactaacatttttggaaaaacatgcttggggtaaagaaaaatttgctttcttccccaaaagttgagaataaagtgatactgtttaacacgctaggaaaaaaaaaacaacaataaaacattttagaggggagcattcactgtcacataagctaaagcctagttaagtttttttaaataaccacatttcaatagctttctccatattttaactattatcttactaaatatcaagtcttcttggcactgtcacaagcaaagtataagcctaactcattaagtaaaaccacttttataataactttttaacatacttacttatctctgtctgttttatagatccgtgcaatctctggcactagggggtcatctgggtttggatcacatagcagtgaacaaatggataaaagaactgcaagaaaacaaaaacatctgttacccagtttcaggagtttggataaataaatttttctaaaccgtgtattacaaaactcaatcctcaaaagacttttattagtttgtatctttatctcaatgagacacagttttacagagattttgtttcacagaagacaagctcctggtaagtaagaagtgctaaaaacagggttttgtggcatgaaattcactgcagactagccataaaaatagtttctaagataggcaactgatgccatattaatatatatattttaaataggcataaatgatattagaacttgagtttcttggtactctgtggctgggggggggggactttagcaagaatatgcaggtaacactcatgccatattcatagccattaggcatgacgaaaaatccattcttagccgctgtcttggcaatttctgagaaaaaccctcaagtgctccactaaatgtctccttgaacttgtaagcaagaaaccatattcccaagagtactagttaaatacaatgccaaaatctctttagtactaagtgagtcatcagctctagttcttaccttaaccagctcaacatactgatgcataagatgtcaagcattaaagaacatagatcgcattcacctttgagtgccggtatgtgccagcaacatatatgtggggtgctgtattaaaatgttaagatataaatgctctgaaaggttctgaccggttttttttaaaaaaagcaatagtataaaaaagcacccttgtcacatatttattgactacagcaaatttaatttccaaaccccaaatacagcagaatataaaattacctaatataggagacttggctatacaataactcacagaaaaaaggtagcttcagttgtgactgctagtttaataagttagcaaagtatggctgccaaaaaagtaagttgctttaacgacaaaacaataccaattcaatctgcccttacaaaaacagttttcagtgttactgtacactcccagcagtagtagaaaaacttggaaactgatatttaggtatgtagcatgatttgaaaagaaattagaaagcatccaagaaggtgaaaaacaggtgtaaaattttaaaaacactcgaattatggcagcatctgcctaagttgtttctttttctcccttaagtgattctactcaataaagtttgggaaatgctactgctacagtctctctccatgagattcaagtgcagtatatacacatatgaaacttttatacaatgccttgccttttgaaaaagcttttttgtacttactgaactcataaaatcaaaaaacaattaatggtgaaatagtgttaattattacaacttcacctgggatattcatgcggagaccggaaaacttgttacatataacgtaacagatgcctattaagagaccagaattgatctacagatctttcgaagattatataattttagactgtcattaggtagaaacaacctatcatggttacataaaacatgactgaagatttgtctaaaaattaacccaggaaagcaaaatcagaattttcctagagtggaaacctcagaattcaaaagctctattaagtttaggtatatcataccattcttggtaaaaaggccgcaagttagtgtgagatgtccaagtggtttgggattgaaaaatacagaagtctattaaaataaattttgctattataagatgagatgaaggtaactcattaggcaaataatgcctactcaccacaatttgaattttaacaacttctcacaaagtatctttaatcaacaccactaaaagaacaaaaattataaaaataactttattgcttccccatctcttaccaaaaagctgccataataaaaatactcagataagtagatctaagaatgaagctttattagacaatgagaacagcttatttcactagaaatatttacctttagaaattgttaaagcaggcgaccactgtgatcttagaatatcgagacaaatgctgccattactgttaatatttggatgataaattcttgttgtaaatgcaacctaaaacaaaaacttttaagtattttattcaaataaaaacaaacatcttttaaagcaaaacttaaaataatcaagccacaatgttaaaaatgtcatctattagcatagaagttctaaatattatagaaactgatttttacaatctgaccacaaccccctgcctcctctttttacaacagaaacctaaacttttggataaaaatttcattactcatatgatgtaaagttctaaaggttactgtggccctaccatatcatgaatcaaagggcaatttaaaggtatttaacacattcatttataaaagccctaacttttggatgtaaccaaaatttgtagaccatctcatttaaagtttcattaagttacacaggtacacctgagtctgcatttccaccgtacataaaacataaacttgaatcacaaaaatggaaaccatcacattgcacctataacattactagagattgttatagtgacatgtttatgacctttgtatattaccttttctagttattcatacaggttgaatttatgttaatgactgaaaagtgaaggataatatgcttttaatacctataaaccagtgcactaagcaactctaagttttcacaaatttacacttacgtatacaaaactataagcataataagcatatgctgtaacaatacgtgcaaatataaattgaagttggacatttgatgcttacaagacaacaaaagcccaaaaatcagaatctgtgtaacaataatacagatgagggcggaagcttccacatggtctgaatcttgcaacattaaagaaaaggcaaaccttattcctatttacaaagctcaaactgaggtctagctctttaaaccaaaggttaagagtcagcatctatacatgagtgcaattcaacatatatatacagcctacacagaaccctatcttccaagaatgctctattcctttgaaataaagcataaatctatactaacagattttgagggaaaatacttgccttaggtggtttgaaggggtagtctgtaggaaaatgaattgtcaaaaagaatacaccgccttgatatgggctgtcattctgtaaaaagaaaagtatgcttaactcaaatttaaaatattattgctaaatattccgtaacatttgtttccaagcatttctctaataatgaacccaaatcacctatttacactgcaataaataatctattccatgaaaattcagtctatagtaatagaaaaaaacttaaaacttatacagtaataaaccctaatttacctagtcattttacacgtcaccaaaatgtttttttaaaaagttatccagaaacgcaagtattctagatctcaattctcaaaagtacaacacagcaataaagcctacataatcatgtttcagaataatctgtaaacaaaattttacacatgtagattatttcttccaatagccagatgtgtacaaatggcttcacaacagtccattctgcccactggcaaaccaaatgttagctattccaggtaacacacacacaccaccttcaagaggagaacagagaaaagcctaagcttctcattttaatcaataccagaaaatacatgcattgcccctattttatgcatgagaaaaatgaggcttaaagaacttagtctagtgtacaaatggtaaatgatagaaccaagattcaaacacaagtcttttgaagaccacttaatgatcaaagatactgacctactcaggaatttaaagttaaaatgtggaatgcctaactgcttctgggtatgcaaagaaccaatccgaagacatgttttacaacttacatgaactgggtttttaccaacactgactcccctctattagaaaggctttgtatatacagctatatatgagcctttcactatgcccattctggatgtcaggcacataaaaaacaggcctgacactaacacagctcatctaattcctacccttctgtaaaataaataaacattaattcaattaatctaaccccttgctatatactgtatgtgtgttaagggatccaaagaacaattttttttatcttgatgagcttacactgatagacatgtaaagtaactgcaatgaaatgttataggtatcatgaaatatgaacaagggacacgagttcaaagaagaaaggtcaatttattaatgaagaatcaggttcaaagaaatatacaactagtaaatggaagagcttttatttatttgagacggagtctcactctgtcgctcaggcttaagcgcagtggcacgatctcagctcactgcgacctctgcctcctgggttcaagcaactctcctgcctcagcctcccaagtagctgggattacacatatgcaccaccacacccagctaatttttgtatttttagtagagactgagtttcaccatgttggccaggctagtcttgcggcctcctgaccttgtgatccacccatctcggcctcccaaaatgtgctgattataggtgtgagctactgtacccagccagagcttatttaaagtgagtccttctccatctcccaagtcttccccctttttttttgtaggggtggagggcggggggaatgggaacgggaagggggacaaacaagacgtagaatatcatcttgctgtttgttgcccaagctcgagtaaaatggtgcaacctcagctcactgcaagcgccgcctccccaggttcaagagattctcctgcttcagctgcctcagtagcttggattacaggtgtgcaccaacgtgcccagctaattttttatttttagtagagatggggcttcaccatgttggctgaactcttaactcctgaccccaggtgatccgcctgcctcagcctcccaaagtgctgggattacaggtatcagccaccgtgcccagtcctttttcatattttctacaaaatatggaactagaaaaacactcaggtcacttagaatgtgacctgagtttattagattaacatgtctttattaaatagttatattaattttgaatagatgcttcaaatagcatatactttcacctgatccaatactatacaagatatgttttttctgtgtaaaattaacaatttaaaggtaatcccaaacactaaagttgtttttgttttttttgagacagggtcttgctctgtcgcccagactggagtgcagtggcacaatcttggctcactgcaaccctctgcctcctgggatcaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataacctaattccagaagttctttgtaagctttcatttcaattttcataaaatcaaatgctgtctatgactgcttctgaataaaggcaatctgctgatgggatttaggcaaagccaaatttcgtttcgtttgttcgaaaaaagaactttataaagaaggcaaaatatttcaatgttacaatttaacactaaagttctgccatgccaaaagaggaagaactacgaggttcagagataatgaaactaggcaatataaaaaattgagaccctatgatatttaaattctattatgaatcagcagcaaactacaccaaaaagaaacaaaatccccaaagaataaggaacactgtgatcagcaaatcgactcaaatcgtacaagtccagaatttatgttagattttttcagaaaccttctacttcttttgctctcatcagtgcaaagttgctccctcacagtgcctcagctcttctgtggcaataaaacgttggtattcttttttttttttttttaaagtggtgctgtcgcccaggctggagtgcagtggtgtgatctcggctcactgcaacctccacctcccaggttcaagtaaattctcgggcctcagcctccaaagcagctggaattacaggcatgtgccactacacccagctaaaaatgctggtattcttataggttgattttctactcttaactgctgacccataaaaatttgagttgcaaaatatatctctggtcagttattcattccagggcatatattcaaatgcctactgatatttctacttggatatctctacttggatatctcatgtcatgcgtccaaaactgaaacttgtctcaatcccttttttcctgttttttaatagcaagccataactgaaagccataaaccaggatctcatcatcaacttcttcctctcttatctcagaatcaagatagttatcaagtaagatctttaaaatttcttgaattagcttctcctttatgcccactgtcactaccatcttagttcatgatgttatcttcagcctagattatggcaatagcttactaatgattatccctccatcctaatgataaagtggtcttttaaaaatgttactcccctgcttgaaatctatgatagtttttaagataattccaactcctaagtacatacggtgctttatgatctgggtgcccatctagtttcatcttctgtctcttctatagaacatgttctctactgcacataaaatattatatggataacatatctttttctcttccctacttggaatattcttccttataatatagcccttcctttgtcttatctgctccctacccttcttttatacctctttaagcacatagttaccattatccacccatatatctaacatttacttatatttctcttttattagactacaaagctcctcaacgagtaaggttaaaggtggaaaaagtcttcaggtatcagtaacctacgtgggaaatgacataataatacacttgaaaaaaaagttgaaaaaataatccttatggaccaaataaaatagtacctatggaccaattattttaattcagatagtttttctggttgactatgctcaggctgccaaaggttacatttttcagatactttcacatttttcacaggtactctcttctacatctctgtcatagattaggtgggagttagtgttgttctctaaatccactttttctggatttccaataaaaaaaaatttaagcaagtaaatatcagaggcaataggtaaggaagtcaatttcttctaattacatcaattcttgttggaaactaaccttaatacagtaccccacgcccccctccccaaaaaaaaccacgcacacaaaaaactagcaatgctgtcatttctttcgaaggtttagtttttagtcaatagttgtgcttccgaagtagcttaccttcagaaagaataagccagtacatatgattattaaagccaagcaattttgctgcataactaatgatctaaaggatttcccaacaactcactaaaatcaaagttactctattgaaactcaaaattagatggtatattccctacagtcaggaatcttcagttctgtggcactggcaccactttaagggacctaagtagtagtccaaagcaaaagtgacgttgttaactgtccagttctcccactaaatctgtaatttatgggttgctttaggtcacaactgcttgctacatagagcaaccatactcacaaaataagctactatttatcttatacagtgatgctttgtcacaaagaagtattgagaagccaaaagaacaaaatgagttgtttcattggtgcactccacagtaagcatatagttaactatttaaagctggcatctaaattatgtgcttacttatgtacaagacaatacccgtactttgggtggatttttataatctttgactccttcttgaaatttacccaaccaacagtgagaactaacctttttaactgaaaacatatttcagtgagtactgctaccaaagcaaaacccagcagttgtggttaatcaggttaatatttaaatggttctgaaaatcacatgcttctgtttgtaaaagcagaaaactgctagtcattatattaaaaggttgctgaaaaagttcagcaaggaatagccatcacctgaaatatatatttaaaaaatgaaaaaaggtaaatgttttctcaaaataacagcaaattaagtaaactgctaaaaaatctgtcagaataagcaacaccattctctaaaaaaattactaccatacactcatcattcatgtttccttttgattgtctataggtatgttccttgccttttgggaaaaactagtgtgttgttcaaaataacaaagtctaaactgtcaagcagaaaaaccaactagttttaaagagttagtttattctgcacaccatccaattagaagttttaattaccaacgcttctgtgctttcttagtattgacaatttttataatgaaactatcaactaccctctgaatcaaagatgagctttattttaaggcattttatagcattctttgaaaactggtaatccaaaatgggaaaattctagaggttgcaaaagcaactgctttacaaaacactaggcagataatatggaattgacctagtaggcactgtggtaaacacatatcccatctaaaaaagggaggcagctgtcattccatcccaagccattactgcttatggaatgtgggcctactcagaaggcttttatttgaagactgccaactttcaaaaatatcgtgtgggccaaactgggtaactcaacatttaactgcgtgtattaaaattaaacaatattgctaccaaattagataaaagtaagtacttttaataactacaaagccaggattgtgcatttcgttattacaggactatttttactgttttaaatgttactttgttttaaaatgatccaggacgtttcaaagtattaaacttaatatttgcacccctgccatgtcttactttgatttagtttttctacctttagggcactaacattttaattactctaaattaatcctccctgctacaatttcccattaatttatcctactcagcacttcattcaccaatcacttattttccatcttgtcacacttcagcacttgttttaggtatctgtctcctctaatacagtgtaagttccctataagatcgacagggatgtttattatgttcaatttgtatccttattacctggcacacagtatgtactcacatttgagacagaaaaatgactaaagttagaatcagaattactaaataaatacttgttgattcgactcatctactaactctaagagcattttttcctttagaattctaaatattacttactgaccattatctcacctagtacattattgctctttatgttgcttataaaaccaccaaaaagggaagacagttttcaggaagatacacatgtaacttagaaaacaaatccttaagcgccttagcaagttaaaaaaaaaaaaaaaagttaaatatttgtgtaagatacagtcttaccccaggatgttttagtgcgctctaattctctgaaattcttagatggtatccataattctgaatattcaattatccagcatatagttgcttatctacccaggatagaaaggaattttgctatattcaaaatatcactttctgcctaaatatattcaaattttgcataaactgaagttctataaagaatcaaatatcaaaatacaattaagctagattattggcagctgcagtaacagaataagatctctgagtaacacaacgcatggcagatcagagccagtaactttgtctctataaataacaggaagttccatgacaatgctttacacagtgctatgtagaaaaactgaactgagatacagagatgtttggtaggtcatagagatggctatactctagaacgtgaacacagggatagacacaaagtacacgtaacaaatgactaactcattatgttttttctttcaaatgcagtacaactatggaatatccaaaatagaattaactatatgataaaataaacctacagaccaagttaaaaattacaaccaaatcaatgctggattttcacttaaaactaaatttaaaaattcttaatacttacaggtcccataattgtggcttgccaatgaaacactagaaaaagaaaaaaaactctggttatctaaaaatgcacaagcttaaaaaaaaattaggcataaaaatcaacttgcaagttacttactatcatccccaactggacctgcagaacattgtgctggagggtcacgggccaaatcactaagttcctacaccaagacagaaaatgggtgagtcacataagcttaatttaagaaaacaagcgagtccactgctttcagttactttcaccctatttttaaaggcacactccatcacaattcacataaataatatattccattaggagagagaacatgcctgaacatatgctgagacaatcatcttagctagagttcgtaaaaatatatatgcaaacacattgatacaaaattttttatttacataaaagccaatctcttacaaaccgaaatagctataattagatattctcatagtttaagagcttagaccagagagagctcaacattcacgttatttgttgaacttccaagaccactttcagaggccctcaactgtcttaaattctttgttcttcctgaaccatccttcctccccaatccactaactctattttctacctgaaaacaaaccaaaaaaactctcatggggctaagtaccttttttgttttctaatctccttattctctcaactcaaccttttttttttttttttttaaactcagcatccatttttaactattgaaatttttttttttttgagacggagtctccaggctgcagtgcagtggcgcaatctggggtcactgcaagctccacctcccaggttcacgccattctcctgcctcaggtgcccgccaccatgccaggctaattttttgtattttttagtagagacaggatttcactgcgttaaccaggatgggtctcgatctcctgacctcgtgattgaaattctgaccctgaagagcgtacttctgtaagtagaaagacgtttgctcttaacatatagtctgcacaattcaatatgaacgttttatttccaacaagtatgtagttcactgttccatgacttgtgcataacaatatgaattatctactatgaaaatatagtttattagaatatttttaagatggtacagctccatcttaccaatgatataaccaatgtctaataatcacaagttaaaaaaaaaagacaataaatagaaccaatgttaatacattactgccttcaacattttcaaactaacagtttctcttaagtttagtctatggcataagtcagtacacccattaagtctagggactactatatcttctatatcccctttctcatataaacatggaaataacacagaagggtaaggtttgggattccatttgaacagcagaagaccactaggtacgtggctcatgcctgtaatcctaacaccctgggaggcaaagacagggatcgcttgagcccaggagtttgactgagaccagcctgaacaacaaagggagacccccgtctcttcgaaaatgttagctaggcatggtggtgcatgcctggggtcctagctactcagaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacattggctcacgcccgtaatcccagcactttgggaggctgagaagggtggatcacctaaggtcaggagttcaagaccagtgctgctaacatggtaaaaccccatctctactaacatcacaaaaattagccacacatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaacccccagaaaagctgaacgtattcatatacaaaagaccaagtactagaaagcaaaagaaaggatgcctaaataaaaaagatacaacagagaagcagaggcgagaggacagcttgagcgcaggagttcgagaccagcttggataacatagtgagaccccattctccataaaaagaaaaaaaaattacgataaagccagtatcaactgtctaccacaatatcaatgcatccgtgtataactaaaaacattaatcttcttttggtctactagaacaacttattccctataactacaggaatttaaaaatggaaacagattttcaaagtgggtacatgcactttttttcctcaactgtgatcttttgccttcctgtgcaaaatcaaggacacaaaatgcagaactttcagtataagctctctcagaagggtgcagggaatgggaagaagagctacaaatcttaatttaacaaggcatagtggcatgtgcctgtagtcccagctactcggaaggctgaggcaggattaagcccaggtgtttcaggtttttgtgtgttaaatgatcatgctggtggagagccactgcactctagcttggacaacaatgtttaatgcctattttatactggcttcagatgattattttcattcactacatcaaatttaaacacagtgacaaatttatgtaagggtcccactatggcactgacttggttgggggaaataaatgagtcctctaaattttgttcattttgttaaatccaccggaaatctttaaaataggctctcaacaaactgaggggccagaacaaaaaacaacccagcttccaagtcttttagaaaattagaatcattgaatagatagcttgaaaaatcagataatgttgacatctttccctgcaaaactgaggaactgaacaaatcaaacaatgtatgcaccaacagtacacaagcctgtaactgtgctttaaatatttcaatttgtgggaaagctctttcaatggagctgctatttttattgggtaagtttgtattctgtagcagcatggaataaaattgaaatttcgagaaacactgaaaaagaaaagagactacataaagtgtttttgtcttattaaaaaagaattgagactttgtcccatttaacaggatttgctctaagcttttaagacaccttagctcccagagggcattttgccatttaaaaaattatagtattatagactacagtcaatgggggttattaatttaaaccttattaacctcaaaagtgctactttcaacaagattaagtaagactattagagatattagcaaaacagcactgagaaacagggctaggaaactagagtacacaaatcggactaagaataattgtactacctttaaaaatgttaagatgatcaacacaaagttttaactgctctaatagtatcttttttaaaaaatgaagttttgattaaagttgtttagttaaaagtccaccaatcctctccccttttaaaaaagtgatgggaatctcactatgttgcccaagccggactacagtggctattcacaggcggaatcacaatcataaggcactatagcccagaactcctgggctcaagggatcctcttgcgtcagcctcttaagcagctggagttgcaggtacgcatcactatgtacagcaatttgttgaacaataaatgtacatttttaattgtaaaattaaacaatgaattttgttgattgactccatgtgggaagaaaaggtgacgctaagatttttggcctgagcaaagcatgagattggcattaagtaaaatggtcaacttacaggtgaagcttgtgggcagatgtagagataaagtaagtaaaataggataatgtaagtaaagactcaattcgaaaagtatatatacaagttgagaacaggctgggaacaaatacaaagtatcattaataaacaaatgatgtttatagccattcaacttggtgagagcactcctggaacagaaggtcctaggagttaacactggactaatttaacgctaagaaagggaaccttggccagtaacctgaaaagttaaaaagaaataaagaatgtgaagaaaggctttgtcacaataaacaacactgcaggaaaattaagaggcaaatatttgcctcttatattcaaaatacacttcagaaaatggccagttgttcgggaatggtcagtctagattaatgccataaaacaaacaacaaaaatagagtagacaaggagaattgtcctgatatgctgtgccaattcactttggaaactcatcacaactacttacaaggttgccagagatcccaagattcacaattttaagactgtatatcacacaccctttatatgcttgtctgtatagatataccctcatgtcttccacatattcagaaatggaagaaaattcattccaaatactattgattctgatcagtgggaattacagaaattcatatcgcagttcaacaatctgtaaaagaaactacatggcttttggccttcaaaaaattgtaacagaaaatattaactgaaccaaatcagtatttcagaagcttttttttttttgcaacttaaattatccactattaagaaaatgactttttttttgagatggagtctccctctgtcatccaggctggagtgcagtggtgtgatcttggttcactgcaacctcctcctcccaggttcaagtgactctcctgcctcagcctcctgagtagctggaattacaggcacatgccaccacacctggctattcttttttttttttttttttgtagttttactagagatggggtttcaccatggccaggctgatctcgaaatcctgacctcaagtgatccgcctgcctcggcctcccaaagtgctaggaatacaggtgtgaaccactgcaccaggcctgcagtcttacttttaatcttacacaggcctactttttctcatggttctcttctcatctctgaaataggaatcactacctggcacataatggactggtacttaacaagcagaccatgtgtagaccacccatcctgaaccaagattcctgggcaaggctcttaattcatctgttactgaacaaaagcaaaactgctccacacatgggccacataatatagccacttgtttatttaaatttttgacctatgtgataaatcctgatgctcagttgtctaaaaatgtctttgtaagcatctgaatatacctaatactgaaataagagtttaaaaagctgacaacacaatccaagttttacatttatttactcataattaactcaataaacatactagattttacatttaatatatgttaaaatggctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagaagtgcgccaccacacccggctaattttttgtatttttagtagagacggggtttcaccatgttggccacactggtctcgaactcctgacctcaggtgatcaccttggcctcccaaagtgctgggattacaggcgtgagccaccgtgcctggccagaataaatattaagataaaatattttaattttaaaataaaaatcaatgtaatcatggttgttctaaacacaatacccaataatgttggaatacttcattataaataaaactaaaggtcagaaaactatgaagttgacctagaatataaacaccatactacttcaacattacacatttcaattacaaagaaagtaagaaagtatttcttatagaataaatgagttttcggcacactgatatttatccatcactaagcctttaaatgctagcattatcatccttttagagtgaaggtataatttcagctagttaacactgggtttcagctcttcactcctgtaatttcaggttcttgttactctcctaacatttctaaatgccttactttcgaagttctccatcaccaagacatctctttagtaataatcaaagagataaaatcagcccaatacacttacctactttaaattcaatatagaaaaatgacctaagtattttaacaatcaaaacaaaggtcttttttaaagatacaaatgctgttcttatttcaccattttctttcttgccatttaaatagtatctaatattactatttaaagtaccacttagtacccaatagtaacaaaaccatgcacaagcacttacctttgagctaccaaataatttttgtaacattatatgcccacagaatgagcaagacagtatcgtaggaaaaaaaagtgagaaaagagtaagtcatagcagatgctctttgtagctagcagacattttgtctactcaataaaccatcttactcatgaattccttttcccttactccaaatcatgtgactgtagtcctgggtcagccatcattaaccaattatttggacatgactaaccacagaattttgttccctcagctgggacccaactattagtccattgtccatcccaacctaagagtttccaaatcaaagggacattcttccttctataatcaagagctataagaatgtgacccatagctgttgacaggcacgtgtcatggacttacatggtaaagtcaaaagctaaagagaccatattcaacagcagcaataacaaagagctgactttccatacagatgtgcaattttggttcctgaggttgtagcttgctctggttcctacacctattccattcattgttaactatcccagtttccttctaataaatcccttatttaatctggattatattaaggagttaaaaaatatatacagcagtagtgagagaccaaatctgaataccaattatgtagattttatgccacttcaaacacaatttagtttttgagttttgctgaaaaacatgtaagaaatctaaatgaagctaagtcttaaaattgaattaggagtaacaaggttaactttcacactggaggttaatttaaatccatttctaaaatgaaaatgtaatgttaatttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaacaacaaggagtaagagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaactgtactcttataaccactttacggaaatagagctcatcttctctgttttacagttgagtcccttaagagaggggaaagaaatgattacattcaagcatagaacatgttcagctttaggataggtgaactaagtgtacctactaacaacttaaaaatttggactaggggtaagtttcaaaaaggttcctttctcaacagggtgtccttgcaaagataatttaatgtttggcaaactgagggaaaaaaattctcaactgcaccaaactattactcaatgctccagaatgaacacgatatggaaaactaatgttttccttagtatttatttccgcataaccatccaccgttagtctgtatctcattattcgtacgtagtgtgaatccagtactatttttcaagttacatggcctgagaaaatgattctatcccacagcaagaccatttactggactggaaatcaatttccaacgacacccatactcagcatttttaaaagtaattttgtctacgatagtcacctaacaaaatgtttttagagcctaaagtttcacaggcttcagggacaaaaacactaaaaaattacacaattgaaattttcagcttattccttcctagcagtctagaggaagaggaacagtgccaagaaccagaaggaacagctctcacacggcacctgtaaaatttttttatactgtgctgactacccctcacctaaggggaacagcattactcaactattaaggccactgaaacaggaaaatgtttggttggggacactgacttactttaggaattgctcaaggttccactcacgttgaagggacactaagatcaagcacatacaatcagggtacaacactaagaaactgtactagctataaaaagaacaaaaggttggacatttcttttccacagagtgctcttttaggaaactttctccttttagtgtcatcttcctctgagctgcttctcctcaaactttctgcacacttggctagtgtgagaatccagaccttctcactggaaaaaatacttgtatttaaaagccttaaaaaacctataggaaaagaagtcaaggagacccctctgccttctttctaagctaggtaaatgagaccctctcaaagctctcacatggtctagttcgcctcattagttaaaacactacaaagaaatttgagacagcaacagactttacacaactgagttgtttgcctatttcctgaagacctggtgggcaccatggtagaaaatagggcaggatttttttcaccaaaaaaatctctctaaaaggcaaccaacaggtacagcttaagccactggtgagtgttctcatctggaagtacatgatttaagcagtaatgggtttggtcactatttttttttttattctgaaacattccttacatgagatttttaatacaaagcctgcaaatggtttatcttgaggaagacctttactgtagtcactatgggatatgggatttaacagttgattgttggagatgttaaactatgctttctgcttctctattctctatcttcctcattcaatgataagtggtactagcagtggtgaccaaccacaggctacaaagaacagtaggccaaggtattgaaaacattaaagacctgaaaggatgctaggagaaacataagaatgtcccctcccttgctgggcgtggtggctcacgcttgtaatcctagcactttgggaagccaaggcaggcggatcacctgaggtcaggaattcaagaccagcctggccaacatcgtgaaatcccatctctactaaaatataaaaattagccgggcatgatggcgggtgcctgtaatcccagctactcgagaggctgagacaggagaattgcttgaacccaggagacggtggttgcagtaagccgcagttgcgccactgcactctagcctgggcagctgaccaagactccgcctcaaaaaaaaaaaaaaaaattccctcctttcaaagagcttataaattggaaatactaaaaatatttattcacaaatatttatgaatattatgaatattcatgaagctacagagcagccatgttccaggagcccaataagtatctgaacattcggttaactttctttcaatgacagccagtatctgttcatcagatcaacataaccaaaaggtagcatttatgaaaacaaggttttaagtgtcaaccctattaaagcgtaacgccataaataacttattctaggtttcatccccccaaggcttgtcaaaattcaaaagcctatatagtggcaaggccaagttcatggattctacctttaagacagtaaaattatcaccacgatgttccacaaatcatttgttatcccaatctctaccatctattttgcacgtcatcacacaaaggtcatacagaggacagaacgcagtagtatagatacatttcctctcagcactttccggaaaactaaaagcttatgccattactaaaggttaatttcttgtattctatttgagagtctatttctttcagaactaaagacaagatttacatgactcaaaagacaagatttgtatgactgtgaatcagcattataaaaacagcccttgcctcaaaaacctatactgagcaacacaaaacactgctttggggactggaagagatgataaaatgaggtgggaaacaaagggagtaagtgccttaagaaattttaagaatcatcctcaagaagactttacaaccaacctagaaaaatacaaaggtgcgaaccaacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggattaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcgattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaagatatttggtgaatgcattcatttttaattatgaaataacactgctatggtagcaagctcaagaccacaacatttccaagaatggagagttttatttcattaatttcaaaatactggttttggcaaggggaattaagtcattataataaaagacaaaccacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccctgtatctgtggttcttaatcagagaggagcttcagaatcacctagaaaattttcaaaattatgtgtttccagggaaaatgatttagtaagtctaagacccccatgcagctgtatttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaaaatttttttaaaaactccaaatgttctggaatataaatgtaattcatgtcacacccaacaatatataatattcagtaagctcttctatacgctaacagatacaagaaaactgctatttaaaaaaagaatgcaaaaaccaacctaggtttgagattttaatctgaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatctagtgacacagtagttcatcccagtgatggagcattcaactttttatttgtataaataacaaaaactagaatcaacactgcagatgagcatgatgaaagaaaagtatgcagtgtcagtaatgcatcctttttcaaattaaacaaatactgaggtcctattattatcagcatccttcagtcacaactatcctacacagaaagtgagctggctatcaacaagctttgaggaccatatatgaaacacatgcaagacagtttacccagcctatatactagttggggacaataaatatattttgttcactctaagacatcctaagcagttaactggcacatgttagttttcagtgcttgaagagactaccccaaaagaattaaatccacttctactttcaaaatattattagccaaaatcttaactcacaaattagctataacctaagagtaaagctaactcccaattacttagatgtataagtgggagagcaaagcagcttatttcaggtaacaaactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggcaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaaggatgatatcaaactgtagttgttaagagcacatactctggaccaggctgcctaggttctaatcccaactgtcacaacatgaacctgggtcatcttcttaacctctatgcctaagtttttcaatttcgagatggagataatcttgaaattatctcagtggaagtggtggtaggagggaaacgaagatcaaatgagagttttttaaccctttacccatggtttccctgctagccgcttgcttataatcatatataaacactaaagtcatacttccagaaataaaaacccttacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatacattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacagctgaaaaaccaaaccacatgcacacgtcaaagtttctgtaagttgaatcaataatgttcacataaacactggtttttccaatatgccaagtttttatgttgtgtctatattacataaatcttcaaaatatttacaaaaggagacaacctggttaactaagagtactaaactagaaatcaaagttcttaaacaaaaacggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttagccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatttcaaaataatttttactttaatccttaactcctaaaaagcgtttcttcctcttttctttcatttcacaaagatttaaatttgtatttcgcataacccaaaatgacgatgttatgaaggcccaaaacaaaattcacgatttcatatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaagaaataaaggaagggagacttgatgtgtattgctatcctcgcagcgagctattctgtgtcacccctgacgccaccgtacactcactccgccttccagcgcgctcccgcgcgcgcccgcccagccacctccaccacgcgcccgcgctgtccctgaggctccggcttaggcgcgaggacgcgcccattccccctcctcctccagcaggagaggccgcggcttccccaaccttcccaccctaacccaccgcacccaataggctggccgctcaagccgcccaggtcccgcactgcccctcttacccggccggccactgggccggcctcccttccctgccctagccgtccacacccacgcgtacagaggggccggggcctccctcaagctgcggcctcggcctcctccccgcgcggcagctggtgcctccccggccctacggggctcacgcgcacgacacagccacaagatgtccgctctgacggaactactgccagctgccacgctccgcccctccccctcctcctgcctcttcaccgccgcggatcagtccgccaacgccgccgtcccgagcacaggaccgatgtgaggccgaagccagacggcttgcttcccacgtccggggccgagtgaatacgtgtcaagcccttttccttctccttctcggaacagcaccttcttactaaacagatcggagattggaccaggagggcgggggagggaggaagatcatgagctggggggagggtgaacgagtggcggaaacccttaggctcagagaagcatcgagaaccggaaggagaccatgggaggaaggtaaaggaagcagccgctgcgcgatccagccccacgcccctccccacagcgtcccccagtttcctcacttggtatcgaggagacgactctcgcgagaacttcgtggctggctaaccgaagcggtagctctgcaatgacttaagagcagttttgtgcgcttttcctgacggggttccgcctccaaaatgcataagttctcgcgagacgcagtaaggcaccggctcgaactggggcgggccactgccaggaaagcaacgcccctgaatgcttatgccggtggttggtagaggaaatggaattccccagactggtaagagcgcgcgcagacacagccttgtctcacgcgcccaatcaggagcgtgtggtgggaggtgccaaggattaattaccagatacctttagtctagctcgagccgggattttgaggtttccggtggagcaggtgagcagtatttactcgcctgccctcctgggctggttatggtgtgggaggaggcgcccctcgagatgggaatagtagttttaaatagacccaggttggccgctcatcagcgctcccacgtgctgaagtctagtgcacgtctgaccctaagggagcaatactgagaacagcagggagcaggctgagtcaagctcaattgagtggatggggctaggacagagagagttaggggcagggttttcactggtctccgtaatcagtcgctgccgtccgccaaggtgtagatgtgggaacaagcttaaattctcaaactttagcttctgttgctgtgtttcagttcttgagccagaaagtgttgagactaattagttaattaggtagagtttagagtcagaaaaacaatacaatacttcctgaaatatccaagttgggaggtgggatttacctcagtaggattggcctgttttagtcaagggtttaaagtatggagacggcagttatgctctctagtgtatccttcaggcaaaagaaagaccttaatttttatgaggaatttaaaagtgggtaagcactgaccagcttaaggttttttaacattccttaatgaccccagttaccgaagtggagatcttcaattacttggaaaaataaacttgttttaaaaatacacttaatttgaaaactgttgcagaaagttttacctaataaaaacttaacacgtcaacaatgatgaatataagtagtctaatgtatactgttcaagtgaccatgtagtgtcactagtgaagcagtgtttctcaaactagtgtccataggaaccacctggggttttgttgaaaatacgactttgatttggtagggcagtggtggagcctgagagcctacatttctaactagctcccaggtgatacagatttttctcgtctgaaccaccccgtgagtagcaaagcactgaagtgcttacctcatggcctaactgctcatgaggctcacctcagtaacacctctggcccctccctcctccctgaataatctgtgttctctctcatagctagccagatatactaaaagcacaggactaggcatgaagatggagggaggaacccagattagttattgcttcccatttgcttgatattggcctggttagttatcttctaaccccgtttcttcaccgctaaagtaagtaataatgactgtcctttctcacagggtgattgtgtggttaaagtgtcataatatatgtgaaaggacactggagactctacagtgctgtataaatgtcagttattaaagtaaccagtcagacattaactggccatagtgtgaaacaaatgtatagtagtaatagtggccacgcctgtaatcccagcactttgggaggctgagacgggtggatcatatgagatcaggagttcgagaccagcctggccaaaacagtgaaaccccatctctactaaaaatacaaaaaattagctgggcgtagtggcgggcgcctgtaatcccagctgcttgggaggctgaggccggagaatcgcttgagcctggaaggcggaggttgcggtgggccaagatcactgcgacagagtgagaccctgtctcaaaaaaaaacaagaacaaaaaacaaaactaatatatatggagttctagattatccaagcttataaaggcaagtgattgtgtaatcacaaactcattattgttaggcagtgaagtaaattcattggttgattgggctttctgtttacaagtttgtatttgcataagtggacttacgtttctgcttatattttgccatggttaaaatcaaaagaaacatagcctagaagcattttgatgccttaggataaagcaggctaagattaagttaaattttaaaacattattcatgtacctgttgttacagagagcccactttacagttgcaaataaagttaaaacattttcattcatttaacttacttgaattacaatggtagagatgtcctcatttgaaacaagaaaggaaaataatcatgttttttatattgcagtcggaaataatgctaacaagaaaaaaattatggctgtaaatactgaaagaaaaatttacatttagaaattaataaaggtacaaaaatgttgaaaatttaattaactaaaaataatcccttccttaataaatactattttgaagtcctaaaaactttgtaaatatagtagatcagattatcttgcatgaattgacataaaacatgagaaaatagaaaggatcaagaaaattaaagctgggctggtggcttacgcctgtaatcccagcactttgtgaggccaaggtggaacgatcacttgagcccaggagtttgagaccagcctggataacatagggtgacccagtctctacaaaaataataaaacaattagctgagcatggtggtacacgcctatggtcccagctacttgggaggctgaggtgggaggattgcctcagcctgggaggttgaggctgcagtgagctgtgattgtgccactatactcaagcctgtgatggagcaagaccctgtctcagagaaaattactagtaaatgggcaattaatctaccaatctgaataatggtggtgtgccagggtcttattacatgaatttttcagtgaggccacgttattataataacttgagagtaaggggttaattagaatgtattgatgaataaacataattaacagattttatatatatgtacttaatattgtatctatgttttcatgtatctttaattttgttacagaatattataacttgccaaagacactggctctagtacagtgtataccattttattagttttattaaattgtaaatgctacggtccagattttatattcagaatgctcatttacatattctgcctggaccaagtaatttggagcccaggtcaaccaaatgttattttacattgtttgcacaaaaatcaaattgatttctatacttaacaattcagaatctcattaagtcaaattaatatggtttaagaaagtgtactttatttcatgctaagatgtcattttggccttaataaggcttttggcatgtaatgaagcatgcacaaatctttgagataaaaatagagcatttttccacacaaaaacatatatatacacaaatgttcagagtagggctattctactttttagtagaaacaactcaaatgtccatcagctgatgaatggataaagaagatgtgatatatgtgtataatggaatattattattattataaggaacaaagtactaatacatgttacaaaatgtatcttgaagccttaaaacattctgtcaagtgaaagagccagacacaaaaggccacatactgtttgattctgtttatgtgaaatgaccacaatagtgcattctgtcttccaaaaagctggtttacttacaaacacaggttaaaaaaatatatatttgtaatactgcttttggtgtagggtgaggcacgataaagagactttcattcggtttgtcaatcagtgatacttaggtctgaataggcaagtgggagtctttcaggtttaggacaaagaatgttaatgtagtagagatctgttgatagagtcactcctagttttctatttatttaaaaaacatcgaattactattaggtgctagacactgaagatacataaaagacacagatgtcatctataagaaagtctcttgaggagaccagtaagcatcagacaacatcatagagtgggttcagtgacataaatgtgtgcacagagcactattaatgtactgaactcagctggcggtggtcagggaaagtttctctgaggaagagagttgtattaaaacaaatgaaaaaaagggagcaaggcaaagttggaaaaaaattgtgagggaggctcctaggcagaggaaacagcatgcaaagtctcagagatgacttgataagtttttaaaactagaaaaactttggctgcagtattgcgaggttgaggtggcggggggagcggcaaggagagaatgagaagacagaaaagatgaggagacaagatagatttgaaagacatgactggagatcttgagggccttttattttgaaggggatgggatagaatggagaaattgaatttttaacaaaaatggcctgatcagatttgatggcaaaaaggtaactgtgatagcaatgttgaagcatgtgcccaaagtatgtattgggatggagactagaggcaagaaaaacaggatgttaatgaaataatcctgaagaaatgggagaaagatctgaaatagttgcactaataagagagagtacaggaagtaaacttagtttatttactgggtcaagcttgcctaaaaaatatttgggggcggggggaattctccctccagttacctttattagaatgttacaataaaatcaagccaggcacagtggcttatgcctgtaattccagcactttgggaggccaaagcaggaggattgcttgagtccaagagtttgagatcagcctgtgcaacatgatgaaactgtgtctctacaaaaaaattaggcatagtggcatgtgcctgtggtcccagctgctctggaagctgaggtgggaggatcccttgagcccagaaggtcaaggttgcagtgagccatgttgcagcagtgcactctagcctaggtgacagagtgagaccctgtctctcaaaaaaaaaaaaaaaaagtttatagaaaaacaaaatatgatattctaataaaataacttgaaacaatagtatgaacttcctatgtttttagctcttaaagaactacgaaactaaagtttacataacattggaaacatgtgctacatgtttttttttttttgcaaatcaaatctcctcttgaaactcaaatgtaggactaactgccacaatttcatttcttttaaatttggccatgtctgtactaactgctgtgatccatgtctcagttctcttaccactttactagaacctttgggagacttttgttcattctttgactgatatcatttggctttcaagtggccagaaaaaagaattcattatctatttctgttccatctgcctcagacaaaatactattatgtgttgccaacaagatcataaacctaaataaaacacaggttctaaaatcacatggcagtacttagtataagtgggtatcaaggtgactgggactgtgcttacagtaattatagattactaaaatcacaaaatggaaaaaagttcatgtagagaattcaaagaatttagtttgatgtagatagagattataacaatccttttgtcacatacctaaagtggaatttgttgagtttgaccttgtgacttttgagtcaagaaatgctaggcaggtagaacagataaattaataaacctgattctgaaatggaagtaaaagggctttaaagatgttagaagcattttaagattcattctcattctggatctcaggacataatttcttatagaaaagtagttgtgcctgcagatcaatccacaaaaggctttaaaacccaccctccctgtatatattacacctatgagaaaatgctccatagaattccaaattgataacaggaggaccgacctacccctctgcccgccagaattcccgtggctcagggcaagtactgaagccgaataggaagaattgactgagggtaaatcatgttgagtggttggttgaaagctttgaaaagttggagaatggtggttaagaaatctgtacattcagacttcttgaatgtcactgtatgttttgggttagtgctgggatacttttcttttttagtgccagatccattaatttacattcctctccactgccattatcaattgcttcctaacagaaaccagtaagctttctttttcccccttttctacagagaagagcagtttcacaagattcaacttttcttatacttttgttcctaaaacagatacacactctgttaagttttcataagggtttttatttctgcaagtatgactttagtgtttatatatgattataagcaggcagctagcagggaaaccatgggtaaaggattaaaaaactctcatttgatcctggtttccctcctaccaccacttcagcccccaatccctgcctaacaaattagacccaatagaaaaagtcacaagattgagggccgggtgtggtggtacatagctgtaatcccagcactttgggaggtcaaggcagggtggattgcttaaacccaggagttagagaccatcttgggcaacatggcaaaaccctgtctgtacagaaaataaaaaatcagcatggcgtggtggtatgcaccagtagtcccacatactagggaggctgaggtgggaggattacttgggcccaggaggtcaaggctgcagtgagctgtgatcaggccactgccctccagcctggatgacagagtgagaccctgtctggaaaaaaaaaaaagattcaactttttttttttttgtcttttgtttgttttgagacagggtctctctgttacccaagttggagtgcagtggcaccatcttggctcactgaagcctctgcctccagggctcaaggagtcctcccacctcagcctcctgagtagctgggactataggcatatgccactaggcccagctaatttttgaacttgcccacacagattctttccccttttccatccatctccaatccccactctctcaggataccctgatggctctgtgggtatccttagtgttcacttatcacagtctacagaaccaccagtctaatgaatataaaatattttaaattataatgaagaagcctcattatgagtaatagtaacatgtgaagcaaatacaatcagccctccagatctgtgagttccacatccatggattcaaccaaccacggatccaaaatacacatttttaattgcatattttctgaacatacatacttttttcttgttactgttccctagacaatacagtatatttacagtgtttacattgtactaagtattataagcaatctaaggaggatgtgtataagttatatgcaaatattatggcattttatatcatggatttaagcatccttggattttggtatctgagagtggttctggaaacaatccctcatggatactggaggatgactataatatgaagtatattagagataaacatataaagacaggcactcagaggagtggcttaccagcagacatgtaataaaaacatgagaatttcagttgcctgacatctctgtaagccagagatatgtgctttttggctgcccaaagaaactatttcagtttaaccctgaaagaaaggaactatgttgtctagcataaagcagttacctcttcctcatctctaccagttagaccacagctacattgttatgtttttaacagctttattgaaatataattgacatacaataaattatacatacctaaataaacagtttgataagctaacatatatatatatacccatgaagctcaccaaaatcaagataatgaacttcaccacaagtttccttatgctcttttataaatcctttctcttgttcttcccccacccctctgtcttcttaacccacaggacacctctgatctattttctgtcacggtaaattagtttgcattttctagagctgtattgaagttgaatcacaatacaacttcttgtctgccttttttcacttagcataattattttgagacttacctatattgttgtctctcagtagttcattatcttttattgctaaataatattccattgtatgtatttgccacaatttatccattcaccagtcagtggacatttggtttgtttccatttttttttttttttttttttttgagactgagtctcactctgtcacccaggctggagtgcagtggcgcaatcttggcttactgtaacctctgcctcctgggttcaaatgattctcctgtctcagcctcctgagtagctgggactataggcactcgccaccacgccggctaatttttttattttttagtagagacggggtttcaccatgttggccaggctggtctcgaactcctgacctcaggtgatccactcagctcagcctcccaaagtgctgggattataagagtgaggcactccgcctagcctcttccaatttttgtcttattacaaatagggctactacgaacattctttacagtgtttatatggacatatgttttcatttctcttgagtaagtagcttaggagtggaatagctagattatatggtagatatgtgtttaactttttaagaaactgccaaactttcccaagtgttttttaccactttatggtcccacaagctatgtatgagtgttccaatttctcctgactggttaggattagtcttttcaattttagccattgtaataggtgtgtagtggtatttcattgtcattttaatttgcattttcctagtgaccaatgatattggcattttttcatgtgcttctttgtcatccacatatcttctttgctgaaatgcctgtctgtatttttccccattgttcattgtattccttttgtcagtatttatttataggtgacacatatgggagtggccttaaatgttttttaactaataaagtcataacaaggtaacatatacctggaggaatatgaaaaagcatgacaaactttactttgcgagatagcaaaatttaagatttcactatataaatctgagtactaggtcaattttttttgtgggtttttgggtgaaacctgctagacagattctaaaagagcagtcacactatgtctattttttaaattattagctagcagaaccacctcaactcacattgactagtccctaagtcacttccacaattaagagtataggcagtagtgtgatagaactggcttgtaacagcttacaagggtcaatttaaaaattgtaggaattttgcaggctgattgttaaacacagccattattaaaaattatagaaactgacaattatattaaaatctgttaaataaagctcaataataaatactcaaaactcacttcctagttattttactatagacatacctaattttattgaacttcatggatatggtatattttacaagttgtaagtttgtggcagcccatattgtgcaagtttgtggtgccatttttccaacagcatgtgcctactttgttagtatgttttagcaataaagtattttttaattaaagtatgtacacaggccaggtgcaatggctcatgcctgtaatcccagcattttgggaggctgaggtgggaggatcgcttgggcccaggagtttgagacaagcttaggcaacacagtgatcctgtctctacaaaaaatttttcggctgggcgcagtggctcacgcctgtaatcccagcactttgggaggccaaggcgggcggatcacgaggtcaggagatcgagaccatcctggctaacatggtgaaaacccatctctactaaaaatacaaaaaaattagccaggcgtggtggcaggcacctgtagtcccagctactccggagaggctgaggcagaagaatggtgtgaacccgggaggcggagcttgcagtgagccgagattgcgccactgcactcaagcctgggtgacagagtgagactctgtctcaaaaaatatatacatatttttctaaaattttctaaaatagctgtagtctcagctatttgggaggctgaggtgggaggactgctgaaacctgggaggttgaggctgctgtgagccatggtcttgctgctgcactcctacctggtgacagagcaagactctgtctcaaaaaaaactgtgtacacttgttttagacataatgctattgcacatttaaatagtgtaaacataactttcatatgcactaggaaatggaaaaattcacgcgaactaaacccacagtatctctgaggtatgctataccttttactgtgttccgtgtttttgtggttatgtctattgtatctgcatggtggaagtattacagtttgatagtgtgcacctcttcccagctctgtgttcagtgatgttctttggaacatgacacagtaccacataggagtactttccccagggaaatttgaaaacaccacagatcagatctctgcctgctgctccctacttcaggctagttgttaaactttaccagcacacttgtgatgacatgacccttcaagttgactgacttctgtcagtaatgaataatcgaggcatcagttagatggagagtttacctttgtgaaacacttaactctcaaaaagaaatatttttgttacagaataaagcttgtaacacctagttttcttggtgttcaatgttttccttacttccaaattctctaaggtagagaaaggtaaagtctgactactggataaggggggatactaatacagtagttctgtggtctcaagtaaaagcgtaaaatattacatttgaagtagaactagaaaggatgctaaacaaaactgtgctgggcaaaaaaaaaaaaaaaaaaaaaaagaggaaaaggaaaggcaaatagctctatctaaccaaaattctattcatgtgagggagcaaaagatgatacaagaggagagtttcttctgacccccaaatcagctttttaatggatgaagctctttttgtccagagttactgaagcttctggatgttgttaggaatttaagttcccagacagattcagtaaaatactatagcagtccagagaaaaccaaataaacttgcagggagagggagggaagggaaattctaagtataaaagataaatctacagctaaggttgaatggctgttacaattaaatttttttaaaactaggagaaactgactaaggatttcaaatggaatagaaactgtcttacactttagggtctaaatgaaaggcatatacatttaaaatgtaaaagaaagaaatatatcatatgactttcttcttctttcttacttttttgagacagggtctcactctgtcacctaggctggaatgcaatggcgccatcatggctcactacagcctcaacctcacaggctcaagtgatcctcccacctcagccaccaccaccaaagagctaggactacagccgcttgccgccacacccagctaattttttttatcttttgtagaaacagggtttcaccatattgcccaggcttgtcttgaactcctgggatcaagcaacctgcccgcctcggcttcccaaagtgccatgattacagtgtgagctactgcacccggcctcatatgattttgaataaggcatttgctttatgctttacaaggtactagtagtaaaaactgtttagagtgatgtacataaagaacagttcagacacaaatgtaagacctgaagctataaaactactagaagaaaacaggtaaaccacttcaggacattgggtctaggcaaagattttatggctaagacctcaaaagcacaaacagcaaagacaaaaatagccaaattggactatattaaactaaaaagctcagcaaaggaaacagcagagtgaagagataacctgttgtatggaagaaaatatttacaaactattaatccaacaagggactaatgttgagagtatacaaggaacttaaaagtaaaacaaaaataaccccattaaaagtggtcaagcgatgtgaatagacatttctcagaagaagacacaaatgcccaataagtatatgaaaaatgtgtaatatcactaatcatcagaaagatgcaaatgaaaaccacagtaaggtatcacctatgacagagtggttattacgaaaataacagatgctggtaaggatgcagaagaaattcttttatactgtcagtgggattgtaaattaatacagcctctatggaaacacagtatttctcaaaaaactaaaagaactgccatatgatctgtcaatcccactaatgggtatttattcaaaggaaaagaaatcagttcaatgcagcactattcacagtggcaaagaacagaatcaacttacgtgtccgtcaacagatgaatggataaagaaaatgtgttacctatgcacaatgaatactattggccacaaaaaagaatgaaatcatttcctctgcagaaacatggaaggtactggagattattgtgttaagttaaataagccaggcacagaatgacaaatatcacatgttctctcattcatgtggaagctaaacatgttgatctcatggaggcagagagtagaatgatggttaccagaagctgggaaaggtgtctgggtgggaggggggatgaagagacgttggtgaatgggtacaaacatacagtgagatatggaacaaaggaatgtttaatagcagagtagggtaactatagctagtaacagtgaatgctttttgtattttaaaatagctaggagagaagacttgaaatgttcccagcacttagaaatgagaaatattcgaggtgatggataccccagtcaaggtaacaaaatagcccatatacctcataaatatgtaaactattatatatcgatttttttaaaagtatagcagtttgttacaaaaattagctgggcacggtggcaggcgcctgtagtcccagctactcaggaggctgaggcaggagaatcgcttgaacccaggaggcagaggttgctgcagtgagctgagatcatgccactgcactccagtctgggtgacagaacaagactcttttaaaaaaaaaaaaaagtatagcaatttggtattaaactggaaggaccaaaggacctaacaaataatctttaaaccagtcaatgccctatgtaacttgtttaccaataaattggacagaacagatggaactttagtgatacaggtggtttatttttaaatgaggagggaatacaaattccccaggagataacctctttctctaagaacataaagttttatgtaggagacagaacattctcatatgaaaaatacctaagaatatatgaaactaatatatgtaataggaagctattacatatattaatggtaacttagttgttcagtttttagttactgctgaacatcttgactatttaaataaatcactattttttccctaaccttgtccagatttctaaaactcagttactctcctaaccagtctacttaagtgaatatatttttccagtcatcaagactaagattcagtataatggagtcatctttgtctttcacccttccctttccttatgagtgtccatttctacttatttaggccttcaatgcatattacaccttaaattgtataacagtttatacattttaaaagattttcatcattatgtaatccctctgagttaagcagaagtgattaacatttcatcactcaagtatttattgagggcctacaaggtcactacaaggtgagtgacatataaataaggatgcagaatcaggcaggtcaaatgacttgcccaaggtgacaggatcagtgattattaccagtcttatgattctaatatcagcattcttttcattacactatgatgcctctcaactcatatttggtccattactataaattcatagtgggcttctctgcctctacttttccttctccagactatcttgcacatcaccattaaattaaacacagctttcattataatgtagcacaataaagaacttttcaatggtttcctattgtatagaggagaaaaactttatctctactttttacaggatatctctattaaactgtgatcctcatattcttttgaacatacttttacttttctaagagtatgcctttgcttttagcagtttaaccttctttgagtttcaagtccctaagtaatagttattaccgtagatctagatatttatgtaccaagcattatctatagactacatatatgcacaactaccttgtgtattttgactgagggagtaaagttttgatactaaaaaaaaaaaaaaaagagtcctctttgctgggtgaggtgcctcatgcctgtaatcccattgctttgggatgccaaagcaggagaatcacttgagaccaggagtttgagaccagcctgggcaacatagtgggaacctgtttctaccaaaacaaaaaacaaacaaacgctgggcatggtggtgcatgcctgtaatctcagctactcaaggaggctgaggtaggagaatcaattgaggccaggagttcaaagttgcagtgagctatgatgaggccagtgcactctagcctgagtgacagaaagcctgtcttaaaaaaaaaaaaacctcgagtttcacttctgataattaagaactcagtggttttgatcatacttctgctgtgaacaattaaaaaagctagaccaaaaccaaacaaacacccctgtttaaaggcacttgttagtgacaagttgtattttccactatcacaacaaagaaaaaggcaaaatatgtggcaggcgtctttagatttggagacaacaaaacatagtacaattgggtaagctgttcttagaggcttaactgtaactgtaagactaccagttttggccaggcgtggtggctcacgcctgtaatcccagcacttcgggaggctgaggtgggtggatcacctgaggtcactaaaaatacaaaaattagctggaagtggtggtgcatgcttgtaatcccagctactcaggaggctgaggcaggagaatcgcttgaacctgggaggcagaggttgcagtgagccgagatcttgccactgcactccagcgtgggcaacagaataagactccgtctcaaaattaccagttttgagtggggtagggcccagacttaggctttatgatcctgtagacccaatgatattagaagttaatgtaggagagatgttatatgaagcctctggcaagtttcagtgcaagaattacaacatagacccttaaggtttaggagtaaggccatatcttccttagccatgattttgtttcatttttttttttttatttgaaaagtacctcttgacttgctactggtacctggaagagatgtaacacctgaccatgggacatcaagtgactgtgtgaatcaaactgcccatcatgaattgttgttatttgactcatcaaactgtacaactggatgaacacaggagcagtgcactacatatgggactggaaccatgaatgagcaggtgactcagactcctatagtacctgcctctactccttcagcacttctccctcaacccacataaactgtcatcataatgagttccctctgaccagttaatggaagagaaaaaagtatggatgttatggatatcctaacatatttctggccattggacccctagaaacctgtggcaagagtcctggaagtttttcaaggttcatcttgcaccttctagcatgcatatgtcgtaccaaagcatgtagaatgctgcctacttctgctcttcagtttcatttaatataatttcattactctgataaatcagtgtgatgttctatggaataacaaaagaccgtcaaggtcccttcataccatatagagaacaggagagttgatgtagcctgagacaagacagtaaggacttactgttatccctcctatttaaacgtagtctgtttctgattctccttagaatgggggtggggggacatttccagatcaatatcagatcagtatcgtgtcaacatgggtattaatttcttccgaagaagataccacacctagaacagcaaccataattggcatccctacctaattaaagtttgcagtccactgtcattcttcactagccatctggtttttatattgtcattctctatgatgcatctggtggccacaggaaatttaaatgggaatgtggtatgaatcaccatggcagcatggtggcactaatctctgcaattcttttggtttttctattttgcttttttatgttttgtagaaatgcagtcttgccatgttatataggctggtctcaaactcctggtgtcaagcaatcctcctgccttggtccccctaagtgctggggttacaggcatgagccactgtgcctggccaatctctgcaatttcctcagggatatagccctgcttttcctttactatcttaatgaggagtggtagaaagcagacctaagctgctgtgtagcactttctaccataatagcaatccctccattgatcaggaaaccaaaataaagattgttgttaaaagatacatattaccactacacatctgggactggagaaatagccacagtatgggtccttctggatctactgttagccacagccaggccaagattccatcacttgacttccttaggttccctattctgaccagttgtccagggtagagttttgggtttctagtattagtacaagttaagagacagtgccttaagaattctagccagcctgggccgggcggtgggtcacacctgtaatctcagcactttgggaggccgaggtgggtggatcacgaggtcagcagatcgagaccatcctggataacatggtgaaaccctgtctctactaaaaatacaaaaaaatttacctaggcatggtggtgggcgcctgtagtcccagctacttgggaggctgaggcaggagaatggcgtgaacctgggaggcggggcttgcagtgagccgagatcgcgccactgcactccagcctgggcgacagagcaagattccatctcaaaaaaaaaaaaaaaaagaattctacccagcctggccaatatgacgaaaccccatctctaccaaaaacacagaaactagctgggagtgatggtgcatgcctgcagtcccagctatttgggaggtagaggttgcagtgagctgagattatgccactgcactccagcctgggtgacaacagagcaagaccttgtctcaaaaacaaaacaaaacaaaacaaagaattttggatattttcctttctctagtgaatggtcactggtccctatggaaaaggcttagggcaatgattcccccaacatatctgctcactggaagtatctggggaacttgaaaaaatactgatgcctgggtcttccctgagattactatttaattagtttgggttgtggcctgggctttagaatcctaaggtgttctaatgtacagacaagtttgagaaccccactggattagggaacaattcgttgtatacagctgtgattgcattgcccctttcgtcaaaggatccagtctctttccatcagtgaaggagtaccaagtctgggagctagatgagatgcttcaaattttactacaaaaccacaagaatttttccacctatatatgtcaagcagcaccttggtaggttactttattatatttccagggacctcatgatcatttagccattatcacttttccctgtgggtcaaactactctggttaacgttctctcctttgacttattttggtaattgtgcctactttgtctctgatatttatttatttatatttttatgttttttgagacagagtcttgctctgttgcccaggctgagtgcagtggtgtgatctcggctcactgcaacctccacttcccaggctcaagccattctcttgcctcagtctcctgagtagctgagaccacaggcatgcaccatcacacccagctaatttttgtatttttactagagatggggtttcaccctgttggccaggctggtctcggactcctggcctcaagtgatctgcctgcgttggcctcccaaagtgctgtgattacagacgtgagccactgtgtctgtcttgtctctgatatttatatgccattatgtggcctctactgccttaggattctaatgttcccactaagatcagctaactcagttccactacagggtttaccaccatcatctctcgcaaacaaagacagccacttcagagctcctaggaaatagtggtgctcccatcatcattgcattccttaatgacatggtgaaaattaacaatggctaaggagcctttgtgttttctcctctacaatatgcccaggaatttctggcattttggccatcttatttataggctattactgaatttaagcctcatcctaccaaattattaatgccaaaatattaactcttgattcttaggtgagtgcacccatgccaataaatttgccatgatctaaccttaaatgtattctcatatatgctgtccaagtttctgctgattaaaatggcaaggcctttagttctcctacataggttttctctctccagagaaggcctcaattctctgactaggctatgttgggatataactggaggcactaataggtagtagggtaaattctttattttattatttttggagacagggagggtcttgctttgttcagactggagtgcagtggtgtgatcatggctcattgcaactttgaactcctgggctcaagtgatcctcccacctcaaccttctgagtagctgggactacaggcgcaaaccaccatgcatggctaattaaatttttttttttttttagagacagagccttgctgtgttgcctaggctagtcttgaactcctgggctcaagcagtcctcccacctcagcctcccaaagggctgggattacaggcatgagctaccatgcctagccccagccggtaaattctgaggagagcatgtatcagcttgtgaaggagcttgcccaagtgcaatcactgaaagcctctatgcataggagcctggtttcctcagaaagagatttaggggaagattgatgttcagagttttcagcttcatttttctctgctcaaatgtccctatcgtatgtcttaggactcctctccccaccaatgttccagcattagaataggaaaggggaagaattaagcatgtaattgatactacaaatctaccatatctgcccagtgattacagaagataatcaactccttcagacctgtaatagagttctcatgctccacatacagtcattttctttttgttgttgtttatgatagtgtctcactccgtcgcccaggctggagtgcagttgtgcaatcaaggctcactgcaacctccacctcccaggttcaagcgattctcatgcctcagcctcccaagtagctaggactacaggtgtgcgccaccacacccagctaatttttgtattttttcatagagatggggttttaccatgttagtcaggctggtcttgaactcctggcctcaagtgatctacccacctcagcctcccaaagtgctgggattacaggtgtgagccaccgcacctggtcaccacatacagtcttaattgtagtttttatgtttttctttttcttatgtatttttcttttcttttcttttcgttagagatagggtcccactctatcacccaggctggagtgcagtggcatgatcatagcttacggcagcctcaaactcctgggcttagacaaccctcctgcctcagcctcctgagttgctgggataacaggtgtgtgccaccatgcgcagctaattaaaaaaaaatttttttagagatggggtcttgcagtgttgcccaggctggcctcaaactcctggcttcaagagatcctcccaccgtagcctcccaaataggggactacaggtattagccaccatgccccttaacccacgtatgcctagcgttccattattggaacgctaagcatgtgggaattatttatagcctactgctcaaggtcatcgccaaggtctgatttttcactcatgcaaaaattcaaaaaattgcaacctctggcacaaacgggttaagtactttctgtttcggaccataagaaaagccagatggatctataatctttataattaccatggttatcatggtgatacactcctcacctgcttcacttgatttcatgttgttactggtaatcctaatacaactgcaaactggctgggcacagtgactccttcctgtaatcccagcactttgggaggcaaaggcaggaggatcattggagctcaggagttcaagaccagcctggacaatatagtgagactctgtctctacaaaaaaagaaaaataggccgggcatggtggctcacacctgtaatcctagcactttgggaggccgaggtgggtgggtcacctgaggtcaggagttcaagaccagcctcgccaacgtggtgaaactctatctctactaaaaatacaaaaattagctgggcgtggtggtgggtgcctgttatcccagttactggggaggctgagacaggagaatcgcatgaacctgggaggcggaggatgcagtgagccgagatcacaccattgcactcaagcctgggtgacaagagcgaaactccatctcataaatgaataaaaaataaataaataggctgggtatggtagtgcacgcctatagtcccagctatttaggaggctgaggcaggaggattgcttgagcctaggaggttgaggctgcagtgagctatggtcgcaccactgcactccattctgggcaatagagtgagaccttgtctcaaaaaaaagtaaactaaatattgtaagccatggattacctgtagtctgtagtctctttccttataggaacgaggttattcctctgattgattttatgtgtgcctgtgtgtgtgtgtgtgtgtgtgtgtgtgtgtgtgtgtgtccaacccaatctcaaaatcttacttaagggtccatttcctgtaataacttctgttgcaaatcaccatatctttagagtcttaagaagaaatagaggacagattaaaaataatttaagaaggcttggcatggtggctcatgcatgtaatcccagcactttgagaagctgaggcaagaggatggcttgagcccaggagtttgagactagccgggacaacatggcaaaaccccacttctacaaaaaaaaaactagctgggtgtggtggcacacacctgtagtcccaggtacttgggaggctaaggtaggaggatcgcctgagcccaggaggttgaggctgcagtgagccctggttgtgccactacactgcaacttgggtgacagagtgagacccctgtctcaaaaaaaaaaaaaaaaaaaaaaggaaatatactggtaaaatgtattacattaataattttgtttatcaaggcaccattacaaaaagactaaccacaatgtaagaaaagatactggccacacatatatttgaccaagaactcatatccagaatatataaatgattcctaaaaatcagtaagaaaaagaatgacaacccaacagaaatatgggcaagtgactttaacaggcactacagaaaagatctccaaaatgtctctgaaggccatttttgtcaaaaacaaaaacatctccaaatgttaagtaccataaaatggtgctcaacttcaatggtcatcaagtaaaaggttaatgtcaaaatgagataccactacattcgcatcagaatgaccaaattaaaaagattgacaataccacgtgttgaccacagtgtggagaaagtgaaactttgtcacactgttgtggagcagtgacaggggacgggggacagggattgggtaaagtttccataaacttggaaaactgtcattctttacaaaatttgaaaatacatcaatgactaagcaactttaatcctaagtatatactcaacagaaatgtcttcacttgcatgtgaagagacatacagaagaatgcaccataattggttaatagctttaaagtggaaacagcccactgaaatatcaacaataaaatggataaatatattttatccatttaatagaatatagaagtgaatatgaacaaacgataaacaccacagatcattttcagaaatataatggtgaaaatatacattacataatttcattcatgtaagactcaaaactaggcaaaaatgatgtatggttagaaatcagaagagtggttacatttggggaacagtgacaggatagttactgggagctctcataagaaggtttctatttcctgggtgctggatacagggacactctgtgataaatcactcatttttgcatatatctatatttcaattttttaaaagggtggtccttaaaagattatgatttagggtttaccaccttgcccctctccatcaattcaaatatttcttccagttcagatcccacaccttacatgaagcctttcccaaccatttcagccagaaggaatttctctttcttcctggtttttatgccatgttctctgggaggtagtgtaatatagtggaaatagtataggctaaggaacttggactttaatctgtgtggcaataaagagcagaagagtgactcggtcagacttgtatctacctaccacaaatttaaccaattttacttatatttctctgtgaacaaatatgaaaatttatacacatatattaaatataaatatatagcttttataccacggaatactactcagccataaaaagaaatgaaataatggcattcacagcaacttggatggagttggagaccattattctaagtgaagtaactcaggaatggaaaaccaaacatcattatgttctcacttataagtgggagctaagctatgaagatgcaaaggcttaagaatgatacagtggacttgggaactttgttgggggcgggtgagaggggggtgagggataaaagactacgcattggctacagtgtacattgctcaggtgacaggtgcaccagaatctcagaaatcatcactaaagaacttatccatgtaaccaaaacccacctgttccccacaaactattgaaataaaaatttaagaatacataaaatgtgtaatttgtgagattgttacaatatttgccctcaataaatcatgcctactttgttcatgcatctttgcaatgtgcttttgccacttttcccatcaaaggctttatttccttaccccttgaatctagctatctttgtgacttgctttgaccacagaatgcaaatagatgtgactttgtacaacttcttagactaggtctagagaagcttcacagcttttttcaccgtttggaacactgcactgagaccactatgttataaatctgggagtgaaagacagtgtaaaggcagccacaggagtgaacacaggggagactaacagaactttctggccaaatcacagtgtggtgagagagaataaatcatgttgttttaagccactgttttggaatgcatgtgtaatgcagaagtagataatttgtaggaaacagagtcccttttccattacctagctcacctatttactctgttgtggcagagaatacaattatttcccaatgtcctttctcctcttcttcctttaatattagaacccccatttttttttgttttgttttgttttttgtttttttttttgagacggagtcttgctctgtctcccaggctggagtgcaatggtgtgatctcagctcactgcaacctctgctgcctgggttcaagcaattctcctgtctcagcctcccaagtagctgggactacaggtgcacgccaccacacctggctaatttttttgtatttttagtagagacggggtttcacagtattggtcaggctggtctcgaactcctgaccctcaggtgatccacccacctcagcctcccaaagtgctgggattacaggcgtgagccaccgtgcccggcagaacccccatatgttagctgggtacattgctacatggatagtgactataatttcctaactctcttgaaagtttggccatgtaactaggttttggcccatgggtcgtaagtggaaatggtggctccaacttctatgatacgcccttagaaagaagaggtatactcttttactatttcctgttctcaaatgtatcatggcaggagctggaactaccaccttaggccatgaaatagaagccacatattcacatattgagtagatcagattaaaaagctaaaagtagcttgagtacctaatatccagagctgctctatcagtcctgaaccgattatccttggactatgagagaaaaagaaatttacatcttatgtcattactattttgacctgagagcaagcaaacctataatcccaagtaatatgtgtttttcacattccctcgtatatatatgttcatgtatatatatacatttacaaatataaatatccatatgtgcacacacaaatatgtaaacatctctataggtattggtgtattttgttttacagattgagatcctgcacttttctccatctttttctcatttagcaatatctggaaatgacaactcatacaacttgaattcattccttttgatagctgtataatattttataggatgcaggagttgtaattcattctgctgttttcctactgattagctttcattttgttacccttttttccactatgaatatttttgtgaatagaaccttatgtatttctatagaacagattcccaagaatggtacagcaaggacaaaagatatctgtagcttaaaaaattttaatacaggttgtcagactgttttacgaataagttgaaaaatttcacatttatgccagctatctataacaatacccttttacttggacccctcaccagccatagttgctattggtcatttaacatttttcccagtctgaaaagatgtttcacctcacttgtgacaagagaaatgcatagtaaaattttactgagattaaacatttctgcttattagtcccaaatccaacagtttgaataacatactctaataacaatgctgtgggggcactctcatctgtttatacagcacctatggagagaaatttggcaatatctgtcaaaattacacacaaacacacacatctttttttttttttttttttttttttttttttttgagacggagtctcgctctgtcgcccaggctggagtgcagtggcgggatctcggctcattgcaagctccgcctcccgggttcacgccattctcctgcctcagcctcccgagtagctgggactacaggcgcccgccactacacacacatctttaacttagcaatctcttttctgtgaatttatccagcagatatcttgaacatgagacaaaattatgtacattattattcaatgatactgtttttaaaagctgaagactgaaaacaatgtccatgtccatcataaggtctagtaaaataagttctggcattcatgtagtggaatactaagcagccattaaaagataaggaatctcattatggagttacataaataattctaagatatattgtaaactaatatatgtaggacagtgtatatattgttatctttatttttaaaatggagaataatataaatttgtatttttctgtaaaatatctgggaaggtatgcaaaaaactaataaaagtattaatgggataggtggtggtgttatgagaaattggtgaacaggagatcatgggagactgaaacgcaaaacatctgtctctctctacacatacagtatctgaatgaactatctattcaaaaaggaaagaaaaatagctcctatagagtgaattcaatttcgcctactgtgagttttatgatcctcactttcatcaactgaataaaagggataagatccacttcaaagtactttctgaacactaaattagaggtgtgcttagctcagtgtctgtccatattaggcactcagtaaatgttagttgaattaaaaaaaaattgtcagtctgttagactaactggcatcttattattttaattttcattttcctgatttctcctgattctgagcctcttttcatatttggatttattattctctgaattcatattatttgcccatccattcttctgttgaattgcttgttcccttgatgtgaatttctgagttccctgattaaacctccttgcaaatatttttctaaatttgttgtgtatctattaatttcgtttagattttttttgcaaacaaatgttatttttatattgacaaatgtgtatattttttaaggataatgtatattctgctgttcttacatgaagtattctataaatgtcaactagatccagtagattaatgatactacagttcaatttttactgattttctgcctgctggatgaattattgaaagagagatattgaagtctctgtgatactggatttgtctatttctcttcgtggttctatcagtttttgccttacacattttaatgctgttaggtgcatatatgttaaagattgttttatctttttggagaatttacctctatacttatgtaatgcttctctctatccctgacagttttcctttttctgaaatctgctttgtctgacaatatagcaactccagctttctttttattagttttagcatggcagatctttctttatttacttttcacctatctatgtctttatatttaaagtgagtttcttacatatggttcctgaaaaaatgaaaaactagtaaaggctgttgtcttcctccctccaaatcaaccctgagtaacaacagaaacaagaaggaagcaaaagcttgaggaataagatcaaaaacttaagaggaaaccatagttagtgttaggagtaagttctgaaatactgttttgccatgccccactttgctttgggacaatcagtgccaaactactgattgctacagaaatcaccagcaacagatcaggcttcctgtaggattagataaagggtctgttgaagtgagttgccaatgaaaaagtggggctgaccagatactatagaatattggggcattcacccctccactccttccctgctgccagaattttgataaattataacagccttctgctgctggattgtggatttcaacacagatccttactagagaaacagtagcaaagagagagcatcagttctgtggttgcctacagctcttgctttctgctccttaaacttgtgggaagggataaaaacgagggtctgccattttgctctacctttctatccattattagaaggggtagtagataacactaggagaacatggcttgtgaaccaaaatatctagacacctgaggagtatgatcactatcaaacacaacaaattctacaacatgtaccaacagaagtagaataataggatataccaatacttttaataactcaattattcattcaacacaatttgtaaagatacagggtctcactctgttgcccaagctggagcaatcatagttcacttcatgcagccttgaactcttgggctcaagcaatcctcctgcctcagccttcttgctagctgggattacaggtgtgtgccaccacacccacctaatttttagaatattgtttatagagacgaggtcttgcaacgtttcccaggctgcttcaaacacctggcctcaagcaatcatcctgccttggcctcctgaagtgctgtgattacaagcatgagccattgtgcccagttcattcagcagttttttactgaacacctaccaagtgtcaggtactaaggattcatcagtcaacaagataggtaaataattttgttcatgtgggacatggcaagggggacagagacaaaaagatacaaattaactaaataataaacaattttggaaggtaatatttactaccaaaacaatgcagagtaggtagattgggactgatgaaagggttgccattttaaaatgaaacccatcctaaaataggagccacaaagatgcagggttgcggtgaggctggtaatatgtgaagagtgaacaagaaaccataaagccatatgagattattaggtgtggaaaaatatgagctaaaataaggatcatagctgggcatggtggctcatgcctgtactcccagcattgtgaaaggcctaggcaggcaaatcacttaaggccaggagttcaagaccagcctcgctaacatggcaaaactctgtctctactaaaaatacaaaaattagccaggcatggtggcacaagcctgtgatcccagctactcggaaggctgaggcaccaaaaatttcttgcaactgggaggcagaggctgcagtgagctgagattgcgccactgcactcccgtctgggcaacagagcaagacggtctcaaaaataataatgaataaaaaattaaaaaataaagaacatcatagataaatagcaggtggattggatcttatgatgcttttgagatacagaattttaatatttttgtgcagttaaaatctctagaacttttcctttgtgctttctagtgctttcatgctttgaaaaaacctttttatccagagatatttttaggttgataattaaaatatttaaaatcataatattcgtatatggaaagaaattcaaacaaaataagatactagaaagtaaaaggcctcatctactgtctctcctcctttcctcagaagttatcatttttctaggtatccttctagaaatgttctatgtataatcaaatacatgtaatttttaaaatttataaataggatactatacatactttctacaatttgcttttttcattcacacatatggccctactccagagattgaggttttaaatatcaggaagaattttatttagaaggcaaaactacagagacaaaagataattggttacccaggggtataagttaggtaggggtaaataggtggagcatagggcacttatagggtaataaaatgattatgtatgctactattatggtggacacatgacactatgcagttgtcaaaattgatagaactatacagcacagagtgacccctaatgttaactatggattttagttaataatgtagcagtactggttcatcagttgtgacaaatgtaccacactaatgcaggatattaataggagaaatggtgtgtgttgggttagagggtgacatatgggaatctgtattttctgccctgttcttctgtaaatttaaagctattctttaaaaagtctttgaaaaaacttcatttagaaaaactattcttaaagctttgtatagaatattttaaagttggaggctagaggtcacatatctggtagactgttgctatggcccaaacataaaataataaaggactatactatggtagcaaataaaattactttgaataggtttgctaatacctaagaaaatttcacattagaaattgagtggaatttaaagtttctaatataaagaaatcatgtgtcaaacatagtgttaatcaaaaataggaaaaaacaatatgcataaaaattatgagaacaaaaggaaatgtggctgaaaagatgctaatagccataacatgttgaatatgttgtttctttttaaagttaacatgacacagaggaaccaggaaatgcgtctactgcatttagttttatttatgttcttaaattgtttatttccagatttctgtaacatgtatatatatttttaaattcaattttattttgtgtgtgtgtgtgatggagtatcactccctcgcctaggctggagtgcagtgctgcgatctcagcttattacaacctctgcctcccgggttcaagcaattcttctgcctcagcctcctgagtagctaggattacaggcatgcaccaccacgcctggctaatttttttgtatttagtagagacagggtttcaccatgttggccaggctgatctcgaactcctgacctcgtgatccacctgccttggcctcccaaagtgctggggttacaggcatgagccaccgtgcccggcctgtattttcttaaaagatcagccattaccaagttattattggatgcctttaatctcttttgttagtgtatccatattccaataaaaatttatttataaaaacaggcagtggtctgctctataggatcttgcactaataagttactttaattctttaaggttgtcttgagaattaaaacacataatgtacaaataaaacaccatgatttggcatatagtaagcacttgaaaatagtagtggctattttattaaaatagtgtgttatcatacagctcaaaatgctgataagatgaatctgaaattcagacttaaaagtatttttattatagtaacaaggttatatttgggattttaagttttgttctaccaccagtggtagtttaaggcttcttgtataacggttctttgtgatgtttttcttgtcagagacacgtgtgatgaactcttgggacatgttccactacttggggatcctggtatttccttgctcagttttcacaagaaataggtttggcatctctaggagtatcaaatgaagatgttcagaaacgacacaaggtgtcgtttaaagtttaaagtcattttcgactttaaaaaatattctattgatatccattaataatgtagtaaaagcttccaagttactataaagtaatggttctggaaagagcatgttaatttaaaaaaataactactttaggtatgattgacatgtaaagctgtatatattgtatataatacaattagtttggggatacattctaatcatttatgataataacaacttagatctcatacaaaaactcgacactttaactcatctgtcctctcccacattgttatcgatgtcaaaatttacatttttatattgtgcatcaattaacaaattactgtagctatagttatttttaatacttttaactcagagttaaaaatgattttatgtatcaccattacattacagtattctgaatgtaactctatacttccctttaccagggagtttcatactttcacgttttcatgttgctaattagcatcctttagtttccacttgaagtacttcaactttagtttcagttttagcatttcttgtgaggcaggtctagtggtgatgaactccctcagcttttgtttttgtggaaaagtcttcatctttccttttctgaatgacagctttgtgggtaaattattcttagttgggaggcttttcttttctttcagtattttgagtatatcatcccattctcttctggcttgcaaggtttgctgaaaaacctgctgaaagtcttataggagctcccttgtacatgacaagttgctttcctctgctgctttcaaattcttcgtcattaacttttgaaaatttgatcacaatgtgtctcagtgaaaaaattttcatatcagacaggtaatgtgccagtgttttggcaaggtctgagaaaggcacatcttacacaatggtatgaaaacccaatcatcatgcttatgaaccacaaaaagatcaatgaagacatctttatgttcaacctacatggaattctttgggaattgtggatctggatgttcattttcctccccagatttgggcagttttctgctattatttctttaaataagcaatctgcctcctttctctttctctgcttgctctaccacttctataatgcgcatattggtttagagtcctgtaggcttactttattatttttcctctttgttcctttgactggataatatcaaatgatctgtcttcaagttcattgattcttctttctgcttgattcaatctgccactgaagctcacttttgaatttttcagttcagttattgtgttctttagtttcagaatttgatttgtttttttttttgatatggagtctcgctctgtcacccaggctggagtgcagtggcgcgatctcagctcactgcaagctctgcctcccgggttcacaccattctcctgcctcagcctcctgagtagctgggactacaggcacccaccaccattcctggctaattttttttgtaattttagtagagacggcgtttcaccatgttagccaggatggtctcgatctcctaacctcatgatccacacgcctcggcctcccaaagcactgggattacaggcgtgagccaccgcgcccagccagaatttgattgtttagtggtttctttgttgaaattctcatttgttcatgtattgttttcctgatttcgtttagctcactgagattcaaggtgagtgttctgaattctttatcaggtaatttataggtctctgtttctttggggtcaactgctagaactttaatttgttcctttggttgtcatgttttcttggtgtgtgtgtgtgtgtgttcaactgctagaactttaattcctttggttgtcatgttttcctggtgtgtgtgtgtgtgtgtgtgtgtgtgtgttcttttaagccttgtcttctaactttgcatctgaagaaagagtcacttcctccagtctttactgactagcttcagaagggaaagacgttcaccagtcagcctgactagagattctgaaggtctctcagaccttttctatgatatgcccattccattcctcttgttctgtcttgggaggggaagtcttaggattgtgtgctttctttcaatctcacaaagctagactatgtgctgagaacctccttttattttctctagtgcagtgcctcagagtgttcaaggttgtgtgctttcttccaatccagcaggagccagttgctgatatctgtgtgctatctgctggggcctgcatacactatctgcaggggaggttgggctgctggctagtgggtgggtgcatggagtgctgggtgtgcttgtcagttgaggggttctgcaggtgaagtgtcctgtagggctcatgggtgagcctatggtggagtctgcaagccagttaggagactccacatctagctctgaagaatcatgtgttggttgctataagcctctgcttcttttcccttctcctagatattcctagactattcatctgtgaagagtccctcagtattctggatagggaaaaacagaagtgagccttttgggcggcaacacgcaaggctagggaagctgggcactcacttgactcttactttccttcctgggagaactcatgggccaaaagggcctctcttggcactgaactctgctgccttggaggagaaggatgtaggtaaagtgaaactgtttttcttaccctcttcaatgtgtctattcttgagtttttcattctactggggtgctggaacctcttagcaggtctcccaggctcccaaaatggtatttggtatttctgcaggggtttgagggctggaacctactaatccaccaacttgctgatgtcagtcagggtgcctttaatctgaatagtattatttcacacagaatgctatctctgagtttagtagctcagaggcaaaatataaacagttaaatatataaagtaacattattaaatctcacatttattctgtgcacaactacaatatcgcaaagcattatgcaggttccttcttcatgcctagttcatcggtgcttggagtagctagttccataaacttctgaggtaataagaatctgccttgttattttattatttaatgactatatttatagattacagtaaccatggaatttctaaggcaaaaaagatggcttccaaaatagcaaaagaaacttcaaagatctatggaattaagcttttaattatgcacatatgcatatacaattatgtatatcatatatgtgctttgtaaccataatcttttgtctagtcaatgactgcaaaagtggtatgtcagtatacacttacagaattatagaaaagagaagctttcttcagagctcactctattctatcatgtgtttgcttgtttatttatttattatggattgactgacagggtctcactctgttgctcaggctggggtgcagaggcataatcatacctcactgtaaccttaaactcctggcctgaggtgatcctcccaccttggctatatagataattctatatactgttagtttttagtaccacaaagtgttatggaaggtgatttcaaaatagtttcgccatgttattgatttatagatcccagttttgtttctttagttttccatttatttctagtttgctggacttcctcttaaaactgtggggttaaggcaaggcagttccaaatgtagttcctcatacacaaaggggaagtaagaacaccaaacaccaaaatcaaaatgttctaataaaaaaagtttatctctttaaaatgttgaatagacagatttaataataattcttttttaaaaaaaattgattagtttctcatatgataatcattattttaaccccaacctatagtccactgtaagtatccttttaatttgttaaagcatattagttgttccattaatttcatctacttttccaatccatcaatctgtgattccttttacctttctcttattttgggtttcttataccttgatcaaatgtcctactttttcttagtttattcctcatttaggtggaacacatcctctattagctttctgagaagagaatgcgtagattgtgtattttttaaaccttttaggtttgaaaatgagtttattgtagtttcacaatgggttcttggtttggattggtatagaattctaaattataggtagtttttcttcagatattttaagaattgccctttaactaccagagctactgttaagaagtccagtacatttaacttttgtagtatgtgtctcagtctgtttgggttgctgtaaaggaatacctgaggttgggtcatttatttaaataagaggtttatttggctcatggttctgcaggctgtacaagaagcatgatgccagtatctgcttcttgtgaaatcttcagactgcttacactgagggcagaaggcaagaggaacccatgaatacacagttcacatggtgagagagaaaggccagaagtgaggggtatgggtatgcccaggcttctttgtttttctttgttttttttttctttttttgagacagagtctcactctgtggcccatgctggagtgcagtggcacaatcttggctcatagcaacctccgtctcccaggatcaagcgattctcctgcctcagcctcccaagtagctgggattacaggtgtgtgccaccacacccagctaatttttgtatttttagtagagatggggtttcactatgttggccagtctggtctcgaactcctgacgtcaggtgagccacccaccttggcctcccaaagtgccgggattacaggcgtgagccaccgagcccggccccaggctctttttaacaactacctctcacaggagcgaacagagtaagaactaattatcacaaggactataccaaaccattcaggagggaaccacccctatgacccaaacacctcccactaggccctaccaacaacattggggatcaaatttctttttcttttttgagacagtctcactctgtgacccaggctggttgcagtggtacaatctcagctcactgcaacctccatctcccgggttcaagtgattctcatgcctcagccacctgagtagctggggttacaggtatgtgctaccacacctggctaatttttgtatttttagtagagatggggtttcaccatgttggccaggctggtcttgaactcctggtctcaagtgatctgcccagctcagcctcccaaagtgctgggattacagacgtgggtcaccgtgcccagctgggatcaaatttcaatatgagacttggaggggtcaaacaaaccacatctagagaaagagctccagaaatctgcatggggttccttaagcattttatattaataacaatcttacatactcaatagccatgttattagtattgacacattacataattacattgatcatgtagatctagaccaaccactgtgaaaaaaacaaggtgcagctaataataaaaaagatgagttgataatgaggtaaaaaaaatgatgaagatgaaatatcatactaactatgcatgtatatgtgccaggtactgttttaattgctatctatgtcttaattcagtgaatatacacaacacaaccttaagatgtaggtattacctacatttttacaggttatataatttatcctagtagaatcagaattgtagtctaaacagtgtggctccaagagtctacagtcttaactataatgctgtatgtaattccttgcagtaagtagacagtagtagtgttttgttatattgttattaaatgccctttcttgaccaaataaaaaattggcaaacctatcttgacttcccaatttaaaaatttattggctgatgaaatctaaaagcctggaaatcatcaatttatagggccagtaaagaacaaaaaaaattaaaatttgagaagtaactgatggagcaaggtcttaaagggattcagctctagaatacagggagcagttagatttggagaacagaacaaaagctaaatatagaagggattatgaccaagtagagatgatggtgagaaaagcttctctagtaactaaaaatcaaggtcatctgagctcaaaataagcctggtaatgttaatagaagacataattattaatataaaatagtgaagatttgaacaacttttgtcaggaatgagaaaaataaataaatccaggaatgggctgacagagcagaaaaagacagggtttcaaaactaaatcaaagaatgtttagtggcagtaaaaatgtaccagaatgtgagattgtggtcaccagtaaaattgctgaatttaaggtctgaaagccagagtaaagggtcattcattgatggtaaagacgataatgataataaccattcattgagtatattacaaaattaattgtatctagtcataaccactggtatcaccatatcaaagagaagaaaactgaggccctaattaattttcagtaaaaagttaagtttttcatacaacttgacaagaggactctgaaattcacagagtagtaacaaggccaggcattcacaatgcaatttgaagaaaacaggtggggaagcttatcttgctagatattaacacttacttatatagttgtagcaattatgacagtatggtattgttatagaggttatacaaatacagcaatggaagagaataagcaacccaggatgtgtggaaacctgatttgagataagtgacattacaaaccacaaaaacaagtttaactcttcaataaatggtgctagaacatagttgtttgtatgtaaaataataacaaatgagagtagatccctttctcatgcacaaaaagtaagtactgggttgagtaaagccctaatatgaagaatataagtttaaaacttttagcaaaaacacaggtgaatacctttgtgatttaggggtagaaaaagatttcttaaacaagactcccagaacacaaattgtaaagaaaaagatgaataaatttgactacacccaaaccaaatttcagtataaaaacagacatacacggtcaggcacggtggctcacgcctgtaatcccagcactttgggaggcagaggcaggtggatcatgaggtcaggagttcaagaccagcctggcaaatatggtgaaacctcgtctctactaaaaatacaaaaattagccgggagtggtggcgggcgcctgtagtcccagctacatggaaggctgaggcaggagaatcacttgaacctgggaggcagaggttatagtgagctgagatcgcgccattgcactccagcctgggcaacagagactctgtctcaaccaaaaaaaaaaaaaaaaaaaagacatacactaggagaagataagcaacaggaaaagataagcaaccaatgtaaccaacaaggtaatattttccagaaaacatgtaccagtgaaactgatgaacaaaccaatagcacagtgggcaaagatgtcaagagcagactagtaggcatttggaattagactcctagaattaagattagcctaaagaaatctgggctggaaatagagatttgggctatatcttaacgatcatatttgaatttggggcactggatgacctaatgggaaaaaaacatgaaagaaataaaagtcttgggcctagctaggacaggcagaagatgagtgatccaagctcaagtgcttgaaagtaaataatgactcctttaactgtatttacatatttatcttgagttttctgaccacagtttctttatgtcttttaaagatggagtctaaaaacactatcgcataaggtggtcagataagcctattacatctatttagagcaatattatctttagaccatgtttcatgtgcagccaagaaggcagggttgtggaaatgaaatacaaatataaatgaaaacaggatttaaattttaagtaaagggaatttaagaaaatattccttttaagtggataataaggatttttaaattggtggagttaggaattatctcctattacacattcgcatagctcatgtaatgcatcagaatacctaatatatgatccacaccttttctctgaatttcaaggcctcccaaaaaagttttatccatatagacttgcattcactacattttttctacttgaaaatagcaaaccagctattcacataaactgctaagaggaagtaagccaaccataaaaaattacatactgtaaaattacttatatgtgagggtcaaaaacatgcacagcaatacagaatagtagtaatggtggtggatgtggttggaagggtcgctttttaaaaacgcctctattgaacattctgtatattgatgtgggtggtggttacctggaactgtacatttggcatttgagcattttactatatctttaaattgaggtatgtattttttaattctttaaagaaaaactgcttggaggtcttattcttaatgcacaacaatcacaaacattaaatttatacagtccagagaatgtaaagttgctttaaaaaaattctttccttttctcactttaaaataccaaggggaaaaattaaactcaacacagcacgtcttgcccttgtcaagatgacagatcctctaagagaagaaacgaataggtaatggccttttccagattttcttttcctaatgtaccccacttccaacctacccctacctcaactagggtatctagttgtacccaagggtgcttctacattagatccacagagattaaagataacagttaacagaatagtccagaggacaaggatattcaagttccatcatcttcaggataaaaaagctccagggtttacctccaaactctctctaaaggaaatcccatcaaccttttaaacatcactttgtatacaccatcttctgtactgccctagctcaaaaacatgaacctgtatctaaacgtgtttgtagaatttccattgtaagttttactttaacaattttgaacaattataatgatagaaaattatttaatctagattttggtcaactctattactgatattcttttttagtgaaggacaatcacaaacactaaatttatacagtccagagaatgaaagattgctttaaaaaattccttccttttctcactgtaaaataaaaataccaaggggaaaaatggaaagtatttattataactggctgttacactgtcatacacaatgaaatactggaccattagcagttcgttattatatgttgttaagtgtagaactgtaaataatgaggcatattattaagatatcacacacattatccaatcagcaagtgcacaacttcggacattttgacttcagccaaaatatgaaacaaagtcatagcaagaaagttatttcaagggagtgaaattttctcctcttacccttcaaatcttttagagatattaataaaaacaactatccagcctgggcgatataatgggactccatctacatacacacaaaaatttttaaaattcgttgggtgtggcagcacacgcctgtaaacccagctacttggaaggctgaggcagaaggatcccttaagccggagttagagtctgcggtgagctatgatctgaccactgcactacagcctgggcgatagagcgaaaccttgtaacaacaacaacaacaacaaaattaaaaccttcaagatcaagcttgcccaacaggatggctttgaatgccactcaatgcaaatctgtaaactttcttaaaactttatgaaaaaaaatttttttttagctcattagctaccattagtgttagtgtatttatgtgtggcccaagacaattcttcttccagtgtggcctagggaagccataaggaccccctgcgctagacttcagcagaagccttgtaacataaagaaaaccatacataaggctttagattctttttttttttttttttttttgtgacggagtcttgctctgtctcccaggctagagtgcagtggcacattctcggctcactgcaacctccgcctccctggttcaagcgattctcctgcctcagtctcccgagtagctgggacaggcacctgccaccgcgcccggctaatttttctatttttagtagagacggggtttcaccatcttgacctggctggcctcgaactcctgacctcgtgatccacccgcctcggcctccctaagtgctgggattacagacgtgagccaccgcgcccggccagctttggattcttttaccactttcccgaaggaaaaggaactgaaaatatctaaggaaggactactacgaatcttctctgagtggcaaaaaccagaggtttttggagctagggctgcagttaagttgccaaggggcagagatgtaaacagttcctggtttagttaaaatattttaatttttatttttttaagcctggcctttgggtgaaggagtaaaattaggcactggggtctgggtagggggaggatactcatgggcgagtatgcaaccctagggccacagcaaccaaactgtaggggaagaggcggggcgagaggggacgaagtagagacagcaagagactcacttttgaaaggcactttcggttagaaagcattctcacatgcttatctcatcgcacacagtatcctttctgctggtctccagcatctacagacgttaaaggcccaagaggagggccaccttcacacgagattcc

SEQ ID NO: 2078 - DNA, 31260 bp, Homo sapiens
atccaatagcattgacttttattcattcatgttaagtcacctgaaatgatatctgttgcatttaaatgctcattaatgtaaatggctgaacaaatccatttcaatggatactcaatatcccacatagataagtcacttcaacacagcctcatgacaactcccacaccaaaacagtactttattttgcaaattttgacccattattactcccatgttgttttttttcagctgtcaagtgtacaaggtgaagagaaatttcagttagacaggggctgcacctggaaaataaatttcttaaactccataaacacatttcaaaactgctgggtcccaaaagtccatctatgaactctagggctgccagtatcatgtgcagcacattaaagctacactatccaaatagcttattaattctgcataaatcaggtcaagcaatgtgtcaacctgtaacagactgtgcactttaactgaacatggcaaaatattcactctttcgaactttacatcatcatttgatgtcaaacaatgaagcaaatcccaacagtatatacaaaaaacagctttgcatttacaaaagattgtttcccatactgattaatccaggcagctaactcattggtttatgcaactttattgaagaaaaataaatcaattactagcagagctattagttgatcactcatccattgacaacttgcatcatttattcagtgctatattaaacagtgtattggaagatagattaactaatagctccaagcctcctaacaatttaaatgaaaattacaaaatgtttgagaccctattttggaatacaaagggtgtttgacttccaatttccattctctgtagaacaagaacaggtcattcctttattgacatgcataaaatacatcacattttctgttctgctgatgctataaattcaataccaattctccagccacatcagttatgagcataaagcatatcatgtaacctcaaatctctaacagtggaaggcttaaacaagaatggatgctgctagaataatgctgtatcctttgatgtgacaactgagcatccatctccctccccctcagatgatttcttcagcatgttagagcagtgaggaatggttttagtctcataaccaagttagagtgaagacattggccacataatacacatgctccatttttttttttaaaaattctgagtcttgggcaactgttctcttgtaactactttacagtttctaaaagcagttattgtccaaagctggaagaacttaagtcttctcagatgagcatgtgaatgaatggagggaggtaaacaaaaaataaaattaaaaaagatgaggtctgataggggagcagccggataagaaaatcaaaaaaggaacagtaatttaaagtttattccagctataatgcaggttattctgactttaaggtagcatcacatggcatacttctgagtccattcccgagatattctgttgtacctgtaaataaagatgttatttttaaaagttaaaataaagaattcctaatactttaaatggaagggaaagatttccattttatcatctccagactcatcatgaagtcatctctaatgactatgattagaataaaagccaacaagggagaaatagcactggtactcaaagcaatgtgggaaatgagagcctgatgctctgaaagtagtattttaaaaacaactaagaaagcagcactgaaaattgggaggctaacaaaaatcaaaagaccctttctttctctaccaccgagctcatgctctaattttaacgtgaagaaatttttacagttcattatggacaaatgttaaaatagtatacacattctatctatccacagaaatttccaccaaggccagaactaggcttttactagaacaattttatctgaatcctagagtttgggaaattacttggtcctggatattacaagaaaaaatggctttgggacttaggtagaggcagaaggggaagatgacactgggcagaatgacaaagggcagtaattttcaaaaggggtgtgtgtgtgagtggttgtgttcatcagaatcacgtgttacttttaataagtgtggtaactgaggctaataagcaccactgagacctgttgagtacaacaagggcatcttcgtttaaaaagatcaacaggtaattcacacacaagcaaggttattactcaggaagactactaacattgataaatactatcagcttccccctggattatactcatgccatagactacttacaacaacaaaaaacagtgataaccttaagaaaggaatatatatatatatatatatatatatatatatatatatatatatatgcacaggagaatttttatattgtttaaatattaactagctttatttcaaaccaagaaccaaatatggtccaacaacttttctaaactttttaaaaagttctttctaccaattcattgtcatctcctaaggatactctctcaaaaagccagcactttaaaacaaaggctttatttagcatacagggagccacaaagtacagctgacgctaatgcatgcttgtcagtaatgaacatttagtttagatgcttaggcttaaaagtgtttttcccttacattactatctcctggcaaaatttgaactaaaccaccacattctgtataggattggtacaaagtctcaagctaaaatttaaacaccatgatagtttgaaaaaaaaaaaagatactacataaattcccatttcttactagtgctattgtaactgctttgccatgcaatactttcaagcagtaacggctaccagatatttactttcacgttaaacagagaccaagcagttaaatgtacagttttcagaagactgccatatttgttaccttttgttagttaatacagtgccttaacgcatgcagcactcaagtgctggcagtaccataataagcgcaccatagagtgcagatcctcttaccctacaacatagcgtatttctctgtccactctcttgctaacctattgtacctaattgaacaagtacacttagcattaattataacatatgaaagttataatggttaagttgaacataaatataattcaaatatttgagaaatttagaccaaatttttacaatagtactaacatttttggaaaaacatgcttggggtaaagaaaaatttgctttcttccccaaaagttgagaataaagtgatactgtttaacacgctaggaaaaaaaaaacaacaataaaacattttagaggggagcattcactgtcacataagctaaagcctagttaagtttttttaaataaccacatttcaatagctttctccatattttaactattatcttactaaatatcaagtcttcttggcactgtcacaagcaaagtataagcctaactcattaagtaaaaccacttttataataactttttaacatacttacttatctctgtctgttttatagatccgtgcaatctctggcactagggggtcatctgggtttggatcacatagcagtgaacaaatggataaaagaactgcaagaaaacaaaaacatctgttacccagtttcaggagtttggataaataaatttttctaaaccgtgtattacaaaactcaatcctcaaaagacttttattagtttgtatctttatctcaatgagacacagttttacagagattttgtttcacagaagacaagctcctggtaagtaagaagtgctaaaaacagggttttgtggcatgaaattcactgcagactagccataaaaatagtttctaagataggcaactgatgccatattaatatatatattttaaataggcataaatgatattagaacttgagtttcttggtactctgtggctgggggggggggactttagcaagaatatgcaggtaacactcatgccatattcatagccattaggcatgacgaaaaatccattcttagccgctgtcttggcaatttctgagaaaaaccctcaagtgctccactaaatgtctccttgaacttgtaagcaagaaaccatattcccaagagtactagttaaatacaatgccaaaatctctttagtactaagtgagtcatcagctctagttcttaccttaaccagctcaacatactgatgcataagatgtcaagcattaaagaacatagatcgcattcacctttgagtgccggtatgtgccagcaacatatatgtggggtgctgtattaaaatgttaagatataaatgctctgaaaggttctgaccggttttttttaaaaaaagcaatagtataaaaaagcacccttgtcacatatttattgactacagcaaatttaatttccaaaccccaaatacagcagaatataaaattacctaatataggagacttggctatacaataactcacagaaaaaaggtagcttcagttgtgactgctagtttaataagttagcaaagtatggctgccaaaaaagtaagttgctttaacgacaaaacaataccaattcaatctgcccttacaaaaacagttttcagtgttactgtacactcccagcagtagtagaaaaacttggaaactgatatttaggtatgtagcatgatttgaaaagaaattagaaagcatccaagaaggtgaaaaacaggtgtaaaattttaaaaacactcgaattatggcagcatctgcctaagttgtttctttttctcccttaagtgattctactcaataaagtttgggaaatgctactgctacagtctctctccatgagattcaagtgcagtatatacacatatgaaacttttatacaatgccttgccttttgaaaaagcttttttgtacttactgaactcataaaatcaaaaaacaattaatggtgaaatagtgttaattattacaacttcacctgggatattcatgcggagaccggaaaacttgttacatataacgtaacagatgcctattaagagaccagaattgatctacagatctttcgaagattatataattttagactgtcattaggtagaaacaacctatcatggttacataaaacatgactgaagatttgtctaaaaattaacccaggaaagcaaaatcagaattttcctagagtggaaacctcagaattcaaaagctctattaagtttaggtatatcataccattcttggtaaaaaggccgcaagttagtgtgagatgtccaagtggtttgggattgaaaaatacagaagtctattaaaataaattttgctattataagatgagatgaaggtaactcattaggcaaataatgcctactcaccacaatttgaattttaacaacttctcacaaagtatctttaatcaacaccactaaaagaacaaaaattataaaaataactttattgcttccccatctcttaccaaaaagctgccataataaaaatactcagataagtagatctaagaatgaagctttattagacaatgagaacagcttatttcactagaaatatttacctttagaaattgttaaagcaggcgaccactgtgatcttagaatatcgagacaaatgctgccattactgttaatatttggatgataaattcttgttgtaaatgcaacctaaaacaaaaacttttaagtattttattcaaataaaaacaaacatcttttaaagcaaaacttaaaataatcaagccacaatgttaaaaatgtcatctattagcatagaagttctaaatattatagaaactgatttttacaatctgaccacaaccccctgcctcctctttttacaacagaaacctaaacttttggataaaaatttcattactcatatgatgtaaagttctaaaggttactgtggccctaccatatcatgaatcaaagggcaatttaaaggtatttaacacattcatttataaaagccctaacttttggatgtaaccaaaatttgtagaccatctcatttaaagtttcattaagttacacaggtacacctgagtctgcatttccaccgtacataaaacataaacttgaatcacaaaaatggaaaccatcacattgcacctataacattactagagattgttatagtgacatgtttatgacctttgtatattaccttttctagttattcatacaggttgaatttatgttaatgactgaaaagtgaaggataatatgcttttaatacctataaaccagtgcactaagcaactctaagttttcacaaatttacacttacgtatacaaaactataagcataataagcatatgctgtaacaatacgtgcaaatataaattgaagttggacatttgatgcttacaagacaacaaaagcccaaaaatcagaatctgtgtaacaataatacagatgagggcggaagcttccacatggtctgaatcttgcaacattaaagaaaaggcaaaccttattcctatttacaaagctcaaactgaggtctagctctttaaaccaaaggttaagagtcagcatctatacatgagtgcaattcaacatatatatacagcctacacagaaccctatcttccaagaatgctctattcctttgaaataaagcataaatctatactaacagattttgagggaaaatacttgccttaggtggtttgaaggggtagtctgtaggaaaatgaattgtcaaaaagaatacaccgccttgatatgggctgtcattctgtaaaaagaaaagtatgcttaactcaaatttaaaatattattgctaaatattccgtaacatttgtttccaagcatttctctaataatgaacccaaatcacctatttacactgcaataaataatctattccatgaaaattcagtctatagtaatagaaaaaaacttaaaacttatacagtaataaaccctaatttacctagtcattttacacgtcaccaaaatgtttttttaaaaagttatccagaaacgcaagtattctagatctcaattctcaaaagtacaacacagcaataaagcctacataatcatgtttcagaataatctgtaaacaaaattttacacatgtagattatttcttccaatagccagatgtgtacaaatggcttcacaacagtccattctgcccactggcaaaccaaatgttagctattccaggtaacacacacacaccaccttcaagaggagaacagagaaaagcctaagcttctcattttaatcaataccagaaaatacatgcattgcccctattttatgcatgagaaaaatgaggcttaaagaacttagtctagtgtacaaatggtaaatgatagaaccaagattcaaacacaagtcttttgaagaccacttaatgatcaaagatactgacctactcaggaatttaaagttaaaatgtggaatgcctaactgcttctgggtatgcaaagaaccaatccgaagacatgttttacaacttacatgaactgggtttttaccaacactgactcccctctattagaaaggctttgtatatacagctatatatgagcctttcactatgcccattctggatgtcaggcacataaaaaacaggcctgacactaacacagctcatctaattcctacccttctgtaaaataaataaacattaattcaattaatctaaccccttgctatatactgtatgtgtgttaagggatccaaagaacaattttttttatcttgatgagcttacactgatagacatgtaaagtaactgcaatgaaatgttataggtatcatgaaatatgaacaagggacacgagttcaaagaagaaaggtcaatttattaatgaagaatcaggttcaaagaaatatacaactagtaaatggaagagcttttatttatttgagacggagtctcactctgtcgctcaggcttaagcgcagtggcacgatctcagctcactgcgacctctgcctcctgggttcaagcaactctcctgcctcagcctcccaagtagctgggattacacatatgcaccaccacacccagctaatttttgtatttttagtagagactgagtttcaccatgttggccaggctagtcttgcggcctcctgaccttgtgatccacccatctcggcctcccaaaatgtgctgattataggtgtgagctactgtacccagccagagcttatttaaagtgagtccttctccatctcccaagtcttccccctttttttttgtaggggtggagggcggggggaatgggaacgggaagggggacaaacaagacgtagaatatcatcttgctgtttgttgcccaagctcgagtaaaatggtgcaacctcagctcactgcaagcgccgcctccccaggttcaagagattctcctgcttcagctgcctcagtagcttggattacaggtgtgcaccaacgtgcccagctaattttttatttttagtagagatggggcttcaccatgttggctgaactcttaactcctgaccccaggtgatccgcctgcctcagcctcccaaagtgctgggattacaggtatcagccaccgtgcccagtcctttttcatattttctacaaaatatggaactagaaaaacactcaggtcacttagaatgtgacctgagtttattagattaacatgtctttattaaatagttatattaattttgaatagatgcttcaaatagcatatactttcacctgatccaatactatacaagatatgttttttctgtgtaaaattaacaatttaaaggtaatcccaaacactaaagttgtttttgttttttttgagacagggtcttgctctgtcgcccagactggagtgcagtggcacaatcttggctcactgcaaccctctgcctcctgggatcaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataacctaattccagaagttctttgtaagctttcatttcaattttcataaaatcaaatgctgtctatgactgcttctgaataaaggcaatctgctgatgggatttaggcaaagccaaatttcgtttcgtttgttcgaaaaaagaactttataaagaaggcaaaatatttcaatgttacaatttaacactaaagttctgccatgccaaaagaggaagaactacgaggttcagagataatgaaactaggcaatataaaaaattgagaccctatgatatttaaattctattatgaatcagcagcaaactacaccaaaaagaaacaaaatccccaaagaataaggaacactgtgatcagcaaatcgactcaaatcgtacaagtccagaatttatgttagattttttcagaaaccttctacttcttttgctctcatcagtgcaaagttgctccctcacagtgcctcagctcttctgtggcaataaaacgttggtattcttttttttttttttttaaagtggtgctgtcgcccaggctggagtgcagtggtgtgatctcggctcactgcaacctccacctcccaggttcaagtaaattctcgggcctcagcctccaaagcagctggaattacaggcatgtgccactacacccagctaaaaatgctggtattcttataggttgattttctactcttaactgctgacccataaaaatttgagttgcaaaatatatctctggtcagttattcattccagggcatatattcaaatgcctactgatatttctacttggatatctctacttggatatctcatgtcatgcgtccaaaactgaaacttgtctcaatcccttttttcctgttttttaatagcaagccataactgaaagccataaaccaggatctcatcatcaacttcttcctctcttatctcagaatcaagatagttatcaagtaagatctttaaaatttcttgaattagcttctcctttatgcccactgtcactaccatcttagttcatgatgttatcttcagcctagattatggcaatagcttactaatgattatccctccatcctaatgataaagtggtcttttaaaaatgttactcccctgcttgaaatctatgatagtttttaagataattccaactcctaagtacatacggtgctttatgatctgggtgcccatctagtttcatcttctgtctcttctatagaacatgttctctactgcacataaaatattatatggataacatatctttttctcttccctacttggaatattcttccttataatatagcccttcctttgtcttatctgctccctacccttcttttatacctctttaagcacatagttaccattatccacccatatatctaacatttacttatatttctcttttattagactacaaagctcctcaacgagtaaggttaaaggtggaaaaagtcttcaggtatcagtaacctacgtgggaaatgacataataatacacttgaaaaaaaagttgaaaaaataatccttatggaccaaataaaatagtacctatggaccaattattttaattcagatagtttttctggttgactatgctcaggctgccaaaggttacatttttcagatactttcacatttttcacaggtactctcttctacatctctgtcatagattaggtgggagttagtgttgttctctaaatccactttttctggatttccaataaaaaaaaatttaagcaagtaaatatcagaggcaataggtaaggaagtcaatttcttctaattacatcaattcttgttggaaactaaccttaatacagtaccccacgcccccctccccaaaaaaaaccacgcacacaaaaaactagcaatgctgtcatttctttcgaaggtttagtttttagtcaatagttgtgcttccgaagtagcttaccttcagaaagaataagccagtacatatgattattaaagccaagcaattttgctgcataactaatgatctaaaggatttcccaacaactcactaaaatcaaagttactctattgaaactcaaaattagatggtatattccctacagtcaggaatcttcagttctgtggcactggcaccactttaagggacctaagtagtagtccaaagcaaaagtgacgttgttaactgtccagttctcccactaaatctgtaatttatgggttgctttaggtcacaactgcttgctacatagagcaaccatactcacaaaataagctactatttatcttatacagtgatgctttgtcacaaagaagtattgagaagccaaaagaacaaaatgagttgtttcattggtgcactccacagtaagcatatagttaactatttaaagctggcatctaaattatgtgcttacttatgtacaagacaatacccgtactttgggtggatttttataatctttgactccttcttgaaatttacccaaccaacagtgagaactaacctttttaactgaaaacatatttcagtgagtactgctaccaaagcaaaacccagcagttgtggttaatcaggttaatatttaaatggttctgaaaatcacatgcttctgtttgtaaaagcagaaaactgctagtcattatattaaaaggttgctgaaaaagttcagcaaggaatagccatcacctgaaatatatatttaaaaaatgaaaaaaggtaaatgttttctcaaaataacagcaaattaagtaaactgctaaaaaatctgtcagaataagcaacaccattctctaaaaaaattactaccatacactcatcattcatgtttccttttgattgtctataggtatgttccttgccttttgggaaaaactagtgtgttgttcaaaataacaaagtctaaactgtcaagcagaaaaaccaactagttttaaagagttagtttattctgcacaccatccaattagaagttttaattaccaacgcttctgtgctttcttagtattgacaatttttataatgaaactatcaactaccctctgaatcaaagatgagctttattttaaggcattttatagcattctttgaaaactggtaatccaaaatgggaaaattctagaggttgcaaaagcaactgctttacaaaacactaggcagataatatggaattgacctagtaggcactgtggtaaacacatatcccatctaaaaaagggaggcagctgtcattccatcccaagccattactgcttatggaatgtgggcctactcagaaggcttttatttgaagactgccaactttcaaaaatatcgtgtgggccaaactgggtaactcaacatttaactgcgtgtattaaaattaaacaatattgctaccaaattagataaaagtaagtacttttaataactacaaagccaggattgtgcatttcgttattacaggactatttttactgttttaaatgttactttgttttaaaatgatccaggacgtttcaaagtattaaacttaatatttgcacccctgccatgtcttactttgatttagtttttctacctttagggcactaacattttaattactctaaattaatcctccctgctacaatttcccattaatttatcctactcagcacttcattcaccaatcacttattttccatcttgtcacacttcagcacttgttttaggtatctgtctcctctaatacagtgtaagttccctataagatcgacagggatgtttattatgttcaatttgtatccttattacctggcacacagtatgtactcacatttgagacagaaaaatgactaaagttagaatcagaattactaaataaatacttgttgattcgactcatctactaactctaagagcattttttcctttagaattctaaatattacttactgaccattatctcacctagtacattattgctctttatgttgcttataaaaccaccaaaaagggaagacagttttcaggaagatacacatgtaacttagaaaacaaatccttaagcgccttagcaagttaaaaaaaaaaaaaaaagttaaatatttgtgtaagatacagtcttaccccaggatgttttagtgcgctctaattctctgaaattcttagatggtatccataattctgaatattcaattatccagcatatagttgcttatctacccaggatagaaaggaattttgctatattcaaaatatcactttctgcctaaatatattcaaattttgcataaactgaagttctataaagaatcaaatatcaaaatacaattaagctagattattggcagctgcagtaacagaataagatctctgagtaacacaacgcatggcagatcagagccagtaactttgtctctataaataacaggaagttccatgacaatgctttacacagtgctatgtagaaaaactgaactgagatacagagatgtttggtaggtcatagagatggctatactctagaacgtgaacacagggatagacacaaagtacacgtaacaaatgactaactcattatgttttttctttcaaatgcagtacaactatggaatatccaaaatagaattaactatatgataaaataaacctacagaccaagttaaaaattacaaccaaatcaatgctggattttcacttaaaactaaatttaaaaattcttaatacttacaggtcccataattgtggcttgccaatgaaacactagaaaaagaaaaaaaactctggttatctaaaaatgcacaagcttaaaaaaaaattaggcataaaaatcaacttgcaagttacttactatcatccccaactggacctgcagaacattgtgctggagggtcacgggccaaatcactaagttcctacaccaagacagaaaatgggtgagtcacataagcttaatttaagaaaacaagcgagtccactgctttcagttactttcaccctatttttaaaggcacactccatcacaattcacataaataatatattccattaggagagagaacatgcctgaacatatgctgagacaatcatcttagctagagttcgtaaaaatatatatgcaaacacattgatacaaaattttttatttacataaaagccaatctcttacaaaccgaaatagctataattagatattctcatagtttaagagcttagaccagagagagctcaacattcacgttatttgttgaacttccaagaccactttcagaggccctcaactgtcttaaattctttgttcttcctgaaccatccttcctccccaatccactaactctattttctacctgaaaacaaaccaaaaaaactctcatggggctaagtaccttttttgttttctaatctccttattctctcaactcaaccttttttttttttttttttaaactcagcatccatttttaactattgaaatttttttttttttgagacggagtctccaggctgcagtgcagtggcgcaatctggggtcactgcaagctccacctcccaggttcacgccattctcctgcctcaggtgcccgccaccatgccaggctaattttttgtattttttagtagagacaggatttcactgcgttaaccaggatgggtctcgatctcctgacctcgtgattgaaattctgaccctgaagagcgtacttctgtaagtagaaagacgtttgctcttaacatatagtctgcacaattcaatatgaacgttttatttccaacaagtatgtagttcactgttccatgacttgtgcataacaatatgaattatctactatgaaaatatagtttattagaatatttttaagatggtacagctccatcttaccaatgatataaccaatgtctaataatcacaagttaaaaaaaaaagacaataaatagaaccaatgttaatacattactgccttcaacattttcaaactaacagtttctcttaagtttagtctatggcataagtcagtacacccattaagtctagggactactatatcttctatatcccctttctcatataaacatggaaataacacagaagggtaaggtttgggattccatttgaacagcagaagaccactaggtacgtggctcatgcctgtaatcctaacaccctgggaggcaaagacagggatcgcttgagcccaggagtttgactgagaccagcctgaacaacaaagggagacccccgtctcttcgaaaatgttagctaggcatggtggtgcatgcctggggtcctagctactcagaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacattggctcacgcccgtaatcccagcactttgggaggctgagaagggtggatcacctaaggtcaggagttcaagaccagtgctgctaacatggtaaaaccccatctctactaacatcacaaaaattagccacacatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaacccccagaaaagctgaacgtattcatatacaaaagaccaagtactagaaagcaaaagaaaggatgcctaaataaaaaagatacaacagagaagcagaggcgagaggacagcttgagcgcaggagttcgagaccagcttggataacatagtgagaccccattctccataaaaagaaaaaaaaattacgataaagccagtatcaactgtctaccacaatatcaatgcatccgtgtataactaaaaacattaatcttcttttggtctactagaacaacttattccctataactacaggaatttaaaaatggaaacagattttcaaagtgggtacatgcactttttttcctcaactgtgatcttttgccttcctgtgcaaaatcaaggacacaaaatgcagaactttcagtataagctctctcagaagggtgcagggaatgggaagaagagctacaaatcttaatttaacaaggcatagtggcatgtgcctgtagtcccagctactcggaaggctgaggcaggattaagcccaggtgtttcaggtttttgtgtgttaaatgatcatgctggtggagagccactgcactctagcttggacaacaatgtttaatgcctattttatactggcttcagatgattattttcattcactacatcaaatttaaacacagtgacaaatttatgtaagggtcccactatggcactgacttggttgggggaaataaatgagtcctctaaattttgttcattttgttaaatccaccggaaatctttaaaataggctctcaacaaactgaggggccagaacaaaaaacaacccagcttccaagtcttttagaaaattagaatcattgaatagatagcttgaaaaatcagataatgttgacatctttccctgcaaaactgaggaactgaacaaatcaaacaatgtatgcaccaacagtacacaagcctgtaactgtgctttaaatatttcaatttgtgggaaagctctttcaatggagctgctatttttattgggtaagtttgtattctgtagcagcatggaataaaattgaaatttcgagaaacactgaaaaagaaaagagactacataaagtgtttttgtcttattaaaaaagaattgagactttgtcccatttaacaggatttgctctaagcttttaagacaccttagctcccagagggcattttgccatttaaaaaattatagtattatagactacagtcaatgggggttattaatttaaaccttattaacctcaaaagtgctactttcaacaagattaagtaagactattagagatattagcaaaacagcactgagaaacagggctaggaaactagagtacacaaatcggactaagaataattgtactacctttaaaaatgttaagatgatcaacacaaagttttaactgctctaatagtatcttttttaaaaaatgaagttttgattaaagttgtttagttaaaagtccaccaatcctctccccttttaaaaaagtgatgggaatctcactatgttgcccaagccggactacagtggctattcacaggcggaatcacaatcataaggcactatagcccagaactcctgggctcaagggatcctcttgcgtcagcctcttaagcagctggagttgcaggtacgcatcactatgtacagcaatttgttgaacaataaatgtacatttttaattgtaaaattaaacaatgaattttgttgattgactccatgtgggaagaaaaggtgacgctaagatttttggcctgagcaaagcatgagattggcattaagtaaaatggtcaacttacaggtgaagcttgtgggcagatgtagagataaagtaagtaaaataggataatgtaagtaaagactcaattcgaaaagtatatatacaagttgagaacaggctgggaacaaatacaaagtatcattaataaacaaatgatgtttatagccattcaacttggtgagagcactcctggaacagaaggtcctaggagttaacactggactaatttaacgctaagaaagggaaccttggccagtaacctgaaaagttaaaaagaaataaagaatgtgaagaaaggctttgtcacaataaacaacactgcaggaaaattaagaggcaaatatttgcctcttatattcaaaatacacttcagaaaatggccagttgttcgggaatggtcagtctagattaatgccataaaacaaacaacaaaaatagagtagacaaggagaattgtcctgatatgctgtgccaattcactttggaaactcatcacaactacttacaaggttgccagagatcccaagattcacaattttaagactgtatatcacacaccctttatatgcttgtctgtatagatataccctcatgtcttccacatattcagaaatggaagaaaattcattccaaatactattgattctgatcagtgggaattacagaaattcatatcgcagttcaacaatctgtaaaagaaactacatggcttttggccttcaaaaaattgtaacagaaaatattaactgaaccaaatcagtatttcagaagcttttttttttttgcaacttaaattatccactattaagaaaatgactttttttttgagatggagtctccctctgtcatccaggctggagtgcagtggtgtgatcttggttcactgcaacctcctcctcccaggttcaagtgactctcctgcctcagcctcctgagtagctggaattacaggcacatgccaccacacctggctattcttttttttttttttttttgtagttttactagagatggggtttcaccatggccaggctgatctcgaaatcctgacctcaagtgatccgcctgcctcggcctcccaaagtgctaggaatacaggtgtgaaccactgcaccaggcctgcagtcttacttttaatcttacacaggcctactttttctcatggttctcttctcatctctgaaataggaatcactacctggcacataatggactggtacttaacaagcagaccatgtgtagaccacccatcctgaaccaagattcctgggcaaggctcttaattcatctgttactgaacaaaagcaaaactgctccacacatgggccacataatatagccacttgtttatttaaatttttgacctatgtgataaatcctgatgctcagttgtctaaaaatgtctttgtaagcatctgaatatacctaatactgaaataagagtttaaaaagctgacaacacaatccaagttttacatttatttactcataattaactcaataaacatactagattttacatttaatatatgttaaaatggctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagaagtgcgccaccacacccggctaattttttgtatttttagtagagacggggtttcaccatgttggccacactggtctcgaactcctgacctcaggtgatcaccttggcctcccaaagtgctgggattacaggcgtgagccaccgtgcctggccagaataaatattaagataaaatattttaattttaaaataaaaatcaatgtaatcatggttgttctaaacacaatacccaataatgttggaatacttcattataaataaaactaaaggtcagaaaactatgaagttgacctagaatataaacaccatactacttcaacattacacatttcaattacaaagaaagtaagaaagtatttcttatagaataaatgagttttcggcacactgatatttatccatcactaagcctttaaatgctagcattatcatccttttagagtgaaggtataatttcagctagttaacactgggtttcagctcttcactcctgtaatttcaggttcttgttactctcctaacatttctaaatgccttactttcgaagttctccatcaccaagacatctctttagtaataatcaaagagataaaatcagcccaatacacttacctactttaaattcaatatagaaaaatgacctaagtattttaacaatcaaaacaaaggtcttttttaaagatacaaatgctgttcttatttcaccattttctttcttgccatttaaatagtatctaatattactatttaaagtaccacttagtacccaatagtaacaaaaccatgcacaagcacttacctttgagctaccaaataatttttgtaacattatatgcccacagaatgagcaagacagtatcgtaggaaaaaaaagtgagaaaagagtaagtcatagcagatgctctttgtagctagcagacattttgtctactcaataaaccatcttactcatgaattccttttcccttactccaaatcatgtgactgtagtcctgggtcagccatcattaaccaattatttggacatgactaaccacagaattttgttccctcagctgggacccaactattagtccattgtccatcccaacctaagagtttccaaatcaaagggacattcttccttctataatcaagagctataagaatgtgacccatagctgttgacaggcacgtgtcatggacttacatggtaaagtcaaaagctaaagagaccatattcaacagcagcaataacaaagagctgactttccatacagatgtgcaattttggttcctgaggttgtagcttgctctggttcctacacctattccattcattgttaactatcccagtttccttctaataaatcccttatttaatctggattatattaaggagttaaaaaatatatacagcagtagtgagagaccaaatctgaataccaattatgtagattttatgccacttcaaacacaatttagtttttgagttttgctgaaaaacatgtaagaaatctaaatgaagctaagtcttaaaattgaattaggagtaacaaggttaactttcacactggaggttaatttaaatccatttctaaaatgaaaatgtaatgttaatttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaacaacaaggagtaagagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaactgtactcttataaccactttacggaaatagagctcatcttctctgttttacagttgagtcccttaagagaggggaaagaaatgattacattcaagcatagaacatgttcagctttaggataggtgaactaagtgtacctactaacaacttaaaaatttggactaggggtaagtttcaaaaaggttcctttctcaacagggtgtccttgcaaagataatttaatgtttggcaaactgagggaaaaaaattctcaactgcaccaaactattactcaatgctccagaatgaacacgatatggaaaactaatgttttccttagtatttatttccgcataaccatccaccgttagtctgtatctcattattcgtacgtagtgtgaatccagtactatttttcaagttacatggcctgagaaaatgattctatcccacagcaagaccatttactggactggaaatcaatttccaacgacacccatactcagcatttttaaaagtaattttgtctacgatagtcacctaacaaaatgtttttagagcctaaagtttcacaggcttcagggacaaaaacactaaaaaattacacaattgaaattttcagcttattccttcctagcagtctagaggaagaggaacagtgccaagaaccagaaggaacagctctcacacggcacctgtaaaatttttttatactgtgctgactacccctcacctaaggggaacagcattactcaactattaaggccactgaaacaggaaaatgtttggttggggacactgacttactttaggaattgctcaaggttccactcacgttgaagggacactaagatcaagcacatacaatcagggtacaacactaagaaactgtactagctataaaaagaacaaaaggttggacatttcttttccacagagtgctcttttaggaaactttctccttttagtgtcatcttcctctgagctgcttctcctcaaactttctgcacacttggctagtgtgagaatccagaccttctcactggaaaaaatacttgtatttaaaagccttaaaaaacctataggaaaagaagtcaaggagacccctctgccttctttctaagctaggtaaatgagaccctctcaaagctctcacatggtctagttcgcctcattagttaaaacactacaaagaaatttgagacagcaacagactttacacaactgagttgtttgcctatttcctgaagacctggtgggcaccatggtagaaaatagggcaggatttttttcaccaaaaaaatctctctaaaaggcaaccaacaggtacagcttaagccactggtgagtgttctcatctggaagtacatgatttaagcagtaatgggtttggtcactatttttttttttattctgaaacattccttacatgagatttttaatacaaagcctgcaaatggtttatcttgaggaagacctttactgtagtcactatgggatatgggatttaacagttgattgttggagatgttaaactatgctttctgcttctctattctctatcttcctcattcaatgataagtggtactagcagtggtgaccaaccacaggctacaaagaacagtaggccaaggtattgaaaacattaaagacctgaaaggatgctaggagaaacataagaatgtcccctcccttgctgggcgtggtggctcacgcttgtaatcctagcactttgggaagccaaggcaggcggatcacctgaggtcaggaattcaagaccagcctggccaacatcgtgaaatcccatctctactaaaatataaaaattagccgggcatgatggcgggtgcctgtaatcccagctactcgagaggctgagacaggagaattgcttgaacccaggagacggtggttgcagtaagccgcagttgcgccactgcactctagcctgggcagctgaccaagactccgcctcaaaaaaaaaaaaaaaaattccctcctttcaaagagcttataaattggaaatactaaaaatatttattcacaaatatttatgaatattatgaatattcatgaagctacagagcagccatgttccaggagcccaataagtatctgaacattcggttaactttctttcaatgacagccagtatctgttcatcagatcaacataaccaaaaggtagcatttatgaaaacaaggttttaagtgtcaaccctattaaagcgtaacgccataaataacttattctaggtttcatccccccaaggcttgtcaaaattcaaaagcctatatagtggcaaggccaagttcatggattctacctttaagacagtaaaattatcaccacgatgttccacaaatcatttgttatcccaatctctaccatctattttgcacgtcatcacacaaaggtcatacagaggacagaacgcagtagtatagatacatttcctctcagcactttccggaaaactaaaagcttatgccattactaaaggttaatttcttgtattctatttgagagtctatttctttcagaactaaagacaagatttacatgactcaaaagacaagatttgtatgactgtgaatcagcattataaaaacagcccttgcctcaaaaacctatactgagcaacacaaaacactgctttggggactggaagagatgataaaatgaggtgggaaacaaagggagtaagtgccttaagaaattttaagaatcatcctcaagaagactttacaaccaacctagaaaaatacaaaggtgcgaaccaacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggattaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcgattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaagatatttggtgaatgcattcatttttaattatgaaataacactgctatggtagcaagctcaagaccacaacatttccaagaatggagagttttatttcattaatttcaaaatactggttttggcaaggggaattaagtcattataataaaagacaaaccacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccctgtatctgtggttcttaatcagagaggagcttcagaatcacctagaaaattttcaaaattatgtgtttccagggaaaatgatttagtaagtctaagacccccatgcagctgtatttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaaaatttttttaaaaactccaaatgttctggaatataaatgtaattcatgtcacacccaacaatatataatattcagtaagctcttctatacgctaacagatacaagaaaactgctatttaaaaaaagaatgcaaaaaccaacctaggtttgagattttaatctgaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatctagtgacacagtagttcatcccagtgatggagcattcaactttttatttgtataaataacaaaaactagaatcaacactgcagatgagcatgatgaaagaaaagtatgcagtgtcagtaatgcatcctttttcaaattaaacaaatactgaggtcctattattatcagcatccttcagtcacaactatcctacacagaaagtgagctggctatcaacaagctttgaggaccatatatgaaacacatgcaagacagtttacccagcctatatactagttggggacaataaatatattttgttcactctaagacatcctaagcagttaactggcacatgttagttttcagtgcttgaagagactaccccaaaagaattaaatccacttctactttcaaaatattattagccaaaatcttaactcacaaattagctataacctaagagtaaagctaactcccaattacttagatgtataagtgggagagcaaagcagcttatttcaggtaacaaactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggcaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaaggatgatatcaaactgtagttgttaagagcacatactctggaccaggctgcctaggttctaatcccaactgtcacaacatgaacctgggtcatcttcttaacctctatgcctaagtttttcaatttcgagatggagataatcttgaaattatctcagtggaagtggtggtaggagggaaacgaagatcaaatgagagttttttaaccctttacccatggtttccctgctagccgcttgcttataatcatatataaacactaaagtcatacttccagaaataaaaacccttacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatacattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacagctgaaaaaccaaaccacatgcacacgtcaaagtttctgtaagttgaatcaataatgttcacataaacactggtttttccaatatgccaagtttttatgttgtgtctatattacataaatcttcaaaatatttacaaaaggagacaacctggttaactaagagtactaaactagaaatcaaagttcttaaacaaaaacggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttagccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatttcaaaataatttttactttaatccttaactcctaaaaagcgtttcttcctcttttctttcatttcacaaagatttaaatttgtatttcgcataacccaaaatgacgatgttatgaaggcccaaaacaaaattcacgatttcatatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaagaaataaaggaagggagacttgatgtgtattgctatcctcgcagcgagctattctgtgtcacccctgacgccaccgtacactcactccgccttccagcgcgctcccgcgcgcgccc

SEQ ID NO: 2079 - DNA, 31628 bp, Homo sapiens; identical to SEQ ID NO: 2076

SEQ ID NO: 2080 - DNA, 73258 bp, Homo sapiens
atccaatagcattgacttttattcattcatgttaagtcacctgaaatgatatctgttgcatttaaatgctcattaatgtaaatggctgaacaaatccatttcaatggatactcaatatcccacatagataagtcacttcaacacagcctcatgacaactcccacaccaaaacagtactttattttgcaaattttgacccattattactcccatgttgttttttttcagctgtcaagtgtacaaggtgaagagaaatttcagttagacaggggctgcacctggaaaataaatttcttaaactccataaacacatttcaaaactgctgggtcccaaaagtccatctatgaactctagggctgccagtatcatgtgcagcacattaaagctacactatccaaatagcttattaattctgcataaatcaggtcaagcaatgtgtcaacctgtaacagactgtgcactttaactgaacatggcaaaatattcactctttcgaactttacatcatcatttgatgtcaaacaatgaagcaaatcccaacagtatatacaaaaaacagctttgcatttacaaaagattgtttcccatactgattaatccaggcagctaactcattggtttatgcaactttattgaagaaaaataaatcaattactagcagagctattagttgatcactcatccattgacaacttgcatcatttattcagtgctatattaaacagtgtattggaagatagattaactaatagctccaagcctcctaacaatttaaatgaaaattacaaaatgtttgagaccctattttggaatacaaagggtgtttgacttccaatttccattctctgtagaacaagaacaggtcattcctttattgacatgcataaaatacatcacattttctgttctgctgatgctataaattcaataccaattctccagccacatcagttatgagcataaagcatatcatgtaacctcaaatctctaacagtggaaggcttaaacaagaatggatgctgctagaataatgctgtatcctttgatgtgacaactgagcatccatctccctccccctcagatgatttcttcagcatgttagagcagtgaggaatggttttagtctcataaccaagttagagtgaagacattggccacataatacacatgctccatttttttttttaaaaattctgagtcttgggcaactgttctcttgtaactactttacagtttctaaaagcagttattgtccaaagctggaagaacttaagtcttctcagatgagcatgtgaatgaatggagggaggtaaacaaaaaataaaattaaaaaagatgaggtctgataggggagcagccggataagaaaatcaaaaaaggaacagtaatttaaagtttattccagctataatgcaggttattctgactttaaggtagcatcacatggcatacttctgagtccattcccgagatattctgttgtacctgtaaataaagatgttatttttaaaagttaaaataaagaattcctaatactttaaatggaagggaaagatttccattttatcatctccagactcatcatgaagtcatctctaatgactatgattagaataaaagccaacaagggagaaatagcactggtactcaaagcaatgtgggaaatgagagcctgatgctctgaaagtagtattttaaaaacaactaagaaagcagcactgaaaattgggaggctaacaaaaatcaaaagaccctttctttctctaccaccgagctcatgctctaattttaacgtgaagaaatttttacagttcattatggacaaatgttaaaatagtatacacattctatctatccacagaaatttccaccaaggccagaactaggcttttactagaacaattttatctgaatcctagagtttgggaaattacttggtcctggatattacaagaaaaaatggctttgggacttaggtagaggcagaaggggaagatgacactgggcagaatgacaaagggcagtaattttcaaaaggggtgtgtgtgtgagtggttgtgttcatcagaatcacgtgttacttttaataagtgtggtaactgaggctaataagcaccactgagacctgttgagtacaacaagggcatcttcgtttaaaaagatcaacaggtaattcacacacaagcaaggttattactcaggaagactactaacattgataaatactatcagcttccccctggattatactcatgccatagactacttacaacaacaaaaaacagtgataaccttaagaaaggaatatatatatatatatatatatatatatatatatatatatatatatgcacaggagaatttttatattgtttaaatattaactagctttatttcaaaccaagaaccaaatatggtccaacaacttttctaaactttttaaaaagttctttctaccaattcattgtcatctcctaaggatactctctcaaaaagccagcactttaaaacaaaggctttatttagcatacagggagccacaaagtacagctgacgctaatgcatgcttgtcagtaatgaacatttagtttagatgcttaggcttaaaagtgtttttcccttacattactatctcctggcaaaatttgaactaaaccaccacattctgtataggattggtacaaagtctcaagctaaaatttaaacaccatgatagtttgaaaaaaaaaaaagatactacataaattcccatttcttactagtgctattgtaactgctttgccatgcaatactttcaagcagtaacggctaccagatatttactttcacgttaaacagagaccaagcagttaaatgtacagttttcagaagactgccatatttgttaccttttgttagttaatacagtgccttaacgcatgcagcactcaagtgctggcagtaccataataagcgcaccatagagtgcagatcctcttaccctacaacatagcgtatttctctgtccactctcttgctaacctattgtacctaattgaacaagtacacttagcattaattataacatatgaaagttataatggttaagttgaacataaatataattcaaatatttgagaaatttagaccaaatttttacaatagtactaacatttttggaaaaacatgcttggggtaaagaaaaatttgctttcttccccaaaagttgagaataaagtgatactgtttaacacgctaggaaaaaaaaaacaacaataaaacattttagaggggagcattcactgtcacataagctaaagcctagttaagtttttttaaataaccacatttcaatagctttctccatattttaactattatcttactaaatatcaagtcttcttggcactgtcacaagcaaagtataagcctaactcattaagtaaaaccacttttataataactttttaacatacttacttatctctgtctgttttatagatccgtgcaatctctggcactagggggtcatctgggtttggatcacatagcagtgaacaaatggataaaagaactgcaagaaaacaaaaacatctgttacccagtttcaggagtttggataaataaatttttctaaaccgtgtattacaaaactcaatcctcaaaagacttttattagtttgtatctttatctcaatgagacacagttttacagagattttgtttcacagaagacaagctcctggtaagtaagaagtgctaaaaacagggttttgtggcatgaaattcactgcagactagccataaaaatagtttctaagataggcaactgatgccatattaatatatatattttaaataggcataaatgatattagaacttgagtttcttggtactctgtggctgggggggggggactttagcaagaatatgcaggtaacactcatgccatattcatagccattaggcatgacgaaaaatccattcttagccgctgtcttggcaatttctgagaaaaaccctcaagtgctccactaaatgtctccttgaacttgtaagcaagaaaccatattcccaagagtactagttaaatacaatgccaaaatctctttagtactaagtgagtcatcagctctagttcttaccttaaccagctcaacatactgatgcataagatgtcaagcattaaagaacatagatcgcattcacctttgagtgccggtatgtgccagcaacatatatgtggggtgctgtattaaaatgttaagatataaatgctctgaaaggttctgaccggttttttttaaaaaaagcaatagtataaaaaagcacccttgtcacatatttattgactacagcaaatttaatttccaaaccccaaatacagcagaatataaaattacctaatataggagacttggctatacaataactcacagaaaaaaggtagcttcagttgtgactgctagtttaataagttagcaaagtatggctgccaaaaaagtaagttgctttaacgacaaaacaataccaattcaatctgcccttacaaaaacagttttcagtgttactgtacactcccagcagtagtagaaaaacttggaaactgatatttaggtatgtagcatgatttgaaaagaaattagaaagcatccaagaaggtgaaaaacaggtgtaaaattttaaaaacactcgaattatggcagcatctgcctaagttgtttctttttctcccttaagtgattctactcaataaagtttgggaaatgctactgctacagtctctctccatgagattcaagtgcagtatatacacatatgaaacttttatacaatgccttgccttttgaaaaagcttttttgtacttactgaactcataaaatcaaaaaacaattaatggtgaaatagtgttaattattacaacttcacctgggatattcatgcggagaccggaaaacttgttacatataacgtaacagatgcctattaagagaccagaattgatctacagatctttcgaagattatataattttagactgtcattaggtagaaacaacctatcatggttacataaaacatgactgaagatttgtctaaaaattaacccaggaaagcaaaatcagaattttcctagagtggaaacctcagaattcaaaagctctattaagtttaggtatatcataccattcttggtaaaaaggccgcaagttagtgtgagatgtccaagtggtttgggattgaaaaatacagaagtctattaaaataaattttgctattataagatgagatgaaggtaactcattaggcaaataatgcctactcaccacaatttgaattttaacaacttctcacaaagtatctttaatcaacaccactaaaagaacaaaaattataaaaataactttattgcttccccatctcttaccaaaaagctgccataataaaaatactcagataagtagatctaagaatgaagctttattagacaatgagaacagcttatttcactagaaatatttacctttagaaattgttaaagcaggcgaccactgtgatcttagaatatcgagacaaatgctgccattactgttaatatttggatgataaattcttgttgtaaatgcaacctaaaacaaaaacttttaagtattttattcaaataaaaacaaacatcttttaaagcaaaacttaaaataatcaagccacaatgttaaaaatgtcatctattagcatagaagttctaaatattatagaaactgatttttacaatctgaccacaaccccctgcctcctctttttacaacagaaacctaaacttttggataaaaatttcattactcatatgatgtaaagttctaaaggttactgtggccctaccatatcatgaatcaaagggcaatttaaaggtatttaacacattcatttataaaagccctaacttttggatgtaaccaaaatttgtagaccatctcatttaaagtttcattaagttacacaggtacacctgagtctgcatttccaccgtacataaaacataaacttgaatcacaaaaatggaaaccatcacattgcacctataacattactagagattgttatagtgacatgtttatgacctttgtatattaccttttctagttattcatacaggttgaatttatgttaatgactgaaaagtgaaggataatatgcttttaatacctataaaccagtgcactaagcaactctaagttttcacaaatttacacttacgtatacaaaactataagcataataagcatatgctgtaacaatacgtgcaaatataaattgaagttggacatttgatgcttacaagacaacaaaagcccaaaaatcagaatctgtgtaacaataatacagatgagggcggaagcttccacatggtctgaatcttgcaacattaaagaaaaggcaaaccttattcctatttacaaagctcaaactgaggtctagctctttaaaccaaaggttaagagtcagcatctatacatgagtgcaattcaacatatatatacagcctacacagaaccctatcttccaagaatgctctattcctttgaaataaagcataaatctatactaacagattttgagggaaaatacttgccttaggtggtttgaaggggtagtctgtaggaaaatgaattgtcaaaaagaatacaccgccttgatatgggctgtcattctgtaaaaagaaaagtatgcttaactcaaatttaaaatattattgctaaatattccgtaacatttgtttccaagcatttctctaataatgaacccaaatcacctatttacactgcaataaataatctattccatgaaaattcagtctatagtaatagaaaaaaacttaaaacttatacagtaataaaccctaatttacctagtcattttacacgtcaccaaaatgtttttttaaaaagttatccagaaacgcaagtattctagatctcaattctcaaaagtacaacacagcaataaagcctacataatcatgtttcagaataatctgtaaacaaaattttacacatgtagattatttcttccaatagccagatgtgtacaaatggcttcacaacagtccattctgcccactggcaaaccaaatgttagctattccaggtaacacacacacaccaccttcaagaggagaacagagaaaagcctaagcttctcattttaatcaataccagaaaatacatgcattgcccctattttatgcatgagaaaaatgaggcttaaagaacttagtctagtgtacaaatggtaaatgatagaaccaagattcaaacacaagtcttttgaagaccacttaatgatcaaagatactgacctactcaggaatttaaagttaaaatgtggaatgcctaactgcttctgggtatgcaaagaaccaatccgaagacatgttttacaacttacatgaactgggtttttaccaacactgactcccctctattagaaaggctttgtatatacagctatatatgagcctttcactatgcccattctggatgtcaggcacataaaaaacaggcctgacactaacacagctcatctaattcctacccttctgtaaaataaataaacattaattcaattaatctaaccccttgctatatactgtatgtgtgttaagggatccaaagaacaattttttttatcttgatgagcttacactgatagacatgtaaagtaactgcaatgaaatgttataggtatcatgaaatatgaacaagggacacgagttcaaagaagaaaggtcaatttattaatgaagaatcaggttcaaagaaatatacaactagtaaatggaagagcttttatttatttgagacggagtctcactctgtcgctcaggcttaagcgcagtggcacgatctcagctcactgcgacctctgcctcctgggttcaagcaactctcctgcctcagcctcccaagtagctgggattacacatatgcaccaccacacccagctaatttttgtatttttagtagagactgagtttcaccatgttggccaggctagtcttgcggcctcctgaccttgtgatccacccatctcggcctcccaaaatgtgctgattataggtgtgagctactgtacccagccagagcttatttaaagtgagtccttctccatctcccaagtcttccccctttttttttgtaggggtggagggcggggggaatgggaacgggaagggggacaaacaagacgtagaatatcatcttgctgtttgttgcccaagctcgagtaaaatggtgcaacctcagctcactgcaagcgccgcctccccaggttcaagagattctcctgcttcagctgcctcagtagcttggattacaggtgtgcaccaacgtgcccagctaattttttatttttagtagagatggggcttcaccatgttggctgaactcttaactcctgaccccaggtgatccgcctgcctcagcctcccaaagtgctgggattacaggtatcagccaccgtgcccagtcctttttcatattttctacaaaatatggaactagaaaaacactcaggtcacttagaatgtgacctgagtttattagattaacatgtctttattaaatagttatattaattttgaatagatgcttcaaatagcatatactttcacctgatccaatactatacaagatatgttttttctgtgtaaaattaacaatttaaaggtaatcccaaacactaaagttgtttttgttttttttgagacagggtcttgctctgtcgcccagactggagtgcagtggcacaatcttggctcactgcaaccctctgcctcctgggatcaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataacctaattccagaagttctttgtaagctttcatttcaattttcataaaatcaaatgctgtctatgactgcttctgaataaaggcaatctgctgatgggatttaggcaaagccaaatttcgtttcgtttgttcgaaaaaagaactttataaagaaggcaaaatatttcaatgttacaatttaacactaaagttctgccatgccaaaagaggaagaactacgaggttcagagataatgaaactaggcaatataaaaaattgagaccctatgatatttaaattctattatgaatcagcagcaaactacaccaaaaagaaacaaaatccccaaagaataaggaacactgtgatcagcaaatcgactcaaatcgtacaagtccagaatttatgttagattttttcagaaaccttctacttcttttgctctcatcagtgcaaagttgctccctcacagtgcctcagctcttctgtggcaataaaacgttggtattcttttttttttttttttaaagtggtgctgtcgcccaggctggagtgcagtggtgtgatctcggctcactgcaacctccacctcccaggttcaagtaaattctcgggcctcagcctccaaagcagctggaattacaggcatgtgccactacacccagctaaaaatgctggtattcttataggttgattttctactcttaactgctgacccataaaaatttgagttgcaaaatatatctctggtcagttattcattccagggcatatattcaaatgcctactgatatttctacttggatatctctacttggatatctcatgtcatgcgtccaaaactgaaacttgtctcaatcccttttttcctgttttttaatagcaagccataactgaaagccataaaccaggatctcatcatcaacttcttcctctcttatctcagaatcaagatagttatcaagtaagatctttaaaatttcttgaattagcttctcctttatgcccactgtcactaccatcttagttcatgatgttatcttcagcctagattatggcaatagcttactaatgattatccctccatcctaatgataaagtggtcttttaaaaatgttactcccctgcttgaaatctatgatagtttttaagataattccaactcctaagtacatacggtgctttatgatctgggtgcccatctagtttcatcttctgtctcttctatagaacatgttctctactgcacataaaatattatatggataacatatctttttctcttccctacttggaatattcttccttataatatagcccttcctttgtcttatctgctccctacccttcttttatacctctttaagcacatagttaccattatccacccatatatctaacatttacttatatttctcttttattagactacaaagctcctcaacgagtaaggttaaaggtggaaaaagtcttcaggtatcagtaacctacgtgggaaatgacataataatacacttgaaaaaaaagttgaaaaaataatccttatggaccaaataaaatagtacctatggaccaattattttaattcagatagtttttctggttgactatgctcaggctgccaaaggttacatttttcagatactttcacatttttcacaggtactctcttctacatctctgtcatagattaggtgggagttagtgttgttctctaaatccactttttctggatttccaataaaaaaaaatttaagcaagtaaatatcagaggcaataggtaaggaagtcaatttcttctaattacatcaattcttgttggaaactaaccttaatacagtaccccacgcccccctccccaaaaaaaaccacgcacacaaaaaactagcaatgctgtcatttctttcgaaggtttagtttttagtcaatagttgtgcttccgaagtagcttaccttcagaaagaataagccagtacatatgattattaaagccaagcaattttgctgcataactaatgatctaaaggatttcccaacaactcactaaaatcaaagttactctattgaaactcaaaattagatggtatattccctacagtcaggaatcttcagttctgtggcactggcaccactttaagggacctaagtagtagtccaaagcaaaagtgacgttgttaactgtccagttctcccactaaatctgtaatttatgggttgctttaggtcacaactgcttgctacatagagcaaccatactcacaaaataagctactatttatcttatacagtgatgctttgtcacaaagaagtattgagaagccaaaagaacaaaatgagttgtttcattggtgcactccacagtaagcatatagttaactatttaaagctggcatctaaattatgtgcttacttatgtacaagacaatacccgtactttgggtggatttttataatctttgactccttcttgaaatttacccaaccaacagtgagaactaacctttttaactgaaaacatatttcagtgagtactgctaccaaagcaaaacccagcagttgtggttaatcaggttaatatttaaatggttctgaaaatcacatgcttctgtttgtaaaagcagaaaactgctagtcattatattaaaaggttgctgaaaaagttcagcaaggaatagccatcacctgaaatatatatttaaaaaatgaaaaaaggtaaatgttttctcaaaataacagcaaattaagtaaactgctaaaaaatctgtcagaataagcaacaccattctctaaaaaaattactaccatacactcatcattcatgtttccttttgattgtctataggtatgttccttgccttttgggaaaaactagtgtgttgttcaaaataacaaagtctaaactgtcaagcagaaaaaccaactagttttaaagagttagtttattctgcacaccatccaattagaagttttaattaccaacgcttctgtgctttcttagtattgacaatttttataatgaaactatcaactaccctctgaatcaaagatgagctttattttaaggcattttatagcattctttgaaaactggtaatccaaaatgggaaaattctagaggttgcaaaagcaactgctttacaaaacactaggcagataatatggaattgacctagtaggcactgtggtaaacacatatcccatctaaaaaagggaggcagctgtcattccatcccaagccattactgcttatggaatgtgggcctactcagaaggcttttatttgaagactgccaactttcaaaaatatcgtgtgggccaaactgggtaactcaacatttaactgcgtgtattaaaattaaacaatattgctaccaaattagataaaagtaagtacttttaataactacaaagccaggattgtgcatttcgttattacaggactatttttactgttttaaatgttactttgttttaaaatgatccaggacgtttcaaagtattaaacttaatatttgcacccctgccatgtcttactttgatttagtttttctacctttagggcactaacattttaattactctaaattaatcctccctgctacaatttcccattaatttatcctactcagcacttcattcaccaatcacttattttccatcttgtcacacttcagcacttgttttaggtatctgtctcctctaatacagtgtaagttccctataagatcgacagggatgtttattatgttcaatttgtatccttattacctggcacacagtatgtactcacatttgagacagaaaaatgactaaagttagaatcagaattactaaataaatacttgttgattcgactcatctactaactctaagagcattttttcctttagaattctaaatattacttactgaccattatctcacctagtacattattgctctttatgttgcttataaaaccaccaaaaagggaagacagttttcaggaagatacacatgtaacttagaaaacaaatccttaagcgccttagcaagttaaaaaaaaaaaaaaaagttaaatatttgtgtaagatacagtcttaccccaggatgttttagtgcgctctaattctctgaaattcttagatggtatccataattctgaatattcaattatccagcatatagttgcttatctacccaggatagaaaggaattttgctatattcaaaatatcactttctgcctaaatatattcaaattttgcataaactgaagttctataaagaatcaaatatcaaaatacaattaagctagattattggcagctgcagtaacagaataagatctctgagtaacacaacgcatggcagatcagagccagtaactttgtctctataaataacaggaagttccatgacaatgctttacacagtgctatgtagaaaaactgaactgagatacagagatgtttggtaggtcatagagatggctatactctagaacgtgaacacagggatagacacaaagtacacgtaacaaatgactaactcattatgttttttctttcaaatgcagtacaactatggaatatccaaaatagaattaactatatgataaaataaacctacagaccaagttaaaaattacaaccaaatcaatgctggattttcacttaaaactaaatttaaaaattcttaatacttacaggtcccataattgtggcttgccaatgaaacactagaaaaagaaaaaaaactctggttatctaaaaatgcacaagcttaaaaaaaaattaggcataaaaatcaacttgcaagttacttactatcatccccaactggacctgcagaacattgtgctggagggtcacgggccaaatcactaagttcctacaccaagacagaaaatgggtgagtcacataagcttaatttaagaaaacaagcgagtccactgctttcagttactttcaccctatttttaaaggcacactccatcacaattcacataaataatatattccattaggagagagaacatgcctgaacatatgctgagacaatcatcttagctagagttcgtaaaaatatatatgcaaacacattgatacaaaattttttatttacataaaagccaatctcttacaaaccgaaatagctataattagatattctcatagtttaagagcttagaccagagagagctcaacattcacgttatttgttgaacttccaagaccactttcagaggccctcaactgtcttaaattctttgttcttcctgaaccatccttcctccccaatccactaactctattttctacctgaaaacaaaccaaaaaaactctcatggggctaagtaccttttttgttttctaatctccttattctctcaactcaaccttttttttttttttttttaaactcagcatccatttttaactattgaaatttttttttttttgagacggagtctccaggctgcagtgcagtggcgcaatctggggtcactgcaagctccacctcccaggttcacgccattctcctgcctcaggtgcccgccaccatgccaggctaattttttgtattttttagtagagacaggatttcactgcgttaaccaggatgggtctcgatctcctgacctcgtgattgaaattctgaccctgaagagcgtacttctgtaagtagaaagacgtttgctcttaacatatagtctgcacaattcaatatgaacgttttatttccaacaagtatgtagttcactgttccatgacttgtgcataacaatatgaattatctactatgaaaatatagtttattagaatatttttaagatggtacagctccatcttaccaatgatataaccaatgtctaataatcacaagttaaaaaaaaaagacaataaatagaaccaatgttaatacattactgccttcaacattttcaaactaacagtttctcttaagtttagtctatggcataagtcagtacacccattaagtctagggactactatatcttctatatcccctttctcatataaacatggaaataacacagaagggtaaggtttgggattccatttgaacagcagaagaccactaggtacgtggctcatgcctgtaatcctaacaccctgggaggcaaagacagggatcgcttgagcccaggagtttgactgagaccagcctgaacaacaaagggagacccccgtctcttcgaaaatgttagctaggcatggtggtgcatgcctggggtcctagctactcagaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacattggctcacgcccgtaatcccagcactttgggaggctgagaagggtggatcacctaaggtcaggagttcaagaccagtgctgctaacatggtaaaaccccatctctactaacatcacaaaaattagccacacatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaacccccagaaaagctgaacgtattcatatacaaaagaccaagtactagaaagcaaaagaaaggatgcctaaataaaaaagatacaacagagaagcagaggcgagaggacagcttgagcgcaggagttcgagaccagcttggataacatagtgagaccccattctccataaaaagaaaaaaaaattacgataaagccagtatcaactgtctaccacaatatcaatgcatccgtgtataactaaaaacattaatcttcttttggtctactagaacaacttattccctataactacaggaatttaaaaatggaaacagattttcaaagtgggtacatgcactttttttcctcaactgtgatcttttgccttcctgtgcaaaatcaaggacacaaaatgcagaactttcagtataagctctctcagaagggtgcagggaatgggaagaagagctacaaatcttaatttaacaaggcatagtggcatgtgcctgtagtcccagctactcggaaggctgaggcaggattaagcccaggtgtttcaggtttttgtgtgttaaatgatcatgctggtggagagccactgcactctagcttggacaacaatgtttaatgcctattttatactggcttcagatgattattttcattcactacatcaaatttaaacacagtgacaaatttatgtaagggtcccactatggcactgacttggttgggggaaataaatgagtcctctaaattttgttcattttgttaaatccaccggaaatctttaaaataggctctcaacaaactgaggggccagaacaaaaaacaacccagcttccaagtcttttagaaaattagaatcattgaatagatagcttgaaaaatcagataatgttgacatctttccctgcaaaactgaggaactgaacaaatcaaacaatgtatgcaccaacagtacacaagcctgtaactgtgctttaaatatttcaatttgtgggaaagctctttcaatggagctgctatttttattgggtaagtttgtattctgtagcagcatggaataaaattgaaatttcgagaaacactgaaaaagaaaagagactacataaagtgtttttgtcttattaaaaaagaattgagactttgtcccatttaacaggatttgctctaagcttttaagacaccttagctcccagagggcattttgccatttaaaaaattatagtattatagactacagtcaatgggggttattaatttaaaccttattaacctcaaaagtgctactttcaacaagattaagtaagactattagagatattagcaaaacagcactgagaaacagggctaggaaactagagtacacaaatcggactaagaataattgtactacctttaaaaatgttaagatgatcaacacaaagttttaactgctctaatagtatcttttttaaaaaatgaagttttgattaaagttgtttagttaaaagtccaccaatcctctccccttttaaaaaagtgatgggaatctcactatgttgcccaagccggactacagtggctattcacaggcggaatcacaatcataaggcactatagcccagaactcctgggctcaagggatcctcttgcgtcagcctcttaagcagctggagttgcaggtacgcatcactatgtacagcaatttgttgaacaataaatgtacatttttaattgtaaaattaaacaatgaattttgttgattgactccatgtgggaagaaaaggtgacgctaagatttttggcctgagcaaagcatgagattggcattaagtaaaatggtcaacttacaggtgaagcttgtgggcagatgtagagataaagtaagtaaaataggataatgtaagtaaagactcaattcgaaaagtatatatacaagttgagaacaggctgggaacaaatacaaagtatcattaataaacaaatgatgtttatagccattcaacttggtgagagcactcctggaacagaaggtcctaggagttaacactggactaatttaacgctaagaaagggaaccttggccagtaacctgaaaagttaaaaagaaataaagaatgtgaagaaaggctttgtcacaataaacaacactgcaggaaaattaagaggcaaatatttgcctcttatattcaaaatacacttcagaaaatggccagttgttcgggaatggtcagtctagattaatgccataaaacaaacaacaaaaatagagtagacaaggagaattgtcctgatatgctgtgccaattcactttggaaactcatcacaactacttacaaggttgccagagatcccaagattcacaattttaagactgtatatcacacaccctttatatgcttgtctgtatagatataccctcatgtcttccacatattcagaaatggaagaaaattcattccaaatactattgattctgatcagtgggaattacagaaattcatatcgcagttcaacaatctgtaaaagaaactacatggcttttggccttcaaaaaattgtaacagaaaatattaactgaaccaaatcagtatttcagaagcttttttttttttgcaacttaaattatccactattaagaaaatgactttttttttgagatggagtctccctctgtcatccaggctggagtgcagtggtgtgatcttggttcactgcaacctcctcctcccaggttcaagtgactctcctgcctcagcctcctgagtagctggaattacaggcacatgccaccacacctggctattcttttttttttttttttttgtagttttactagagatggggtttcaccatggccaggctgatctcgaaatcctgacctcaagtgatccgcctgcctcggcctcccaaagtgctaggaatacaggtgtgaaccactgcaccaggcctgcagtcttacttttaatcttacacaggcctactttttctcatggttctcttctcatctctgaaataggaatcactacctggcacataatggactggtacttaacaagcagaccatgtgtagaccacccatcctgaaccaagattcctgggcaaggctcttaattcatctgttactgaacaaaagcaaaactgctccacacatgggccacataatatagccacttgtttatttaaatttttgacctatgtgataaatcctgatgctcagttgtctaaaaatgtctttgtaagcatctgaatatacctaatactgaaataagagtttaaaaagctgacaacacaatccaagttttacatttatttactcataattaactcaataaacatactagattttacatttaatatatgttaaaatggctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagaagtgcgccaccacacccggctaattttttgtatttttagtagagacggggtttcaccatgttggccacactggtctcgaactcctgacctcaggtgatcaccttggcctcccaaagtgctgggattacaggcgtgagccaccgtgcctggccagaataaatattaagataaaatattttaattttaaaataaaaatcaatgtaatcatggttgttctaaacacaatacccaataatgttggaatacttcattataaataaaactaaaggtcagaaaactatgaagttgacctagaatataaacaccatactacttcaacattacacatttcaattacaaagaaagtaagaaagtatttcttatagaataaatgagttttcggcacactgatatttatccatcactaagcctttaaatgctagcattatcatccttttagagtgaaggtataatttcagctagttaacactgggtttcagctcttcactcctgtaatttcaggttcttgttactctcctaacatttctaaatgccttactttcgaagttctccatcaccaagacatctctttagtaataatcaaagagataaaatcagcccaatacacttacctactttaaattcaatatagaaaaatgacctaagtattttaacaatcaaaacaaaggtcttttttaaagatacaaatgctgttcttatttcaccattttctttcttgccatttaaatagtatctaatattactatttaaagtaccacttagtacccaatagtaacaaaaccatgcacaagcacttacctttgagctaccaaataatttttgtaacattatatgcccacagaatgagcaagacagtatcgtaggaaaaaaaagtgagaaaagagtaagtcatagcagatgctctttgtagctagcagacattttgtctactcaataaaccatcttactcatgaattccttttcccttactccaaatcatgtgactgtagtcctgggtcagccatcattaaccaattatttggacatgactaaccacagaattttgttccctcagctgggacccaactattagtccattgtccatcccaacctaagagtttccaaatcaaagggacattcttccttctataatcaagagctataagaatgtgacccatagctgttgacaggcacgtgtcatggacttacatggtaaagtcaaaagctaaagagaccatattcaacagcagcaataacaaagagctgactttccatacagatgtgcaattttggttcctgaggttgtagcttgctctggttcctacacctattccattcattgttaactatcccagtttccttctaataaatcccttatttaatctggattatattaaggagttaaaaaatatatacagcagtagtgagagaccaaatctgaataccaattatgtagattttatgccacttcaaacacaatttagtttttgagttttgctgaaaaacatgtaagaaatctaaatgaagctaagtcttaaaattgaattaggagtaacaaggttaactttcacactggaggttaatttaaatccatttctaaaatgaaaatgtaatgttaatttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaacaacaaggagtaagagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaactgtactcttataaccactttacggaaatagagctcatcttctctgttttacagttgagtcccttaagagaggggaaagaaatgattacattcaagcatagaacatgttcagctttaggataggtgaactaagtgtacctactaacaacttaaaaatttggactaggggtaagtttcaaaaaggttcctttctcaacagggtgtccttgcaaagataatttaatgtttggcaaactgagggaaaaaaattctcaactgcaccaaactattactcaatgctccagaatgaacacgatatggaaaactaatgttttccttagtatttatttccgcataaccatccaccgttagtctgtatctcattattcgtacgtagtgtgaatccagtactatttttcaagttacatggcctgagaaaatgattctatcccacagcaagaccatttactggactggaaatcaatttccaacgacacccatactcagcatttttaaaagtaattttgtctacgatagtcacctaacaaaatgtttttagagcctaaagtttcacaggcttcagggacaaaaacactaaaaaattacacaattgaaattttcagcttattccttcctagcagtctagaggaagaggaacagtgccaagaaccagaaggaacagctctcacacggcacctgtaaaatttttttatactgtgctgactacccctcacctaaggggaacagcattactcaactattaaggccactgaaacaggaaaatgtttggttggggacactgacttactttaggaattgctcaaggttccactcacgttgaagggacactaagatcaagcacatacaatcagggtacaacactaagaaactgtactagctataaaaagaacaaaaggttggacatttcttttccacagagtgctcttttaggaaactttctccttttagtgtcatcttcctctgagctgcttctcctcaaactttctgcacacttggctagtgtgagaatccagaccttctcactggaaaaaatacttgtatttaaaagccttaaaaaacctataggaaaagaagtcaaggagacccctctgccttctttctaagctaggtaaatgagaccctctcaaagctctcacatggtctagttcgcctcattagttaaaacactacaaagaaatttgagacagcaacagactttacacaactgagttgtttgcctatttcctgaagacctggtgggcaccatggtagaaaatagggcaggatttttttcaccaaaaaaatctctctaaaaggcaaccaacaggtacagcttaagccactggtgagtgttctcatctggaagtacatgatttaagcagtaatgggtttggtcactatttttttttttattctgaaacattccttacatgagatttttaatacaaagcctgcaaatggtttatcttgaggaagacctttactgtagtcactatgggatatgggatttaacagttgattgttggagatgttaaactatgctttctgcttctctattctctatcttcctcattcaatgataagtggtactagcagtggtgaccaaccacaggctacaaagaacagtaggccaaggtattgaaaacattaaagacctgaaaggatgctaggagaaacataagaatgtcccctcccttgctgggcgtggtggctcacgcttgtaatcctagcactttgggaagccaaggcaggcggatcacctgaggtcaggaattcaagaccagcctggccaacatcgtgaaatcccatctctactaaaatataaaaattagccgggcatgatggcgggtgcctgtaatcccagctactcgagaggctgagacaggagaattgcttgaacccaggagacggtggttgcagtaagccgcagttgcgccactgcactctagcctgggcagctgaccaagactccgcctcaaaaaaaaaaaaaaaaattccctcctttcaaagagcttataaattggaaatactaaaaatatttattcacaaatatttatgaatattatgaatattcatgaagctacagagcagccatgttccaggagcccaataagtatctgaacattcggttaactttctttcaatgacagccagtatctgttcatcagatcaacataaccaaaaggtagcatttatgaaaacaaggttttaagtgtcaaccctattaaagcgtaacgccataaataacttattctaggtttcatccccccaaggcttgtcaaaattcaaaagcctatatagtggcaaggccaagttcatggattctacctttaagacagtaaaattatcaccacgatgttccacaaatcatttgttatcccaatctctaccatctattttgcacgtcatcacacaaaggtcatacagaggacagaacgcagtagtatagatacatttcctctcagcactttccggaaaactaaaagcttatgccattactaaaggttaatttcttgtattctatttgagagtctatttctttcagaactaaagacaagatttacatgactcaaaagacaagatttgtatgactgtgaatcagcattataaaaacagcccttgcctcaaaaacctatactgagcaacacaaaacactgctttggggactggaagagatgataaaatgaggtgggaaacaaagggagtaagtgccttaagaaattttaagaatcatcctcaagaagactttacaaccaacctagaaaaatacaaaggtgcgaaccaacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggattaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcgattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaagatatttggtgaatgcattcatttttaattatgaaataacactgctatggtagcaagctcaagaccacaacatttccaagaatggagagttttatttcattaatttcaaaatactggttttggcaaggggaattaagtcattataataaaagacaaaccacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccctgtatctgtggttcttaatcagagaggagcttcagaatcacctagaaaattttcaaaattatgtgtttccagggaaaatgatttagtaagtctaagacccccatgcagctgtatttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaaaatttttttaaaaactccaaatgttctggaatataaatgtaattcatgtcacacccaacaatatataatattcagtaagctcttctatacgctaacagatacaagaaaactgctatttaaaaaaagaatgcaaaaaccaacctaggtttgagattttaatctgaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatctagtgacacagtagttcatcccagtgatggagcattcaactttttatttgtataaataacaaaaactagaatcaacactgcagatgagcatgatgaaagaaaagtatgcagtgtcagtaatgcatcctttttcaaattaaacaaatactgaggtcctattattatcagcatccttcagtcacaactatcctacacagaaagtgagctggctatcaacaagctttgaggaccatatatgaaacacatgcaagacagtttacccagcctatatactagttggggacaataaatatattttgttcactctaagacatcctaagcagttaactggcacatgttagttttcagtgcttgaagagactaccccaaaagaattaaatccacttctactttcaaaatattattagccaaaatcttaactcacaaattagctataacctaagagtaaagctaactcccaattacttagatgtataagtgggagagcaaagcagcttatttcaggtaacaaactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggcaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaaggatgatatcaaactgtagttgttaagagcacatactctggaccaggctgcctaggttctaatcccaactgtcacaacatgaacctgggtcatcttcttaacctctatgcctaagtttttcaatttcgagatggagataatcttgaaattatctcagtggaagtggtggtaggagggaaacgaagatcaaatgagagttttttaaccctttacccatggtttccctgctagccgcttgcttataatcatatataaacactaaagtcatacttccagaaataaaaacccttacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatacattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacagctgaaaaaccaaaccacatgcacacgtcaaagtttctgtaagttgaatcaataatgttcacataaacactggtttttccaatatgccaagtttttatgttgtgtctatattacataaatcttcaaaatatttacaaaaggagacaacctggttaactaagagtactaaactagaaatcaaagttcttaaacaaaaacggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttagccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatttcaaaataatttttactttaatccttaactcctaaaaagcgtttcttcctcttttctttcatttcacaaagatttaaatttgtatttcgcataacccaaaatgacgatgttatgaaggcccaaaacaaaattcacgatttcatatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaagaaataaaggaagggagacttgatgtgtattgctatcctcgcagcgagctattctgtgtcacccctgacgccaccgtacactcactccgccttccagcgcgctcccgcgcgcgcccgcccagccacctccaccacgcgcccgcgctgtccctgaggctccggcttaggcgcgaggacgcgcccattccccctcctcctccagcaggagaggccgcggcttccccaaccttcccaccctaacccaccgcacccaataggctggccgctcaagccgcccaggtcccgcactgcccctcttacccggccggccactgggccggcctcccttccctgccctagccgtccacacccacgcgtacagaggggccggggcctccctcaagctgcggcctcggcctcctccccgcgcggcagctggtgcctccccggccctacggggctcacgcgcacgacacagccacaagatgtccgctctgacggaactactgccagctgccacgctccgcccctccccctcctcctgcctcttcaccgccgcggatcagtccgccaacgccgccgtcccgagcacaggaccgatgtgaggccgaagccagacggcttgcttcccacgtccggggccgagtgaatacgtgtcaagcccttttccttctccttctcggaacagcaccttcttactaaacagatcggagattggaccaggagggcgggggagggaggaagatcatgagctggggggagggtgaacgagtggcggaaacccttaggctcagagaagcatcgagaaccggaaggagaccatgggaggaaggtaaaggaagcagccgctgcgcgatccagccccacgcccctccccacagcgtcccccagtttcctcacttggtatcgaggagacgactctcgcgagaacttcgtggctggctaaccgaagcggtagctctgcaatgacttaagagcagttttgtgcgcttttcctgacggggttccgcctccaaaatgcataagttctcgcgagacgcagtaaggcaccggctcgaactggggcgggccactgccaggaaagcaacgcccctgaatgcttatgccggtggttggtagaggaaatggaattccccagactggtaagagcgcgcgcagacacagccttgtctcacgcgcccaatcaggagcgtgtggtgggaggtgccaaggattaattaccagatacctttagtctagctcgagccgggattttgaggtttccggtggagcaggtgagcagtatttactcgcctgccctcctgggctggttatggtgtgggaggaggcgcccctcgagatgggaatagtagttttaaatagacccaggttggccgctcatcagcgctcccacgtgctgaagtctagtgcacgtctgaccctaagggagcaatactgagaacagcagggagcaggctgagtcaagctcaattgagtggatggggctaggacagagagagttaggggcagggttttcactggtctccgtaatcagtcgctgccgtccgccaaggtgtagatgtgggaacaagcttaaattctcaaactttagcttctgttgctgtgtttcagttcttgagccagaaagtgttgagactaattagttaattaggtagagtttagagtcagaaaaacaatacaatacttcctgaaatatccaagttgggaggtgggatttacctcagtaggattggcctgttttagtcaagggtttaaagtatggagacggcagttatgctctctagtgtatccttcaggcaaaagaaagaccttaatttttatgaggaatttaaaagtgggtaagcactgaccagcttaaggttttttaacattccttaatgaccccagttaccgaagtggagatcttcaattacttggaaaaataaacttgttttaaaaatacacttaatttgaaaactgttgcagaaagttttacctaataaaaacttaacacgtcaacaatgatgaatataagtagtctaatgtatactgttcaagtgaccatgtagtgtcactagtgaagcagtgtttctcaaactagtgtccataggaaccacctggggttttgttgaaaatacgactttgatttggtagggcagtggtggagcctgagagcctacatttctaactagctcccaggtgatacagatttttctcgtctgaaccaccccgtgagtagcaaagcactgaagtgcttacctcatggcctaactgctcatgaggctcacctcagtaacacctctggcccctccctcctccctgaataatctgtgttctctctcatagctagccagatatactaaaagcacaggactaggcatgaagatggagggaggaacccagattagttattgcttcccatttgcttgatattggcctggttagttatcttctaaccccgtttcttcaccgctaaagtaagtaataatgactgtcctttctcacagggtgattgtgtggttaaagtgtcataatatatgtgaaaggacactggagactctacagtgctgtataaatgtcagttattaaagtaaccagtcagacattaactggccatagtgtgaaacaaatgtatagtagtaatagtggccacgcctgtaatcccagcactttgggaggctgagacgggtggatcatatgagatcaggagttcgagaccagcctggccaaaacagtgaaaccccatctctactaaaaatacaaaaaattagctgggcgtagtggcgggcgcctgtaatcccagctgcttgggaggctgaggccggagaatcgcttgagcctggaaggcggaggttgcggtgggccaagatcactgcgacagagtgagaccctgtctcaaaaaaaaacaagaacaaaaaacaaaactaatatatatggagttctagattatccaagcttataaaggcaagtgattgtgtaatcacaaactcattattgttaggcagtgaagtaaattcattggttgattgggctttctgtttacaagtttgtatttgcataagtggacttacgtttctgcttatattttgccatggttaaaatcaaaagaaacatagcctagaagcattttgatgccttaggataaagcaggctaagattaagttaaattttaaaacattattcatgtacctgttgttacagagagcccactttacagttgcaaataaagttaaaacattttcattcatttaacttacttgaattacaatggtagagatgtcctcatttgaaacaagaaaggaaaataatcatgttttttatattgcagtcggaaataatgctaacaagaaaaaaattatggctgtaaatactgaaagaaaaatttacatttagaaattaataaaggtacaaaaatgttgaaaatttaattaactaaaaataatcccttccttaataaatactattttgaagtcctaaaaactttgtaaatatagtagatcagattatcttgcatgaattgacataaaacatgagaaaatagaaaggatcaagaaaattaaagctgggctggtggcttacgcctgtaatcccagcactttgtgaggccaaggtggaacgatcacttgagcccaggagtttgagaccagcctggataacatagggtgacccagtctctacaaaaataataaaacaattagctgagcatggtggtacacgcctatggtcccagctacttgggaggctgaggtgggaggattgcctcagcctgggaggttgaggctgcagtgagctgtgattgtgccactatactcaagcctgtgatggagcaagaccctgtctcagagaaaattactagtaaatgggcaattaatctaccaatctgaataatggtggtgtgccagggtcttattacatgaatttttcagtgaggccacgttattataataacttgagagtaaggggttaattagaatgtattgatgaataaacataattaacagattttatatatatgtacttaatattgtatctatgttttcatgtatctttaattttgttacagaatattataacttgccaaagacactggctctagtacagtgtataccattttattagttttattaaattgtaaatgctacggtccagattttatattcagaatgctcatttacatattctgcctggaccaagtaatttggagcccaggtcaaccaaatgttattttacattgtttgcacaaaaatcaaattgatttctatacttaacaattcagaatctcattaagtcaaattaatatggtttaagaaagtgtactttatttcatgctaagatgtcattttggccttaataaggcttttggcatgtaatgaagcatgcacaaatctttgagataaaaatagagcatttttccacacaaaaacatatatatacacaaatgttcagagtagggctattctactttttagtagaaacaactcaaatgtccatcagctgatgaatggataaagaagatgtgatatatgtgtataatggaatattattattattataaggaacaaagtactaatacatgttacaaaatgtatcttgaagccttaaaacattctgtcaagtgaaagagccagacacaaaaggccacatactgtttgattctgtttatgtgaaatgaccacaatagtgcattctgtcttccaaaaagctggtttacttacaaacacaggttaaaaaaatatatatttgtaatactgcttttggtgtagggtgaggcacgataaagagactttcattcggtttgtcaatcagtgatacttaggtctgaataggcaagtgggagtctttcaggtttaggacaaagaatgttaatgtagtagagatctgttgatagagtcactcctagttttctatttatttaaaaaacatcgaattactattaggtgctagacactgaagatacataaaagacacagatgtcatctataagaaagtctcttgaggagaccagtaagcatcagacaacatcatagagtgggttcagtgacataaatgtgtgcacagagcactattaatgtactgaactcagctggcggtggtcagggaaagtttctctgaggaagagagttgtattaaaacaaatgaaaaaaagggagcaaggcaaagttggaaaaaaattgtgagggaggctcctaggcagaggaaacagcatgcaaagtctcagagatgacttgataagtttttaaaactagaaaaactttggctgcagtattgcgaggttgaggtggcggggggagcggcaaggagagaatgagaagacagaaaagatgaggagacaagatagatttgaaagacatgactggagatcttgagggccttttattttgaaggggatgggatagaatggagaaattgaatttttaacaaaaatggcctgatcagatttgatggcaaaaaggtaactgtgatagcaatgttgaagcatgtgcccaaagtatgtattgggatggagactagaggcaagaaaaacaggatgttaatgaaataatcctgaagaaatgggagaaagatctgaaatagttgcactaataagagagagtacaggaagtaaacttagtttatttactgggtcaagcttgcctaaaaaatatttgggggcggggggaattctccctccagttacctttattagaatgttacaataaaatcaagccaggcacagtggcttatgcctgtaattccagcactttgggaggccaaagcaggaggattgcttgagtccaagagtttgagatcagcctgtgcaacatgatgaaactgtgtctctacaaaaaaattaggcatagtggcatgtgcctgtggtcccagctgctctggaagctgaggtgggaggatcccttgagcccagaaggtcaaggttgcagtgagccatgttgcagcagtgcactctagcctaggtgacagagtgagaccctgtctctcaaaaaaaaaaaaaaaaagtttatagaaaaacaaaatatgatattctaataaaataacttgaaacaatagtatgaacttcctatgtttttagctcttaaagaactacgaaactaaagtttacataacattggaaacatgtgctacatgtttttttttttttgcaaatcaaatctcctcttgaaactcaaatgtaggactaactgccacaatttcatttcttttaaatttggccatgtctgtactaactgctgtgatccatgtctcagttctcttaccactttactagaacctttgggagacttttgttcattctttgactgatatcatttggctttcaagtggccagaaaaaagaattcattatctatttctgttccatctgcctcagacaaaatactattatgtgttgccaacaagatcataaacctaaataaaacacaggttctaaaatcacatggcagtacttagtataagtgggtatcaaggtgactgggactgtgcttacagtaattatagattactaaaatcacaaaatggaaaaaagttcatgtagagaattcaaagaatttagtttgatgtagatagagattataacaatccttttgtcacatacctaaagtggaatttgttgagtttgaccttgtgacttttgagtcaagaaatgctaggcaggtagaacagataaattaataaacctgattctgaaatggaagtaaaagggctttaaagatgttagaagcattttaagattcattctcattctggatctcaggacataatttcttatagaaaagtagttgtgcctgcagatcaatccacaaaaggctttaaaacccaccctccctgtatatattacacctatgagaaaatgctccatagaattccaaattgataacaggaggaccgacctacccctctgcccgccagaattcccgtggctcagggcaagtactgaagccgaataggaagaattgactgagggtaaatcatgttgagtggttggttgaaagctttgaaaagttggagaatggtggttaagaaatctgtacattcagacttcttgaatgtcactgtatgttttgggttagtgctgggatacttttcttttttagtgccagatccattaatttacattcctctccactgccattatcaattgcttcctaacagaaaccagtaagctttctttttcccccttttctacagagaagagcagtttcacaagattcaacttttcttatacttttgttcctaaaacagatacacactctgttaagttttcataagggtttttatttctgcaagtatgactttagtgtttatatatgattataagcaggcagctagcagggaaaccatgggtaaaggattaaaaaactctcatttgatcctggtttccctcctaccaccacttcagcccccaatccctgcctaacaaattagacccaatagaaaaagtcacaagattgagggccgggtgtggtggtacatagctgtaatcccagcactttgggaggtcaaggcagggtggattgcttaaacccaggagttagagaccatcttgggcaacatggcaaaaccctgtctgtacagaaaataaaaaatcagcatggcgtggtggtatgcaccagtagtcccacatactagggaggctgaggtgggaggattacttgggcccaggaggtcaaggctgcagtgagctgtgatcaggccactgccctccagcctggatgacagagtgagaccctgtctggaaaaaaaaaaaagattcaactttttttttttttgtcttttgtttgttttgagacagggtctctctgttacccaagttggagtgcagtggcaccatcttggctcactgaagcctctgcctccagggctcaaggagtcctcccacctcagcctcctgagtagctgggactataggcatatgccactaggcccagctaatttttgaacttgcccacacagattctttccccttttccatccatctccaatccccactctctcaggataccctgatggctctgtgggtatccttagtgttcacttatcacagtctacagaaccaccagtctaatgaatataaaatattttaaattataatgaagaagcctcattatgagtaatagtaacatgtgaagcaaatacaatcagccctccagatctgtgagttccacatccatggattcaaccaaccacggatccaaaatacacatttttaattgcatattttctgaacatacatacttttttcttgttactgttccctagacaatacagtatatttacagtgtttacattgtactaagtattataagcaatctaaggaggatgtgtataagttatatgcaaatattatggcattttatatcatggatttaagcatccttggattttggtatctgagagtggttctggaaacaatccctcatggatactggaggatgactataatatgaagtatattagagataaacatataaagacaggcactcagaggagtggcttaccagcagacatgtaataaaaacatgagaatttcagttgcctgacatctctgtaagccagagatatgtgctttttggctgcccaaagaaactatttcagtttaaccctgaaagaaaggaactatgttgtctagcataaagcagttacctcttcctcatctctaccagttagaccacagctacattgttatgtttttaacagctttattgaaatataattgacatacaataaattatacatacctaaataaacagtttgataagctaacatatatatatatacccatgaagctcaccaaaatcaagataatgaacttcaccacaagtttccttatgctcttttataaatcctttctcttgttcttcccccacccctctgtcttcttaacccacaggacacctctgatctattttctgtcacggtaaattagtttgcattttctagagctgtattgaagttgaatcacaatacaacttcttgtctgccttttttcacttagcataattattttgagacttacctatattgttgtctctcagtagttcattatcttttattgctaaataatattccattgtatgtatttgccacaatttatccattcaccagtcagtggacatttggtttgtttccatttttttttttttttttttttttgagactgagtctcactctgtcacccaggctggagtgcagtggcgcaatcttggcttactgtaacctctgcctcctgggttcaaatgattctcctgtctcagcctcctgagtagctgggactataggcactcgccaccacgccggctaatttttttattttttagtagagacggggtttcaccatgttggccaggctggtctcgaactcctgacctcaggtgatccactcagctcagcctcccaaagtgctgggattataagagtgaggcactccgcctagcctcttccaatttttgtcttattacaaatagggctactacgaacattctttacagtgtttatatggacatatgttttcatttctcttgagtaagtagcttaggagtggaatagctagattatatggtagatatgtgtttaactttttaagaaactgccaaactttcccaagtgttttttaccactttatggtcccacaagctatgtatgagtgttccaatttctcctgactggttaggattagtcttttcaattttagccattgtaataggtgtgtagtggtatttcattgtcattttaatttgcattttcctagtgaccaatgatattggcattttttcatgtgcttctttgtcatccacatatcttctttgctgaaatgcctgtctgtatttttccccattgttcattgtattccttttgtcagtatttatttataggtgacacatatgggagtggccttaaatgttttttaactaataaagtcataacaaggtaacatatacctggaggaatatgaaaaagcatgacaaactttactttgcgagatagcaaaatttaagatttcactatataaatctgagtactaggtcaattttttttgtgggtttttgggtgaaacctgctagacagattctaaaagagcagtcacactatgtctattttttaaattattagctagcagaaccacctcaactcacattgactagtccctaagtcacttccacaattaagagtataggcagtagtgtgatagaactggcttgtaacagcttacaagggtcaatttaaaaattgtaggaattttgcaggctgattgttaaacacagccattattaaaaattatagaaactgacaattatattaaaatctgttaaataaagctcaataataaatactcaaaactcacttcctagttattttactatagacatacctaattttattgaacttcatggatatggtatattttacaagttgtaagtttgtggcagcccatattgtgcaagtttgtggtgccatttttccaacagcatgtgcctactttgttagtatgttttagcaataaagtattttttaattaaagtatgtacacaggccaggtgcaatggctcatgcctgtaatcccagcattttgggaggctgaggtgggaggatcgcttgggcccaggagtttgagacaagcttaggcaacacagtgatcctgtctctacaaaaaatttttcggctgggcgcagtggctcacgcctgtaatcccagcactttgggaggccaaggcgggcggatcacgaggtcaggagatcgagaccatcctggctaacatggtgaaaacccatctctactaaaaatacaaaaaaattagccaggcgtggtggcaggcacctgtagtcccagctactccggagaggctgaggcagaagaatggtgtgaacccgggaggcggagcttgcagtgagccgagattgcgccactgcactcaagcctgggtgacagagtgagactctgtctcaaaaaatatatacatatttttctaaaattttctaaaatagctgtagtctcagctatttgggaggctgaggtgggaggactgctgaaacctgggaggttgaggctgctgtgagccatggtcttgctgctgcactcctacctggtgacagagcaagactctgtctcaaaaaaaactgtgtacacttgttttagacataatgctattgcacatttaaatagtgtaaacataactttcatatgcactaggaaatggaaaaattcacgcgaactaaacccacagtatctctgaggtatgctataccttttactgtgttccgtgtttttgtggttatgtctattgtatctgcatggtggaagtattacagtttgatagtgtgcacctcttcccagctctgtgttcagtgatgttctttggaacatgacacagtaccacataggagtactttccccagggaaatttgaaaacaccacagatcagatctctgcctgctgctccctacttcaggctagttgttaaactttaccagcacacttgtgatgacatgacccttcaagttgactgacttctgtcagtaatgaataatcgaggcatcagttagatggagagtttacctttgtgaaacacttaactctcaaaaagaaatatttttgttacagaataaagcttgtaacacctagttttcttggtgttcaatgttttccttacttccaaattctctaaggtagagaaaggtaaagtctgactactggataaggggggatactaatacagtagttctgtggtctcaagtaaaagcgtaaaatattacatttgaagtagaactagaaaggatgctaaacaaaactgtgctgggcaaaaaaaaaaaaaaaaaaaaaaagaggaaaaggaaaggcaaatagctctatctaaccaaaattctattcatgtgagggagcaaaagatgatacaagaggagagtttcttctgacccccaaatcagctttttaatggatgaagctctttttgtccagagttactgaagcttctggatgttgttaggaatttaagttcccagacagattcagtaaaatactatagcagtccagagaaaaccaaataaacttgcagggagagggagggaagggaaattctaagtataaaagataaatctacagctaaggttgaatggctgttacaattaaatttttttaaaactaggagaaactgactaaggatttcaaatggaatagaaactgtcttacactttagggtctaaatgaaaggcatatacatttaaaatgtaaaagaaagaaatatatcatatgactttcttcttctttcttacttttttgagacagggtctcactctgtcacctaggctggaatgcaatggcgccatcatggctcactacagcctcaacctcacaggctcaagtgatcctcccacctcagccaccaccaccaaagagctaggactacagccgcttgccgccacacccagctaattttttttatcttttgtagaaacagggtttcaccatattgcccaggcttgtcttgaactcctgggatcaagcaacctgcccgcctcggcttcccaaagtgccatgattacagtgtgagctactgcacccggcctcatatgattttgaataaggcatttgctttatgctttacaaggtactagtagtaaaaactgtttagagtgatgtacataaagaacagttcagacacaaatgtaagacctgaagctataaaactactagaagaaaacaggtaaaccacttcaggacattgggtctaggcaaagattttatggctaagacctcaaaagcacaaacagcaaagacaaaaatagccaaattggactatattaaactaaaaagctcagcaaaggaaacagcagagtgaagagataacctgttgtatggaagaaaatatttacaaactattaatccaacaagggactaatgttgagagtatacaaggaacttaaaagtaaaacaaaaataaccccattaaaagtggtcaagcgatgtgaatagacatttctcagaagaagacacaaatgcccaataagtatatgaaaaatgtgtaatatcactaatcatcagaaagatgcaaatgaaaaccacagtaaggtatcacctatgacagagtggttattacgaaaataacagatgctggtaaggatgcagaagaaattcttttatactgtcagtgggattgtaaattaatacagcctctatggaaacacagtatttctcaaaaaactaaaagaactgccatatgatctgtcaatcccactaatgggtatttattcaaaggaaaagaaatcagttcaatgcagcactattcacagtggcaaagaacagaatcaacttacgtgtccgtcaacagatgaatggataaagaaaatgtgttacctatgcacaatgaatactattggccacaaaaaagaatgaaatcatttcctctgcagaaacatggaaggtactggagattattgtgttaagttaaataagccaggcacagaatgacaaatatcacatgttctctcattcatgtggaagctaaacatgttgatctcatggaggcagagagtagaatgatggttaccagaagctgggaaaggtgtctgggtgggaggggggatgaagagacgttggtgaatgggtacaaacatacagtgagatatggaacaaaggaatgtttaatagcagagtagggtaactatagctagtaacagtgaatgctttttgtattttaaaatagctaggagagaagacttgaaatgttcccagcacttagaaatgagaaatattcgaggtgatggataccccagtcaaggtaacaaaatagcccatatacctcataaatatgtaaactattatatatcgatttttttaaaagtatagcagtttgttacaaaaattagctgggcacggtggcaggcgcctgtagtcccagctactcaggaggctgaggcaggagaatcgcttgaacccaggaggcagaggttgctgcagtgagctgagatcatgccactgcactccagtctgggtgacagaacaagactcttttaaaaaaaaaaaaaagtatagcaatttggtattaaactggaaggaccaaaggacctaacaaataatctttaaaccagtcaatgccctatgtaacttgtttaccaataaattggacagaacagatggaactttagtgatacaggtggtttatttttaaatgaggagggaatacaaattccccaggagataacctctttctctaagaacataaagttttatgtaggagacagaacattctcatatgaaaaatacctaagaatatatgaaactaatatatgtaataggaagctattacatatattaatggtaacttagttgttcagtttttagttactgctgaacatcttgactatttaaataaatcactattttttccctaaccttgtccagatttctaaaactcagttactctcctaaccagtctacttaagtgaatatatttttccagtcatcaagactaagattcagtataatggagtcatctttgtctttcacccttccctttccttatgagtgtccatttctacttatttaggccttcaatgcatattacaccttaaattgtataacagtttatacattttaaaagattttcatcattatgtaatccctctgagttaagcagaagtgattaacatttcatcactcaagtatttattgagggcctacaaggtcactacaaggtgagtgacatataaataaggatgcagaatcaggcaggtcaaatgacttgcccaaggtgacaggatcagtgattattaccagtcttatgattctaatatcagcattcttttcattacactatgatgcctctcaactcatatttggtccattactataaattcatagtgggcttctctgcctctacttttccttctccagactatcttgcacatcaccattaaattaaacacagctttcattataatgtagcacaataaagaacttttcaatggtttcctattgtatagaggagaaaaactttatctctactttttacaggatatctctattaaactgtgatcctcatattcttttgaacatacttttacttttctaagagtatgcctttgcttttagcagtttaaccttctttgagtttcaagtccctaagtaatagttattaccgtagatctagatatttatgtaccaagcattatctatagactacatatatgcacaactaccttgtgtattttgactgagggagtaaagttttgatactaaaaaaaaaaaaaaaagagtcctctttgctgggtgaggtgcctcatgcctgtaatcccattgctttgggatgccaaagcaggagaatcacttgagaccaggagtttgagaccagcctgggcaacatagtgggaacctgtttctaccaaaacaaaaaacaaacaaacgctgggcatggtggtgcatgcctgtaatctcagctactcaaggaggctgaggtaggagaatcaattgaggccaggagttcaaagttgcagtgagctatgatgaggccagtgcactctagcctgagtgacagaaagcctgtcttaaaaaaaaaaaaacctcgagtttcacttctgataattaagaactcagtggttttgatcatacttctgctgtgaacaattaaaaaagctagaccaaaaccaaacaaacacccctgtttaaaggcacttgttagtgacaagttgtattttccactatcacaacaaagaaaaaggcaaaatatgtggcaggcgtctttagatttggagacaacaaaacatagtacaattgggtaagctgttcttagaggcttaactgtaactgtaagactaccagttttggccaggcgtggtggctcacgcctgtaatcccagcacttcgggaggctgaggtgggtggatcacctgaggtcactaaaaatacaaaaattagctggaagtggtggtgcatgcttgtaatcccagctactcaggaggctgaggcaggagaatcgcttgaacctgggaggcagaggttgcagtgagccgagatcttgccactgcactccagcgtgggcaacagaataagactccgtctcaaaattaccagttttgagtggggtagggcccagacttaggctttatgatcctgtagacccaatgatattagaagttaatgtaggagagatgttatatgaagcctctggcaagtttcagtgcaagaattacaacatagacccttaaggtttaggagtaaggccatatcttccttagccatgattttgtttcatttttttttttttatttgaaaagtacctcttgacttgctactggtacctggaagagatgtaacacctgaccatgggacatcaagtgactgtgtgaatcaaactgcccatcatgaattgttgttatttgactcatcaaactgtacaactggatgaacacaggagcagtgcactacatatgggactggaaccatgaatgagcaggtgactcagactcctatagtacctgcctctactccttcagcacttctccctcaacccacataaactgtcatcataatgagttccctctgaccagttaatggaagagaaaaaagtatggatgttatggatatcctaacatatttctggccattggacccctagaaacctgtggcaagagtcctggaagtttttcaaggttcatcttgcaccttctagcatgcatatgtcgtaccaaagcatgtagaatgctgcctacttctgctcttcagtttcatttaatataatttcattactctgataaatcagtgtgatgttctatggaataacaaaagaccgtcaaggtcccttcataccatatagagaacaggagagttgatgtagcctgagacaagacagtaaggacttactgttatccctcctatttaaacgtagtctgtttctgattctccttagaatgggggtggggggacatttccagatcaatatcagatcagtatcgtgtcaacatgggtattaatttcttccgaagaagataccacacctagaacagcaaccataattggcatccctacctaattaaagtttgcagtccactgtcattcttcactagccatctggtttttatattgtcattctctatgatgcatctggtggccacaggaaatttaaatgggaatgtggtatgaatcaccatggcagcatggtggcactaatctctgcaattcttttggtttttctattttgcttttttatgttttgtagaaatgcagtcttgccatgttatataggctggtctcaaactcctggtgtcaagcaatcctcctgccttggtccccctaagtgctggggttacaggcatgagccactgtgcctggccaatctctgcaatttcctcagggatatagccctgcttttcctttactatcttaatgaggagtggtagaaagcagacctaagctgctgtgtagcactttctaccataatagcaatccctccattgatcaggaaaccaaaataaagattgttgttaaaagatacatattaccactacacatctgggactggagaaatagccacagtatgggtccttctggatctactgttagccacagccaggccaagattccatcacttgacttccttaggttccctattctgaccagttgtccagggtagagttttgggtttctagtattagtacaagttaagagacagtgccttaagaattctagccagcctgggccgggcggtgggtcacacctgtaatctcagcactttgggaggccgaggtgggtggatcacgaggtcagcagatcgagaccatcctggataacatggtgaaaccctgtctctactaaaaatacaaaaaaatttacctaggcatggtggtgggcgcctgtagtcccagctacttgggaggctgaggcaggagaatggcgtgaacctgggaggcggggcttgcagtgagccgagatcgcgccactgcactccagcctgggcgacagagcaagattccatctcaaaaaaaaaaaaaaaaagaattctacccagcctggccaatatgacgaaaccccatctctaccaaaaacacagaaactagctgggagtgatggtgcatgcctgcagtcccagctatttgggaggtagaggttgcagtgagctgagattatgccactgcactccagcctgggtgacaacagagcaagaccttgtctcaaaaacaaaacaaaacaaaacaaagaattttggatattttcctttctctagtgaatggtcactggtccctatggaaaaggcttagggcaatgattcccccaacatatctgctcactggaagtatctggggaacttgaaaaaatactgatgcctgggtcttccctgagattactatttaattagtttgggttgtggcctgggctttagaatcctaaggtgttctaatgtacagacaagtttgagaaccccactggattagggaacaattcgttgtatacagctgtgattgcattgcccctttcgtcaaaggatccagtctctttccatcagtgaaggagtaccaagtctgggagctagatgagatgcttcaaattttactacaaaaccacaagaatttttccacctatatatgtcaagcagcaccttggtaggttactttattatatttccagggacctcatgatcatttagccattatcacttttccctgtgggtcaaactactctggttaacgttctctcctttgacttattttggtaattgtgcctactttgtctctgatatttatttatttatatttttatgttttttgagacagagtcttgctctgttgcccaggctgagtgcagtggtgtgatctcggctcactgcaacctccacttcccaggctcaagccattctcttgcctcagtctcctgagtagctgagaccacaggcatgcaccatcacacccagctaatttttgtatttttactagagatggggtttcaccctgttggccaggctggtctcggactcctggcctcaagtgatctgcctgcgttggcctcccaaagtgctgtgattacagacgtgagccactgtgtctgtcttgtctctgatatttatatgccattatgtggcctctactgccttaggattctaatgttcccactaagatcagctaactcagttccactacagggtttaccaccatcatctctcgcaaacaaagacagccacttcagagctcctaggaaatagtggtgctcccatcatcattgcattccttaatgacatggtgaaaattaacaatggctaaggagcctttgtgttttctcctctacaatatgcccaggaatttctggcattttggccatcttatttataggctattactgaatttaagcctcatcctaccaaattattaatgccaaaatattaactcttgattcttaggtgagtgcacccatgccaataaatttgccatgatctaaccttaaatgtattctcatatatgctgtccaagtttctgctgattaaaatggcaaggcctttagttctcctacataggttttctctctccagagaaggcctcaattctctgactaggctatgttgggatataactggaggcactaataggtagtagggtaaattctttattttattatttttggagacagggagggtcttgctttgttcagactggagtgcagtggtgtgatcatggctcattgcaactttgaactcctgggctcaagtgatcctcccacctcaaccttctgagtagctgggactacaggcgcaaaccaccatgcatggctaattaaatttttttttttttttagagacagagccttgctgtgttgcctaggctagtcttgaactcctgggctcaagcagtcctcccacctcagcctcccaaagggctgggattacaggcatgagctaccatgcctagccccagccggtaaattctgaggagagcatgtatcagcttgtgaaggagcttgcccaagtgcaatcactgaaagcctctatgcataggagcctggtttcctcagaaagagatttaggggaagattgatgttcagagttttcagcttcatttttctctgctcaaatgtccctatcgtatgtcttaggactcctctccccaccaatgttccagcattagaataggaaaggggaagaattaagcatgtaattgatactacaaatctaccatatctgcccagtgattacagaagataatcaactccttcagacctgtaatagagttctcatgctccacatacagtcattttctttttgttgttgtttatgatagtgtctcactccgtcgcccaggctggagtgcagttgtgcaatcaaggctcactgcaacctccacctcccaggttcaagcgattctcatgcctcagcctcccaagtagctaggactacaggtgtgcgccaccacacccagctaatttttgtattttttcatagagatggggttttaccatgttagtcaggctggtcttgaactcctggcctcaagtgatctacccacctcagcctcccaaagtgctgggattacaggtgtgagccaccgcacctggtcaccacatacagtcttaattgtagtttttatgtttttctttttcttatgtatttttcttttcttttcttttcgttagagatagggtcccactctatcacccaggctggagtgcagtggcatgatcatagcttacggcagcctcaaactcctgggcttagacaaccctcctgcctcagcctcctgagttgctgggataacaggtgtgtgccaccatgcgcagctaattaaaaaaaaatttttttagagatggggtcttgcagtgttgcccaggctggcctcaaactcctggcttcaagagatcctcccaccgtagcctcccaaataggggactacaggtattagccaccatgccccttaacccacgtatgcctagcgttccattattggaacgctaagcatgtgggaattatttatagcctactgctcaaggtcatcgccaaggtctgatttttcactcatgcaaaaattcaaaaaattgcaacctctggcacaaacgggttaagtactttctgtttcggaccataagaaaagccagatggatctataatctttataattaccatggttatcatggtgatacactcctcacctgcttcacttgatttcatgttgttactggtaatcctaatacaactgcaaactggctgggcacagtgactccttcctgtaatcccagcactttgggaggcaaaggcaggaggatcattggagctcaggagttcaagaccagcctggacaatatagtgagactctgtctctacaaaaaaagaaaaataggccgggcatggtggctcacacctgtaatcctagcactttgggaggccgaggtgggtgggtcacctgaggtcaggagttcaagaccagcctcgccaacgtggtgaaactctatctctactaaaaatacaaaaattagctgggcgtggtggtgggtgcctgttatcccagttactggggaggctgagacaggagaatcgcatgaacctgggaggcggaggatgcagtgagccgagatcacaccattgcactcaagcctgggtgacaagagcgaaactccatctcataaatgaataaaaaataaataaataggctgggtatggtagtgcacgcctatagtcccagctatttaggaggctgaggcaggaggattgcttgagcctaggaggttgaggctgcagtgagctatggtcgcaccactgcactccattctgggcaatagagtgagaccttgtctcaaaaaaaagtaaactaaatattgtaagccatggattacctgtagtctgtagtctctttccttataggaacgaggttattcctctgattgattttatgtgtgcctgtgtgtgtgtgtgtgtgtgtgtgtgtgtgtgtgtgtgtccaacccaatctcaaaatcttacttaagggtccatttcctgtaataacttctgttgcaaatcaccatatctttagagtcttaagaagaaatagaggacagattaaaaataatttaagaaggcttggcatggtggctcatgcatgtaatcccagcactttgagaagctgaggcaagaggatggcttgagcccaggagtttgagactagccgggacaacatggcaaaaccccacttctacaaaaaaaaaactagctgggtgtggtggcacacacctgtagtcccaggtacttgggaggctaaggtaggaggatcgcctgagcccaggaggttgaggctgcagtgagccctggttgtgccactacactgcaacttgggtgacagagtgagacccctgtctcaaaaaaaaaaaaaaaaaaaaaaggaaatatactggtaaaatgtattacattaataattttgtttatcaaggcaccattacaaaaagactaaccacaatgtaagaaaagatactggccacacatatatttgaccaagaactcatatccagaatatataaatgattcctaaaaatcagtaagaaaaagaatgacaacccaacagaaatatgggcaagtgactttaacaggcactacagaaaagatctccaaaatgtctctgaaggccatttttgtcaaaaacaaaaacatctccaaatgttaagtaccataaaatggtgctcaacttcaatggtcatcaagtaaaaggttaatgtcaaaatgagataccactacattcgcatcagaatgaccaaattaaaaagattgacaataccacgtgttgaccacagtgtggagaaagtgaaactttgtcacactgttgtggagcagtgacaggggacgggggacagggattgggtaaagtttccataaacttggaaaactgtcattctttacaaaatttgaaaatacatcaatgactaagcaactttaatcctaagtatatactcaacagaaatgtcttcacttgcatgtgaagagacatacagaagaatgcaccataattggttaatagctttaaagtggaaacagcccactgaaatatcaacaataaaatggataaatatattttatccatttaatagaatatagaagtgaatatgaacaaacgataaacaccacagatcattttcagaaatataatggtgaaaatatacattacataatttcattcatgtaagactcaaaactaggcaaaaatgatgtatggttagaaatcagaagagtggttacatttggggaacagtgacaggatagttactgggagctctcataagaaggtttctatttcctgggtgctggatacagggacactctgtgataaatcactcatttttgcatatatctatatttcaattttttaaaagggtggtccttaaaagattatgatttagggtttaccaccttgcccctctccatcaattcaaatatttcttccagttcagatcccacaccttacatgaagcctttcccaaccatttcagccagaaggaatttctctttcttcctggtttttatgccatgttctctgggaggtagtgtaatatagtggaaatagtataggctaaggaacttggactttaatctgtgtggcaataaagagcagaagagtgactcggtcagacttgtatctacctaccacaaatttaaccaattttacttatatttctctgtgaacaaatatgaaaatttatacacatatattaaatataaatatatagcttttataccacggaatactactcagccataaaaagaaatgaaataatggcattcacagcaacttggatggagttggagaccattattctaagtgaagtaactcaggaatggaaaaccaaacatcattatgttctcacttataagtgggagctaagctatgaagatgcaaaggcttaagaatgatacagtggacttgggaactttgttgggggcgggtgagaggggggtgagggataaaagactacgcattggctacagtgtacattgctcaggtgacaggtgcaccagaatctcagaaatcatcactaaagaacttatccatgtaaccaaaacccacctgttccccacaaactattgaaataaaaatttaagaatacataaaatgtgtaatttgtgagattgttacaatatttgccctcaataaatcatgcctactttgttcatgcatctttgcaatgtgcttttgccacttttcccatcaaaggctttatttccttaccccttgaatctagctatctttgtgacttgctttgaccacagaatgcaaatagatgtgactttgtacaacttcttagactaggtctagagaagcttcacagcttttttcaccgtttggaacactgcactgagaccactatgttataaatctgggagtgaaagacagtgtaaaggcagccacaggagtgaacacaggggagactaacagaactttctggccaaatcacagtgtggtgagagagaataaatcatgttgttttaagccactgttttggaatgcatgtgtaatgcagaagtagataatttgtaggaaacagagtcccttttccattacctagctcacctatttactctgttgtggcagagaatacaattatttcccaatgtcctttctcctcttcttcctttaatattagaacccccatttttttttgttttgttttgttttttgtttttttttttgagacggagtcttgctctgtctcccaggctggagtgcaatggtgtgatctcagctcactgcaacctctgctgcctgggttcaagcaattctcctgtctcagcctcccaagtagctgggactacaggtgcacgccaccacacctggctaatttttttgtatttttagtagagacggggtttcacagtattggtcaggctggtctcgaactcctgaccctcaggtgatccacccacctcagcctcccaaagtgctgggattacaggcgtgagccaccgtgcccggcagaacccccatatgttagctgggtacattgctacatggatagtgactataatttcctaactctcttgaaagtttggccatgtaactaggttttggcccatgggtcgtaagtggaaatggtggctccaacttctatgatacgcccttagaaagaagaggtatactcttttactatttcctgttctcaaatgtatcatggcaggagctggaactaccaccttaggccatgaaatagaagccacatattcacatattgagtagatcagattaaaaagctaaaagtagcttgagtacctaatatccagagctgctctatcagtcctgaaccgattatccttggactatgagagaaaaagaaatttacatcttatgtcattactattttgacctgagagcaagcaaacctataatcccaagtaatatgtgtttttcacattccctcgtatatatatgttcatgtatatatatacatttacaaatataaatatccatatgtgcacacacaaatatgtaaacatctctataggtattggtgtattttgttttacagattgagatcctgcacttttctccatctttttctcatttagcaatatctggaaatgacaactcatacaacttgaattcattccttttgatagctgtataatattttataggatgcaggagttgtaattcattctgctgttttcctactgattagctttcattttgttacccttttttccactatgaatatttttgtgaatagaaccttatgtatttctatagaacagattcccaagaatggtacagcaaggacaaaagatatctgtagcttaaaaaattttaatacaggttgtcagactgttttacgaataagttgaaaaatttcacatttatgccagctatctataacaatacccttttacttggacccctcaccagccatagttgctattggtcatttaacatttttcccagtctgaaaagatgtttcacctcacttgtgacaagagaaatgcatagtaaaattttactgagattaaacatttctgcttattagtcccaaatccaacagtttgaataacatactctaataacaatgctgtgggggcactctcatctgtttatacagcacctatggagagaaatttggcaatatctgtcaaaattacacacaaacacacacatctttttttttttttttttttttttttttttttttgagacggagtctcgctctgtcgcccaggctggagtgcagtggcgggatctcggctcattgcaagctccgcctcccgggttcacgccattctcctgcctcagcctcccgagtagctgggactacaggcgcccgccactacacacacatctttaacttagcaatctcttttctgtgaatttatccagcagatatcttgaacatgagacaaaattatgtacattattattcaatgatactgtttttaaaagctgaagactgaaaacaatgtccatgtccatcataaggtctagtaaaataagttctggcattcatgtagtggaatactaagcagccattaaaagataaggaatctcattatggagttacataaataattctaagatatattgtaaactaatatatgtaggacagtgtatatattgttatctttatttttaaaatggagaataatataaatttgtatttttctgtaaaatatctgggaaggtatgcaaaaaactaataaaagtattaatgggataggtggtggtgttatgagaaattggtgaacaggagatcatgggagactgaaacgcaaaacatctgtctctctctacacatacagtatctgaatgaactatctattcaaaaaggaaagaaaaatagctcctatagagtgaattcaatttcgcctactgtgagttttatgatcctcactttcatcaactgaataaaagggataagatccacttcaaagtactttctgaacactaaattagaggtgtgcttagctcagtgtctgtccatattaggcactcagtaaatgttagttgaattaaaaaaaaattgtcagtctgttagactaactggcatcttattattttaattttcattttcctgatttctcctgattctgagcctcttttcatatttggatttattattctctgaattcatattatttgcccatccattcttctgttgaattgcttgttcccttgatgtgaatttctgagttccctgattaaacctccttgcaaatatttttctaaatttgttgtgtatctattaatttcgtttagattttttttgcaaacaaatgttatttttatattgacaaatgtgtatattttttaaggataatgtatattctgctgttcttacatgaagtattctataaatgtcaactagatccagtagattaatgatactacagttcaatttttactgattttctgcctgctggatgaattattgaaagagagatattgaagtctctgtgatactggatttgtctatttctcttcgtggttctatcagtttttgccttacacattttaatgctgttaggtgcatatatgttaaagattgttttatctttttggagaatttacctctatacttatgtaatgcttctctctatccctgacagttttcctttttctgaaatctgctttgtctgacaatatagcaactccagctttctttttattagttttagcatggcagatctttctttatttacttttcacctatctatgtctttatatttaaagtgagtttcttacatatggttcctgaaaaaatgaaaaactagtaaaggctgttgtcttcctccctccaaatcaaccctgagtaacaacagaaacaagaaggaagcaaaagcttgaggaataagatcaaaaacttaagaggaaaccatagttagtgttaggagtaagttctgaaatactgttttgccatgccccactttgctttgggacaatcagtgccaaactactgattgctacagaaatcaccagcaacagatcaggcttcctgtaggattagataaagggtctgttgaagtgagttgccaatgaaaaagtggggctgaccagatactatagaatattggggcattcacccctccactccttccctgctgccagaattttgataaattataacagccttctgctgctggattgtggatttcaacacagatccttactagagaaacagtagcaaagagagagcatcagttctgtggttgcctacagctcttgctttctgctccttaaacttgtgggaagggataaaaacgagggtctgccattttgctctacctttctatccattattagaaggggtagtagataacactaggagaacatggcttgtgaaccaaaatatctagacacctgaggagtatgatcactatcaaacacaacaaattctacaacatgtaccaacagaagtagaataataggatataccaatacttttaataactcaattattcattcaacacaatttgtaaagatacagggtctcactctgttgcccaagctggagcaatcatagttcacttcatgcagccttgaactcttgggctcaagcaatcctcctgcctcagccttcttgctagctgggattacaggtgtgtgccaccacacccacctaatttttagaatattgtttatagagacgaggtcttgcaacgtttcccaggctgcttcaaacacctggcctcaagcaatcatcctgccttggcctcctgaagtgctgtgattacaagcatgagccattgtgcccagttcattcagcagttttttactgaacacctaccaagtgtcaggtactaaggattcatcagtcaacaagataggtaaataattttgttcatgtgggacatggcaagggggacagagacaaaaagatacaaattaactaaataataaacaattttggaaggtaatatttactaccaaaacaatgcagagtaggtagattgggactgatgaaagggttgccattttaaaatgaaacccatcctaaaataggagccacaaagatgcagggttgcggtgaggctggtaatatgtgaagagtgaacaagaaaccataaagccatatgagattattaggtgtggaaaaatatgagctaaaataaggatcatagctgggcatggtggctcatgcctgtactcccagcattgtgaaaggcctaggcaggcaaatcacttaaggccaggagttcaagaccagcctcgctaacatggcaaaactctgtctctactaaaaatacaaaaattagccaggcatggtggcacaagcctgtgatcccagctactcggaaggctgaggcaccaaaaatttcttgcaactgggaggcagaggctgcagtgagctgagattgcgccactgcactcccgtctgggcaacagagcaagacggtctcaaaaataataatgaataaaaaattaaaaaataaagaacatcatagataaatagcaggtggattggatcttatgatgcttttgagatacagaattttaatatttttgtgcagttaaaatctctagaacttttcctttgtgctttctagtgctttcatgctttgaaaaaacctttttatccagagatatttttaggttgataattaaaatatttaaaatcataatattcgtatatggaaagaaattcaaacaaaataagatactagaaagtaaaaggcctcatctactgtctctcctcctttcctcagaagttatcatttttctaggtatccttctagaaatgttctatgtataatcaaatacatgtaatttttaaaatttataaataggatactatacatactttctacaatttgcttttttcattcacacatatggccctactccagagattgaggttttaaatatcaggaagaattttatttagaaggcaaaactacagagacaaaagataattggttacccaggggtataagttaggtaggggtaaataggtggagcatagggcacttatagggtaataaaatgattatgtatgctactattatggtggacacatgacactatgcagttgtcaaaattgatagaactatacagcacagagtgacccctaatgttaactatggattttagttaataatgtagcagtactggttcatcagttgtgacaaatgtaccacactaatgcaggatattaataggagaaatggtgtgtgttgggttagagggtgacatatgggaatctgtattttctgccctgttcttctgtaaatttaaagctattctttaaaaagtctttgaaaaaacttcatttagaaaaactattcttaaagctttgtatagaatattttaaagttggaggctagaggtcacatatctggtagactgttgctatggcccaaacataaaataataaaggactatactatggtagcaaataaaattactttgaataggtttgctaatacctaagaaaatttcacattagaaattgagtggaatttaaagtttctaatataaagaaatcatgtgtcaaacatagtgttaatcaaaaataggaaaaaacaatatgcataaaaattatgagaacaaaaggaaatgtggctgaaaagatgctaatagccataacatgttgaatatgttgtttctttttaaagttaacatgacacagaggaaccaggaaatgcgtctactgcatttagttttatttatgttcttaaattgtttatttccagatttctgtaacatgtatatatatttttaaattcaattttattttgtgtgtgtgtgtgatggagtatcactccctcgcctaggctggagtgcagtgctgcgatctcagcttattacaacctctgcctcccgggttcaagcaattcttctgcctcagcctcctgagtagctaggattacaggcatgcaccaccacgcctggctaatttttttgtatttagtagagacagggtttcaccatgttggccaggctgatctcgaactcctgacctcgtgatccacctgccttggcctcccaaagtgctggggttacaggcatgagccaccgtgcccggcctgtattttcttaaaagatcagccattaccaagttattattggatgcctttaatctcttttgttagtgtatccatattccaataaaaatttatttataaaaacaggcagtggtctgctctataggatcttgcactaataagttactttaattctttaaggttgtcttgagaattaaaacacataatgtacaaataaaacaccatgatttggcatatagtaagcacttgaaaatagtagtggctattttattaaaatagtgtgttatcatacagctcaaaatgctgataagatgaatctgaaattcagacttaaaagtatttttattatagtaacaaggttatatttgggattttaagttttgttctaccaccagtggtagtttaaggcttcttgtataacggttctttgtgatgtttttcttgtcagagacacgtgtgatgaactcttgggacatgttccactacttggggatcctggtatttccttgctcagttttcacaagaaataggtttggcatctctaggagtatcaaatgaagatgttcagaaacgacacaaggtgtcgtttaaagtttaaagtcattttcgactttaaaaaatattctattgatatccattaataatgtagtaaaagcttccaagttactataaagtaatggttctggaaagagcatgttaatttaaaaaaataactactttaggtatgattgacatgtaaagctgtatatattgtatataatacaattagtttggggatacattctaatcatttatgataataacaacttagatctcatacaaaaactcgacactttaactcatctgtcctctcccacattgttatcgatgtcaaaatttacatttttatattgtgcatcaattaacaaattactgtagctatagttatttttaatacttttaactcagagttaaaaatgattttatgtatcaccattacattacagtattctgaatgtaactctatacttccctttaccagggagtttcatactttcacgttttcatgttgctaattagcatcctttagtttccacttgaagtacttcaactttagtttcagttttagcatttcttgtgaggcaggtctagtggtgatgaactccctcagcttttgtttttgtggaaaagtcttcatctttccttttctgaatgacagctttgtgggtaaattattcttagttgggaggcttttcttttctttcagtattttgagtatatcatcccattctcttctggcttgcaaggtttgctgaaaaacctgctgaaagtcttataggagctcccttgtacatgacaagttgctttcctctgctgctttcaaattcttcgtcattaacttttgaaaatttgatcacaatgtgtctcagtgaaaaaattttcatatcagacaggtaatgtgccagtgttttggcaaggtctgagaaaggcacatcttacacaatggtatgaaaacccaatcatcatgcttatgaaccacaaaaagatcaatgaagacatctttatgttcaacctacatggaattctttgggaattgtggatctggatgttcattttcctccccagatttgggcagttttctgctattatttctttaaataagcaatctgcctcctttctctttctctgcttgctctaccacttctataatgcgcatattggtttagagtcctgtaggcttactttattatttttcctctttgttcctttgactggataatatcaaatgatctgtcttcaagttcattgattcttctttctgcttgattcaatctgccactgaagctcacttttgaatttttcagttcagttattgtgttctttagtttcagaatttgatttgtttttttttttgatatggagtctcgctctgtcacccaggctggagtgcagtggcgcgatctcagctcactgcaagctctgcctcccgggttcacaccattctcctgcctcagcctcctgagtagctgggactacaggcacccaccaccattcctggctaattttttttgtaattttagtagagacggcgtttcaccatgttagccaggatggtctcgatctcctaacctcatgatccacacgcctcggcctcccaaagcactgggattacaggcgtgagccaccgcgcccagccagaatttgattgtttagtggtttctttgttgaaattctcatttgttcatgtattgttttcctgatttcgtttagctcactgagattcaaggtgagtgttctgaattctttatcaggtaatttataggtctctgtttctttggggtcaactgctagaactttaatttgttcctttggttgtcatgttttcttggtgtgtgtgtgtgtgtgttcaactgctagaactttaattcctttggttgtcatgttttcctggtgtgtgtgtgtgtgtgtgtgtgtgtgtgttcttttaagccttgtcttctaactttgcatctgaagaaagagtcacttcctccagtctttactgactagcttcagaagggaaagacgttcaccagtcagcctgactagagattctgaaggtctctcagaccttttctatgatatgcccattccattcctcttgttctgtcttgggaggggaagtcttaggattgtgtgctttctttcaatctcacaaagctagactatgtgctgagaacctccttttattttctctagtgcagtgcctcagagtgttcaaggttgtgtgctttcttccaatccagcaggagccagttgctgatatctgtgtgctatctgctggggcctgcatacactatctgcaggggaggttgggctgctggctagtgggtgggtgcatggagtgctgggtgtgcttgtcagttgaggggttctgcaggtgaagtgtcctgtagggctcatgggtgagcctatggtggagtctgcaagccagttaggagactccacatctagctctgaagaatcatgtgttggttgctataagcctctgcttcttttcccttctcctagatattcctagactattcatctgtgaagagtccctcagtattctggatagggaaaaacagaagtgagccttttgggcggcaacacgcaaggctagggaagctgggcactcacttgactcttactttccttcctgggagaactcatgggccaaaagggcctctcttggcactgaactctgctgccttggaggagaaggatgtaggtaaagtgaaactgtttttcttaccctcttcaatgtgtctattcttgagtttttcattctactggggtgctggaacctcttagcaggtctcccaggctcccaaaatggtatttggtatttctgcaggggtttgagggctggaacctactaatccaccaacttgctgatgtcagtcagggtgcctttaatctgaatagtattatttcacacagaatgctatctctgagtttagtagctcagaggcaaaatataaacagttaaatatataaagtaacattattaaatctcacatttattctgtgcacaactacaatatcgcaaagcattatgcaggttccttcttcatgcctagttcatcggtgcttggagtagctagttccataaacttctgaggtaataagaatctgccttgttattttattatttaatgactatatttatagattacagtaaccatggaatttctaaggcaaaaaagatggcttccaaaatagcaaaagaaacttcaaagatctatggaattaagcttttaattatgcacatatgcatatacaattatgtatatcatatatgtgctttgtaaccataatcttttgtctagtcaatgactgcaaaagtggtatgtcagtatacacttacagaattatagaaaagagaagctttcttcagagctcactctattctatcatgtgtttgcttgtttatttatttattatggattgactgacagggtctcactctgttgctcaggctggggtgcagaggcataatcatacctcactgtaaccttaaactcctggcctgaggtgatcctcccaccttggctatatagataattctatatactgttagtttttagtaccacaaagtgttatggaaggtgatttcaaaatagtttcgccatgttattgatttatagatcccagttttgtttctttagttttccatttatttctagtttgctggacttcctcttaaaactgtggggttaaggcaaggcagttccaaatgtagttcctcatacacaaaggggaagtaagaacaccaaacaccaaaatcaaaatgttctaataaaaaaagtttatctctttaaaatgttgaatagacagatttaataataattcttttttaaaaaaaattgattagtttctcatatgataatcattattttaaccccaacctatagtccactgtaagtatccttttaatttgttaaagcatattagttgttccattaatttcatctacttttccaatccatcaatctgtgattccttttacctttctcttattttgggtttcttataccttgatcaaatgtcctactttttcttagtttattcctcatttaggtggaacacatcctctattagctttctgagaagagaatgcgtagattgtgtattttttaaaccttttaggtttgaaaatgagtttattgtagtttcacaatgggttcttggtttggattggtatagaattctaaattataggtagtttttcttcagatattttaagaattgccctttaactaccagagctactgttaagaagtccagtacatttaacttttgtagtatgtgtctcagtctgtttgggttgctgtaaaggaatacctgaggttgggtcatttatttaaataagaggtttatttggctcatggttctgcaggctgtacaagaagcatgatgccagtatctgcttcttgtgaaatcttcagactgcttacactgagggcagaaggcaagaggaacccatgaatacacagttcacatggtgagagagaaaggccagaagtgaggggtatgggtatgcccaggcttctttgtttttctttgttttttttttctttttttgagacagagtctcactctgtggcccatgctggagtgcagtggcacaatcttggctcatagcaacctccgtctcccaggatcaagcgattctcctgcctcagcctcccaagtagctgggattacaggtgtgtgccaccacacccagctaatttttgtatttttagtagagatggggtttcactatgttggccagtctggtctcgaactcctgacgtcaggtgagccacccaccttggcctcccaaagtgccgggattacaggcgtgagccaccgagcccggccccaggctctttttaacaactacctctcacaggagcgaacagagtaagaactaattatcacaaggactataccaaaccattcaggagggaaccacccctatgacccaaacacctcccactaggccctaccaacaacattggggatcaaatttctttttcttttttgagacagtctcactctgtgacccaggctggttgcagtggtacaatctcagctcactgcaacctccatctcccgggttcaagtgattctcatgcctcagccacctgagtagctggggttacaggtatgtgctaccacacctggctaatttttgtatttttagtagagatggggtttcaccatgttggccaggctggtcttgaactcctggtctcaagtgatctgcccagctcagcctcccaaagtgctgggattacagacgtgggtcaccgtgcccagctgggatcaaatttcaatatgagacttggaggggtcaaacaaaccacatctagagaaagagctccagaaatctgcatggggttccttaagcattttatattaataacaatcttacatactcaatagccatgttattagtattgacacattacataattacattgatcatgtagatctagaccaaccactgtgaaaaaaacaaggtgcagctaataataaaaaagatgagttgataatgaggtaaaaaaaatgatgaagatgaaatatcatactaactatgcatgtatatgtgccaggtactgttttaattgctatctatgtcttaattcagtgaatatacacaacacaaccttaagatgtaggtattacctacatttttacaggttatataatttatcctagtagaatcagaattgtagtctaaacagtgtggctccaagagtctacagtcttaactataatgctgtatgtaattccttgcagtaagtagacagtagtagtgttttgttatattgttattaaatgccctttcttgaccaaataaaaaattggcaaacctatcttgacttcccaatttaaaaatttattggctgatgaaatctaaaagcctggaaatcatcaatttatagggccagtaaagaacaaaaaaaattaaaatttgagaagtaactgatggagcaaggtcttaaagggattcagctctagaatacagggagcagttagatttggagaacagaacaaaagctaaatatagaagggattatgaccaagtagagatgatggtgagaaaagcttctctagtaactaaaaatcaaggtcatctgagctcaaaataagcctggtaatgttaatagaagacataattattaatataaaatagtgaagatttgaacaacttttgtcaggaatgagaaaaataaataaatccaggaatgggctgacagagcagaaaaagacagggtttcaaaactaaatcaaagaatgtttagtggcagtaaaaatgtaccagaatgtgagattgtggtcaccagtaaaattgctgaatttaaggtctgaaagccagagtaaagggtcattcattgatggtaaagacgataatgataataaccattcattgagtatattacaaaattaattgtatctagtcataaccactggtatcaccatatcaaagagaagaaaactgaggccctaattaattttcagtaaaaagttaagtttttcatacaacttgacaagaggactctgaaattcacagagtagtaacaaggccaggcattcacaatgcaatttgaagaaaacaggtggggaagcttatcttgctagatattaacacttacttatatagttgtagcaattatgacagtatggtattgttatagaggttatacaaatacagcaatggaagagaataagcaacccaggatgtgtggaaacctgatttgagataagtgacattacaaaccacaaaaacaagtttaactcttcaataaatggtgctagaacatagttgtttgtatgtaaaataataacaaatgagagtagatccctttctcatgcacaaaaagtaagtactgggttgagtaaagccctaatatgaagaatataagtttaaaacttttagcaaaaacacaggtgaatacctttgtgatttaggggtagaaaaagatttcttaaacaagactcccagaacacaaattgtaaagaaaaagatgaataaatttgactacacccaaaccaaatttcagtataaaaacagacatacacggtcaggcacggtggctcacgcctgtaatcccagcactttgggaggcagaggcaggtggatcatgaggtcaggagttcaagaccagcctggcaaatatggtgaaacctcgtctctactaaaaatacaaaaattagccgggagtggtggcgggcgcctgtagtcccagctacatggaaggctgaggcaggagaatcacttgaacctgggaggcagaggttatagtgagctgagatcgcgccattgcactccagcctgggcaacagagactctgtctcaaccaaaaaaaaaaaaaaaaaaaagacatacactaggagaagataagcaacaggaaaagataagcaaccaatgtaaccaacaaggtaatattttccagaaaacatgtaccagtgaaactgatgaacaaaccaatagcacagtgggcaaagatgtcaagagcagactagtaggcatttggaattagactcctagaattaagattagcctaaagaaatctgggctggaaatagagatttgggctatatcttaacgatcatatttgaatttggggcactggatgacctaatgggaaaaaaacatgaaagaaataaaagtcttgggcctagctaggacaggcagaagatgagtgatccaagctcaagtgcttgaaagtaaataatgactcctttaactgtatttacatatttatcttgagttttctgaccacagtttctttatgtcttttaaagatggagtctaaaaacactatcgcataaggtggtcagataagcctattacatctatttagagcaatattatctttagaccatgtttcatgtgcagccaagaaggcagggttgtggaaatgaaatacaaatataaatgaaaacaggatttaaattttaagtaaagggaatttaagaaaatattccttttaagtggataataaggatttttaaattggtggagttaggaattatctcctattacacattcgcatagctcatgtaatgcatcagaatacctaatatatgatccacaccttttctctgaatttcaaggcctcccaaaaaagttttatccatatagacttgcattcactacattttttctacttgaaaatagcaaaccagctattcacataaactgctaagaggaagtaagccaaccataaaaaattacatactgtaaaattacttatatgtgagggtcaaaaacatgcacagcaatacagaatagtagtaatggtggtggatgtggttggaagggtcgctttttaaaaacgcctctattgaacattctgtatattgatgtgggtggtggttacctggaactgtacatttggcatttgagcattttactatatctttaaattgaggtatgtattttttaattctttaaagaaaaactgcttggaggtcttattcttaatgcacaacaatcacaaacattaaatttatacagtccagagaatgtaaagttgctttaaaaaaattctttccttttctcactttaaaataccaaggggaaaaattaaactcaacacagcacgtcttgcccttgtcaagatgacagatcctctaagagaagaaacgaataggtaatggccttttccagattttcttttcctaatgtaccccacttccaacctacccctacctcaactagggtatctagttgtacccaagggtgcttctacattagatccacagagattaaagataacagttaacagaatagtccagaggacaaggatattcaagttccatcatcttcaggataaaaaagctccagggtttacctccaaactctctctaaaggaaatcccatcaaccttttaaacatcactttgtatacaccatcttctgtactgccctagctcaaaaacatgaacctgtatctaaacgtgtttgtagaatttccattgtaagttttactttaacaattttgaacaattataatgatagaaaattatttaatctagattttggtcaactctattactgatattcttttttagtgaaggacaatcacaaacactaaatttatacagtccagagaatgaaagattgctttaaaaaattccttccttttctcactgtaaaataaaaataccaaggggaaaaatggaaagtatttattataactggctgttacactgtcatacacaatgaaatactggaccattagcagttcgttattatatgttgttaagtgtagaactgtaaataatgaggcatattattaagatatcacacacattatccaatcagcaagtgcacaacttcggacattttgacttcagccaaaatatgaaacaaagtcatagcaagaaagttatttcaagggagtgaaattttctcctcttacccttcaaatcttttagagatattaataaaaacaactatccagcctgggcgatataatgggactccatctacatacacacaaaaatttttaaaattcgttgggtgtggcagcacacgcctgtaaacccagctacttggaaggctgaggcagaaggatcccttaagccggagttagagtctgcggtgagctatgatctgaccactgcactacagcctgggcgatagagcgaaaccttgtaacaacaacaacaacaacaaaattaaaaccttcaagatcaagcttgcccaacaggatggctttgaatgccactcaatgcaaatctgtaaactttcttaaaactttatgaaaaaaaatttttttttagctcattagctaccattagtgttagtgtatttatgtgtggcccaagacaattcttcttccagtgtggcctagggaagccataaggaccccctgcgctagacttcagcagaagccttgtaacataaagaaaaccatacataaggctttagattctttttttttttttttttttttgtgacggagtcttgctctgtctcccaggctagagtgcagtggcacattctcggctcactgcaacctccgcctccctggttcaagcgattctcctgcctcagtctcccgagtagctgggacaggcacctgccaccgcgcccggctaatttttctatttttagtagagacggggtttcaccatcttgacctggctggcctcgaactcctgacctcgtgatccacccgcctcggcctccctaagtgctgggattacagacgtgagccaccgcgcccggccagctttggattcttttaccactttcccgaaggaaaaggaactgaaaatatctaaggaaggactactacgaatcttctctgagtggcaaaaaccagaggtttttggagctagggctgcagttaagttgccaaggggcagagatgtaaacagttcctggtttagttaaaatattttaatttttatttttttaagcctggcctttgggtgaaggagtaaaattaggcactggggtctgggtagggggaggatactcatgggcgagtatgcaaccctagggccacagcaaccaaactgtaggggaagaggcggggcgagaggggacgaagtagagacagcaagagactcacttttgaaaggcactttcggttagaaagcattctcacatgcttatctcatcgcacacagtatcctttctgctggtctccagcatctacagacgttaaaggcccaagaggagggccaccttcacacgagattccgaggagggcctcgctacccgccagttccc

SEQ ID NO: 2081 - DNA, 32028 bp, Homo sapiens; identical to SEQ ID NO: 2075

SEQ ID NO: 2082 - DNA, 32028 bp, Homo sapiens; identical to SEQ ID NO: 2075

SEQ ID NO: 2083 - DNA, 32230 bp, Homo sapiens
atccaatagcattgacttttattcattcatgttaagtcacctgaaatgatatctgttgcatttaaatgctcattaatgtaaatggctgaacaaatccatttcaatggatactcaatatcccacatagataagtcacttcaacacagcctcatgacaactcccacaccaaaacagtactttattttgcaaattttgacccattattactcccatgttgttttttttcagctgtcaagtgtacaaggtgaagagaaatttcagttagacaggggctgcacctggaaaataaatttcttaaactccataaacacatttcaaaactgctgggtcccaaaagtccatctatgaactctagggctgccagtatcatgtgcagcacattaaagctacactatccaaatagcttattaattctgcataaatcaggtcaagcaatgtgtcaacctgtaacagactgtgcactttaactgaacatggcaaaatattcactctttcgaactttacatcatcatttgatgtcaaacaatgaagcaaatcccaacagtatatacaaaaaacagctttgcatttacaaaagattgtttcccatactgattaatccaggcagctaactcattggtttatgcaactttattgaagaaaaataaatcaattactagcagagctattagttgatcactcatccattgacaacttgcatcatttattcagtgctatattaaacagtgtattggaagatagattaactaatagctccaagcctcctaacaatttaaatgaaaattacaaaatgtttgagaccctattttggaatacaaagggtgtttgacttccaatttccattctctgtagaacaagaacaggtcattcctttattgacatgcataaaatacatcacattttctgttctgctgatgctataaattcaataccaattctccagccacatcagttatgagcataaagcatatcatgtaacctcaaatctctaacagtggaaggcttaaacaagaatggatgctgctagaataatgctgtatcctttgatgtgacaactgagcatccatctccctccccctcagatgatttcttcagcatgttagagcagtgaggaatggttttagtctcataaccaagttagagtgaagacattggccacataatacacatgctccatttttttttttaaaaattctgagtcttgggcaactgttctcttgtaactactttacagtttctaaaagcagttattgtccaaagctggaagaacttaagtcttctcagatgagcatgtgaatgaatggagggaggtaaacaaaaaataaaattaaaaaagatgaggtctgataggggagcagccggataagaaaatcaaaaaaggaacagtaatttaaagtttattccagctataatgcaggttattctgactttaaggtagcatcacatggcatacttctgagtccattcccgagatattctgttgtacctgtaaataaagatgttatttttaaaagttaaaataaagaattcctaatactttaaatggaagggaaagatttccattttatcatctccagactcatcatgaagtcatctctaatgactatgattagaataaaagccaacaagggagaaatagcactggtactcaaagcaatgtgggaaatgagagcctgatgctctgaaagtagtattttaaaaacaactaagaaagcagcactgaaaattgggaggctaacaaaaatcaaaagaccctttctttctctaccaccgagctcatgctctaattttaacgtgaagaaatttttacagttcattatggacaaatgttaaaatagtatacacattctatctatccacagaaatttccaccaaggccagaactaggcttttactagaacaattttatctgaatcctagagtttgggaaattacttggtcctggatattacaagaaaaaatggctttgggacttaggtagaggcagaaggggaagatgacactgggcagaatgacaaagggcagtaattttcaaaaggggtgtgtgtgtgagtggttgtgttcatcagaatcacgtgttacttttaataagtgtggtaactgaggctaataagcaccactgagacctgttgagtacaacaagggcatcttcgtttaaaaagatcaacaggtaattcacacacaagcaaggttattactcaggaagactactaacattgataaatactatcagcttccccctggattatactcatgccatagactacttacaacaacaaaaaacagtgataaccttaagaaaggaatatatatatatatatatatatatatatatatatatatatatatatgcacaggagaatttttatattgtttaaatattaactagctttatttcaaaccaagaaccaaatatggtccaacaacttttctaaactttttaaaaagttctttctaccaattcattgtcatctcctaaggatactctctcaaaaagccagcactttaaaacaaaggctttatttagcatacagggagccacaaagtacagctgacgctaatgcatgcttgtcagtaatgaacatttagtttagatgcttaggcttaaaagtgtttttcccttacattactatctcctggcaaaatttgaactaaaccaccacattctgtataggattggtacaaagtctcaagctaaaatttaaacaccatgatagtttgaaaaaaaaaaaagatactacataaattcccatttcttactagtgctattgtaactgctttgccatgcaatactttcaagcagtaacggctaccagatatttactttcacgttaaacagagaccaagcagttaaatgtacagttttcagaagactgccatatttgttaccttttgttagttaatacagtgccttaacgcatgcagcactcaagtgctggcagtaccataataagcgcaccatagagtgcagatcctcttaccctacaacatagcgtatttctctgtccactctcttgctaacctattgtacctaattgaacaagtacacttagcattaattataacatatgaaagttataatggttaagttgaacataaatataattcaaatatttgagaaatttagaccaaatttttacaatagtactaacatttttggaaaaacatgcttggggtaaagaaaaatttgctttcttccccaaaagttgagaataaagtgatactgtttaacacgctaggaaaaaaaaaacaacaataaaacattttagaggggagcattcactgtcacataagctaaagcctagttaagtttttttaaataaccacatttcaatagctttctccatattttaactattatcttactaaatatcaagtcttcttggcactgtcacaagcaaagtataagcctaactcattaagtaaaaccacttttataataactttttaacatacttacttatctctgtctgttttatagatccgtgcaatctctggcactagggggtcatctgggtttggatcacatagcagtgaacaaatggataaaagaactgcaagaaaacaaaaacatctgttacccagtttcaggagtttggataaataaatttttctaaaccgtgtattacaaaactcaatcctcaaaagacttttattagtttgtatctttatctcaatgagacacagttttacagagattttgtttcacagaagacaagctcctggtaagtaagaagtgctaaaaacagggttttgtggcatgaaattcactgcagactagccataaaaatagtttctaagataggcaactgatgccatattaatatatatattttaaataggcataaatgatattagaacttgagtttcttggtactctgtggctgggggggggggactttagcaagaatatgcaggtaacactcatgccatattcatagccattaggcatgacgaaaaatccattcttagccgctgtcttggcaatttctgagaaaaaccctcaagtgctccactaaatgtctccttgaacttgtaagcaagaaaccatattcccaagagtactagttaaatacaatgccaaaatctctttagtactaagtgagtcatcagctctagttcttaccttaaccagctcaacatactgatgcataagatgtcaagcattaaagaacatagatcgcattcacctttgagtgccggtatgtgccagcaacatatatgtggggtgctgtattaaaatgttaagatataaatgctctgaaaggttctgaccggttttttttaaaaaaagcaatagtataaaaaagcacccttgtcacatatttattgactacagcaaatttaatttccaaaccccaaatacagcagaatataaaattacctaatataggagacttggctatacaataactcacagaaaaaaggtagcttcagttgtgactgctagtttaataagttagcaaagtatggctgccaaaaaagtaagttgctttaacgacaaaacaataccaattcaatctgcccttacaaaaacagttttcagtgttactgtacactcccagcagtagtagaaaaacttggaaactgatatttaggtatgtagcatgatttgaaaagaaattagaaagcatccaagaaggtgaaaaacaggtgtaaaattttaaaaacactcgaattatggcagcatctgcctaagttgtttctttttctcccttaagtgattctactcaataaagtttgggaaatgctactgctacagtctctctccatgagattcaagtgcagtatatacacatatgaaacttttatacaatgccttgccttttgaaaaagcttttttgtacttactgaactcataaaatcaaaaaacaattaatggtgaaatagtgttaattattacaacttcacctgggatattcatgcggagaccggaaaacttgttacatataacgtaacagatgcctattaagagaccagaattgatctacagatctttcgaagattatataattttagactgtcattaggtagaaacaacctatcatggttacataaaacatgactgaagatttgtctaaaaattaacccaggaaagcaaaatcagaattttcctagagtggaaacctcagaattcaaaagctctattaagtttaggtatatcataccattcttggtaaaaaggccgcaagttagtgtgagatgtccaagtggtttgggattgaaaaatacagaagtctattaaaataaattttgctattataagatgagatgaaggtaactcattaggcaaataatgcctactcaccacaatttgaattttaacaacttctcacaaagtatctttaatcaacaccactaaaagaacaaaaattataaaaataactttattgcttccccatctcttaccaaaaagctgccataataaaaatactcagataagtagatctaagaatgaagctttattagacaatgagaacagcttatttcactagaaatatttacctttagaaattgttaaagcaggcgaccactgtgatcttagaatatcgagacaaatgctgccattactgttaatatttggatgataaattcttgttgtaaatgcaacctaaaacaaaaacttttaagtattttattcaaataaaaacaaacatcttttaaagcaaaacttaaaataatcaagccacaatgttaaaaatgtcatctattagcatagaagttctaaatattatagaaactgatttttacaatctgaccacaaccccctgcctcctctttttacaacagaaacctaaacttttggataaaaatttcattactcatatgatgtaaagttctaaaggttactgtggccctaccatatcatgaatcaaagggcaatttaaaggtatttaacacattcatttataaaagccctaacttttggatgtaaccaaaatttgtagaccatctcatttaaagtttcattaagttacacaggtacacctgagtctgcatttccaccgtacataaaacataaacttgaatcacaaaaatggaaaccatcacattgcacctataacattactagagattgttatagtgacatgtttatgacctttgtatattaccttttctagttattcatacaggttgaatttatgttaatgactgaaaagtgaaggataatatgcttttaatacctataaaccagtgcactaagcaactctaagttttcacaaatttacacttacgtatacaaaactataagcataataagcatatgctgtaacaatacgtgcaaatataaattgaagttggacatttgatgcttacaagacaacaaaagcccaaaaatcagaatctgtgtaacaataatacagatgagggcggaagcttccacatggtctgaatcttgcaacattaaagaaaaggcaaaccttattcctatttacaaagctcaaactgaggtctagctctttaaaccaaaggttaagagtcagcatctatacatgagtgcaattcaacatatatatacagcctacacagaaccctatcttccaagaatgctctattcctttgaaataaagcataaatctatactaacagattttgagggaaaatacttgccttaggtggtttgaaggggtagtctgtaggaaaatgaattgtcaaaaagaatacaccgccttgatatgggctgtcattctgtaaaaagaaaagtatgcttaactcaaatttaaaatattattgctaaatattccgtaacatttgtttccaagcatttctctaataatgaacccaaatcacctatttacactgcaataaataatctattccatgaaaattcagtctatagtaatagaaaaaaacttaaaacttatacagtaataaaccctaatttacctagtcattttacacgtcaccaaaatgtttttttaaaaagttatccagaaacgcaagtattctagatctcaattctcaaaagtacaacacagcaataaagcctacataatcatgtttcagaataatctgtaaacaaaattttacacatgtagattatttcttccaatagccagatgtgtacaaatggcttcacaacagtccattctgcccactggcaaaccaaatgttagctattccaggtaacacacacacaccaccttcaagaggagaacagagaaaagcctaagcttctcattttaatcaataccagaaaatacatgcattgcccctattttatgcatgagaaaaatgaggcttaaagaacttagtctagtgtacaaatggtaaatgatagaaccaagattcaaacacaagtcttttgaagaccacttaatgatcaaagatactgacctactcaggaatttaaagttaaaatgtggaatgcctaactgcttctgggtatgcaaagaaccaatccgaagacatgttttacaacttacatgaactgggtttttaccaacactgactcccctctattagaaaggctttgtatatacagctatatatgagcctttcactatgcccattctggatgtcaggcacataaaaaacaggcctgacactaacacagctcatctaattcctacccttctgtaaaataaataaacattaattcaattaatctaaccccttgctatatactgtatgtgtgttaagggatccaaagaacaattttttttatcttgatgagcttacactgatagacatgtaaagtaactgcaatgaaatgttataggtatcatgaaatatgaacaagggacacgagttcaaagaagaaaggtcaatttattaatgaagaatcaggttcaaagaaatatacaactagtaaatggaagagcttttatttatttgagacggagtctcactctgtcgctcaggcttaagcgcagtggcacgatctcagctcactgcgacctctgcctcctgggttcaagcaactctcctgcctcagcctcccaagtagctgggattacacatatgcaccaccacacccagctaatttttgtatttttagtagagactgagtttcaccatgttggccaggctagtcttgcggcctcctgaccttgtgatccacccatctcggcctcccaaaatgtgctgattataggtgtgagctactgtacccagccagagcttatttaaagtgagtccttctccatctcccaagtcttccccctttttttttgtaggggtggagggcggggggaatgggaacgggaagggggacaaacaagacgtagaatatcatcttgctgtttgttgcccaagctcgagtaaaatggtgcaacctcagctcactgcaagcgccgcctccccaggttcaagagattctcctgcttcagctgcctcagtagcttggattacaggtgtgcaccaacgtgcccagctaattttttatttttagtagagatggggcttcaccatgttggctgaactcttaactcctgaccccaggtgatccgcctgcctcagcctcccaaagtgctgggattacaggtatcagccaccgtgcccagtcctttttcatattttctacaaaatatggaactagaaaaacactcaggtcacttagaatgtgacctgagtttattagattaacatgtctttattaaatagttatattaattttgaatagatgcttcaaatagcatatactttcacctgatccaatactatacaagatatgttttttctgtgtaaaattaacaatttaaaggtaatcccaaacactaaagttgtttttgttttttttgagacagggtcttgctctgtcgcccagactggagtgcagtggcacaatcttggctcactgcaaccctctgcctcctgggatcaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataacctaattccagaagttctttgtaagctttcatttcaattttcataaaatcaaatgctgtctatgactgcttctgaataaaggcaatctgctgatgggatttaggcaaagccaaatttcgtttcgtttgttcgaaaaaagaactttataaagaaggcaaaatatttcaatgttacaatttaacactaaagttctgccatgccaaaagaggaagaactacgaggttcagagataatgaaactaggcaatataaaaaattgagaccctatgatatttaaattctattatgaatcagcagcaaactacaccaaaaagaaacaaaatccccaaagaataaggaacactgtgatcagcaaatcgactcaaatcgtacaagtccagaatttatgttagattttttcagaaaccttctacttcttttgctctcatcagtgcaaagttgctccctcacagtgcctcagctcttctgtggcaataaaacgttggtattcttttttttttttttttaaagtggtgctgtcgcccaggctggagtgcagtggtgtgatctcggctcactgcaacctccacctcccaggttcaagtaaattctcgggcctcagcctccaaagcagctggaattacaggcatgtgccactacacccagctaaaaatgctggtattcttataggttgattttctactcttaactgctgacccataaaaatttgagttgcaaaatatatctctggtcagttattcattccagggcatatattcaaatgcctactgatatttctacttggatatctctacttggatatctcatgtcatgcgtccaaaactgaaacttgtctcaatcccttttttcctgttttttaatagcaagccataactgaaagccataaaccaggatctcatcatcaacttcttcctctcttatctcagaatcaagatagttatcaagtaagatctttaaaatttcttgaattagcttctcctttatgcccactgtcactaccatcttagttcatgatgttatcttcagcctagattatggcaatagcttactaatgattatccctccatcctaatgataaagtggtcttttaaaaatgttactcccctgcttgaaatctatgatagtttttaagataattccaactcctaagtacatacggtgctttatgatctgggtgcccatctagtttcatcttctgtctcttctatagaacatgttctctactgcacataaaatattatatggataacatatctttttctcttccctacttggaatattcttccttataatatagcccttcctttgtcttatctgctccctacccttcttttatacctctttaagcacatagttaccattatccacccatatatctaacatttacttatatttctcttttattagactacaaagctcctcaacgagtaaggttaaaggtggaaaaagtcttcaggtatcagtaacctacgtgggaaatgacataataatacacttgaaaaaaaagttgaaaaaataatccttatggaccaaataaaatagtacctatggaccaattattttaattcagatagtttttctggttgactatgctcaggctgccaaaggttacatttttcagatactttcacatttttcacaggtactctcttctacatctctgtcatagattaggtgggagttagtgttgttctctaaatccactttttctggatttccaataaaaaaaaatttaagcaagtaaatatcagaggcaataggtaaggaagtcaatttcttctaattacatcaattcttgttggaaactaaccttaatacagtaccccacgcccccctccccaaaaaaaaccacgcacacaaaaaactagcaatgctgtcatttctttcgaaggtttagtttttagtcaatagttgtgcttccgaagtagcttaccttcagaaagaataagccagtacatatgattattaaagccaagcaattttgctgcataactaatgatctaaaggatttcccaacaactcactaaaatcaaagttactctattgaaactcaaaattagatggtatattccctacagtcaggaatcttcagttctgtggcactggcaccactttaagggacctaagtagtagtccaaagcaaaagtgacgttgttaactgtccagttctcccactaaatctgtaatttatgggttgctttaggtcacaactgcttgctacatagagcaaccatactcacaaaataagctactatttatcttatacagtgatgctttgtcacaaagaagtattgagaagccaaaagaacaaaatgagttgtttcattggtgcactccacagtaagcatatagttaactatttaaagctggcatctaaattatgtgcttacttatgtacaagacaatacccgtactttgggtggatttttataatctttgactccttcttgaaatttacccaaccaacagtgagaactaacctttttaactgaaaacatatttcagtgagtactgctaccaaagcaaaacccagcagttgtggttaatcaggttaatatttaaatggttctgaaaatcacatgcttctgtttgtaaaagcagaaaactgctagtcattatattaaaaggttgctgaaaaagttcagcaaggaatagccatcacctgaaatatatatttaaaaaatgaaaaaaggtaaatgttttctcaaaataacagcaaattaagtaaactgctaaaaaatctgtcagaataagcaacaccattctctaaaaaaattactaccatacactcatcattcatgtttccttttgattgtctataggtatgttccttgccttttgggaaaaactagtgtgttgttcaaaataacaaagtctaaactgtcaagcagaaaaaccaactagttttaaagagttagtttattctgcacaccatccaattagaagttttaattaccaacgcttctgtgctttcttagtattgacaatttttataatgaaactatcaactaccctctgaatcaaagatgagctttattttaaggcattttatagcattctttgaaaactggtaatccaaaatgggaaaattctagaggttgcaaaagcaactgctttacaaaacactaggcagataatatggaattgacctagtaggcactgtggtaaacacatatcccatctaaaaaagggaggcagctgtcattccatcccaagccattactgcttatggaatgtgggcctactcagaaggcttttatttgaagactgccaactttcaaaaatatcgtgtgggccaaactgggtaactcaacatttaactgcgtgtattaaaattaaacaatattgctaccaaattagataaaagtaagtacttttaataactacaaagccaggattgtgcatttcgttattacaggactatttttactgttttaaatgttactttgttttaaaatgatccaggacgtttcaaagtattaaacttaatatttgcacccctgccatgtcttactttgatttagtttttctacctttagggcactaacattttaattactctaaattaatcctccctgctacaatttcccattaatttatcctactcagcacttcattcaccaatcacttattttccatcttgtcacacttcagcacttgttttaggtatctgtctcctctaatacagtgtaagttccctataagatcgacagggatgtttattatgttcaatttgtatccttattacctggcacacagtatgtactcacatttgagacagaaaaatgactaaagttagaatcagaattactaaataaatacttgttgattcgactcatctactaactctaagagcattttttcctttagaattctaaatattacttactgaccattatctcacctagtacattattgctctttatgttgcttataaaaccaccaaaaagggaagacagttttcaggaagatacacatgtaacttagaaaacaaatccttaagcgccttagcaagttaaaaaaaaaaaaaaaagttaaatatttgtgtaagatacagtcttaccccaggatgttttagtgcgctctaattctctgaaattcttagatggtatccataattctgaatattcaattatccagcatatagttgcttatctacccaggatagaaaggaattttgctatattcaaaatatcactttctgcctaaatatattcaaattttgcataaactgaagttctataaagaatcaaatatcaaaatacaattaagctagattattggcagctgcagtaacagaataagatctctgagtaacacaacgcatggcagatcagagccagtaactttgtctctataaataacaggaagttccatgacaatgctttacacagtgctatgtagaaaaactgaactgagatacagagatgtttggtaggtcatagagatggctatactctagaacgtgaacacagggatagacacaaagtacacgtaacaaatgactaactcattatgttttttctttcaaatgcagtacaactatggaatatccaaaatagaattaactatatgataaaataaacctacagaccaagttaaaaattacaaccaaatcaatgctggattttcacttaaaactaaatttaaaaattcttaatacttacaggtcccataattgtggcttgccaatgaaacactagaaaaagaaaaaaaactctggttatctaaaaatgcacaagcttaaaaaaaaattaggcataaaaatcaacttgcaagttacttactatcatccccaactggacctgcagaacattgtgctggagggtcacgggccaaatcactaagttcctacaccaagacagaaaatgggtgagtcacataagcttaatttaagaaaacaagcgagtccactgctttcagttactttcaccctatttttaaaggcacactccatcacaattcacataaataatatattccattaggagagagaacatgcctgaacatatgctgagacaatcatcttagctagagttcgtaaaaatatatatgcaaacacattgatacaaaattttttatttacataaaagccaatctcttacaaaccgaaatagctataattagatattctcatagtttaagagcttagaccagagagagctcaacattcacgttatttgttgaacttccaagaccactttcagaggccctcaactgtcttaaattctttgttcttcctgaaccatccttcctccccaatccactaactctattttctacctgaaaacaaaccaaaaaaactctcatggggctaagtaccttttttgttttctaatctccttattctctcaactcaaccttttttttttttttttttaaactcagcatccatttttaactattgaaatttttttttttttgagacggagtctccaggctgcagtgcagtggcgcaatctggggtcactgcaagctccacctcccaggttcacgccattctcctgcctcaggtgcccgccaccatgccaggctaattttttgtattttttagtagagacaggatttcactgcgttaaccaggatgggtctcgatctcctgacctcgtgattgaaattctgaccctgaagagcgtacttctgtaagtagaaagacgtttgctcttaacatatagtctgcacaattcaatatgaacgttttatttccaacaagtatgtagttcactgttccatgacttgtgcataacaatatgaattatctactatgaaaatatagtttattagaatatttttaagatggtacagctccatcttaccaatgatataaccaatgtctaataatcacaagttaaaaaaaaaagacaataaatagaaccaatgttaatacattactgccttcaacattttcaaactaacagtttctcttaagtttagtctatggcataagtcagtacacccattaagtctagggactactatatcttctatatcccctttctcatataaacatggaaataacacagaagggtaaggtttgggattccatttgaacagcagaagaccactaggtacgtggctcatgcctgtaatcctaacaccctgggaggcaaagacagggatcgcttgagcccaggagtttgactgagaccagcctgaacaacaaagggagacccccgtctcttcgaaaatgttagctaggcatggtggtgcatgcctggggtcctagctactcagaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacattggctcacgcccgtaatcccagcactttgggaggctgagaagggtggatcacctaaggtcaggagttcaagaccagtgctgctaacatggtaaaaccccatctctactaacatcacaaaaattagccacacatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaacccccagaaaagctgaacgtattcatatacaaaagaccaagtactagaaagcaaaagaaaggatgcctaaataaaaaagatacaacagagaagcagaggcgagaggacagcttgagcgcaggagttcgagaccagcttggataacatagtgagaccccattctccataaaaagaaaaaaaaattacgataaagccagtatcaactgtctaccacaatatcaatgcatccgtgtataactaaaaacattaatcttcttttggtctactagaacaacttattccctataactacaggaatttaaaaatggaaacagattttcaaagtgggtacatgcactttttttcctcaactgtgatcttttgccttcctgtgcaaaatcaaggacacaaaatgcagaactttcagtataagctctctcagaagggtgcagggaatgggaagaagagctacaaatcttaatttaacaaggcatagtggcatgtgcctgtagtcccagctactcggaaggctgaggcaggattaagcccaggtgtttcaggtttttgtgtgttaaatgatcatgctggtggagagccactgcactctagcttggacaacaatgtttaatgcctattttatactggcttcagatgattattttcattcactacatcaaatttaaacacagtgacaaatttatgtaagggtcccactatggcactgacttggttgggggaaataaatgagtcctctaaattttgttcattttgttaaatccaccggaaatctttaaaataggctctcaacaaactgaggggccagaacaaaaaacaacccagcttccaagtcttttagaaaattagaatcattgaatagatagcttgaaaaatcagataatgttgacatctttccctgcaaaactgaggaactgaacaaatcaaacaatgtatgcaccaacagtacacaagcctgtaactgtgctttaaatatttcaatttgtgggaaagctctttcaatggagctgctatttttattgggtaagtttgtattctgtagcagcatggaataaaattgaaatttcgagaaacactgaaaaagaaaagagactacataaagtgtttttgtcttattaaaaaagaattgagactttgtcccatttaacaggatttgctctaagcttttaagacaccttagctcccagagggcattttgccatttaaaaaattatagtattatagactacagtcaatgggggttattaatttaaaccttattaacctcaaaagtgctactttcaacaagattaagtaagactattagagatattagcaaaacagcactgagaaacagggctaggaaactagagtacacaaatcggactaagaataattgtactacctttaaaaatgttaagatgatcaacacaaagttttaactgctctaatagtatcttttttaaaaaatgaagttttgattaaagttgtttagttaaaagtccaccaatcctctccccttttaaaaaagtgatgggaatctcactatgttgcccaagccggactacagtggctattcacaggcggaatcacaatcataaggcactatagcccagaactcctgggctcaagggatcctcttgcgtcagcctcttaagcagctggagttgcaggtacgcatcactatgtacagcaatttgttgaacaataaatgtacatttttaattgtaaaattaaacaatgaattttgttgattgactccatgtgggaagaaaaggtgacgctaagatttttggcctgagcaaagcatgagattggcattaagtaaaatggtcaacttacaggtgaagcttgtgggcagatgtagagataaagtaagtaaaataggataatgtaagtaaagactcaattcgaaaagtatatatacaagttgagaacaggctgggaacaaatacaaagtatcattaataaacaaatgatgtttatagccattcaacttggtgagagcactcctggaacagaaggtcctaggagttaacactggactaatttaacgctaagaaagggaaccttggccagtaacctgaaaagttaaaaagaaataaagaatgtgaagaaaggctttgtcacaataaacaacactgcaggaaaattaagaggcaaatatttgcctcttatattcaaaatacacttcagaaaatggccagttgttcgggaatggtcagtctagattaatgccataaaacaaacaacaaaaatagagtagacaaggagaattgtcctgatatgctgtgccaattcactttggaaactcatcacaactacttacaaggttgccagagatcccaagattcacaattttaagactgtatatcacacaccctttatatgcttgtctgtatagatataccctcatgtcttccacatattcagaaatggaagaaaattcattccaaatactattgattctgatcagtgggaattacagaaattcatatcgcagttcaacaatctgtaaaagaaactacatggcttttggccttcaaaaaattgtaacagaaaatattaactgaaccaaatcagtatttcagaagcttttttttttttgcaacttaaattatccactattaagaaaatgactttttttttgagatggagtctccctctgtcatccaggctggagtgcagtggtgtgatcttggttcactgcaacctcctcctcccaggttcaagtgactctcctgcctcagcctcctgagtagctggaattacaggcacatgccaccacacctggctattcttttttttttttttttttgtagttttactagagatggggtttcaccatggccaggctgatctcgaaatcctgacctcaagtgatccgcctgcctcggcctcccaaagtgctaggaatacaggtgtgaaccactgcaccaggcctgcagtcttacttttaatcttacacaggcctactttttctcatggttctcttctcatctctgaaataggaatcactacctggcacataatggactggtacttaacaagcagaccatgtgtagaccacccatcctgaaccaagattcctgggcaaggctcttaattcatctgttactgaacaaaagcaaaactgctccacacatgggccacataatatagccacttgtttatttaaatttttgacctatgtgataaatcctgatgctcagttgtctaaaaatgtctttgtaagcatctgaatatacctaatactgaaataagagtttaaaaagctgacaacacaatccaagttttacatttatttactcataattaactcaataaacatactagattttacatttaatatatgttaaaatggctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagaagtgcgccaccacacccggctaattttttgtatttttagtagagacggggtttcaccatgttggccacactggtctcgaactcctgacctcaggtgatcaccttggcctcccaaagtgctgggattacaggcgtgagccaccgtgcctggccagaataaatattaagataaaatattttaattttaaaataaaaatcaatgtaatcatggttgttctaaacacaatacccaataatgttggaatacttcattataaataaaactaaaggtcagaaaactatgaagttgacctagaatataaacaccatactacttcaacattacacatttcaattacaaagaaagtaagaaagtatttcttatagaataaatgagttttcggcacactgatatttatccatcactaagcctttaaatgctagcattatcatccttttagagtgaaggtataatttcagctagttaacactgggtttcagctcttcactcctgtaatttcaggttcttgttactctcctaacatttctaaatgccttactttcgaagttctccatcaccaagacatctctttagtaataatcaaagagataaaatcagcccaatacacttacctactttaaattcaatatagaaaaatgacctaagtattttaacaatcaaaacaaaggtcttttttaaagatacaaatgctgttcttatttcaccattttctttcttgccatttaaatagtatctaatattactatttaaagtaccacttagtacccaatagtaacaaaaccatgcacaagcacttacctttgagctaccaaataatttttgtaacattatatgcccacagaatgagcaagacagtatcgtaggaaaaaaaagtgagaaaagagtaagtcatagcagatgctctttgtagctagcagacattttgtctactcaataaaccatcttactcatgaattccttttcccttactccaaatcatgtgactgtagtcctgggtcagccatcattaaccaattatttggacatgactaaccacagaattttgttccctcagctgggacccaactattagtccattgtccatcccaacctaagagtttccaaatcaaagggacattcttccttctataatcaagagctataagaatgtgacccatagctgttgacaggcacgtgtcatggacttacatggtaaagtcaaaagctaaagagaccatattcaacagcagcaataacaaagagctgactttccatacagatgtgcaattttggttcctgaggttgtagcttgctctggttcctacacctattccattcattgttaactatcccagtttccttctaataaatcccttatttaatctggattatattaaggagttaaaaaatatatacagcagtagtgagagaccaaatctgaataccaattatgtagattttatgccacttcaaacacaatttagtttttgagttttgctgaaaaacatgtaagaaatctaaatgaagctaagtcttaaaattgaattaggagtaacaaggttaactttcacactggaggttaatttaaatccatttctaaaatgaaaatgtaatgttaatttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaacaacaaggagtaagagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaactgtactcttataaccactttacggaaatagagctcatcttctctgttttacagttgagtcccttaagagaggggaaagaaatgattacattcaagcatagaacatgttcagctttaggataggtgaactaagtgtacctactaacaacttaaaaatttggactaggggtaagtttcaaaaaggttcctttctcaacagggtgtccttgcaaagataatttaatgtttggcaaactgagggaaaaaaattctcaactgcaccaaactattactcaatgctccagaatgaacacgatatggaaaactaatgttttccttagtatttatttccgcataaccatccaccgttagtctgtatctcattattcgtacgtagtgtgaatccagtactatttttcaagttacatggcctgagaaaatgattctatcccacagcaagaccatttactggactggaaatcaatttccaacgacacccatactcagcatttttaaaagtaattttgtctacgatagtcacctaacaaaatgtttttagagcctaaagtttcacaggcttcagggacaaaaacactaaaaaattacacaattgaaattttcagcttattccttcctagcagtctagaggaagaggaacagtgccaagaaccagaaggaacagctctcacacggcacctgtaaaatttttttatactgtgctgactacccctcacctaaggggaacagcattactcaactattaaggccactgaaacaggaaaatgtttggttggggacactgacttactttaggaattgctcaaggttccactcacgttgaagggacactaagatcaagcacatacaatcagggtacaacactaagaaactgtactagctataaaaagaacaaaaggttggacatttcttttccacagagtgctcttttaggaaactttctccttttagtgtcatcttcctctgagctgcttctcctcaaactttctgcacacttggctagtgtgagaatccagaccttctcactggaaaaaatacttgtatttaaaagccttaaaaaacctataggaaaagaagtcaaggagacccctctgccttctttctaagctaggtaaatgagaccctctcaaagctctcacatggtctagttcgcctcattagttaaaacactacaaagaaatttgagacagcaacagactttacacaactgagttgtttgcctatttcctgaagacctggtgggcaccatggtagaaaatagggcaggatttttttcaccaaaaaaatctctctaaaaggcaaccaacaggtacagcttaagccactggtgagtgttctcatctggaagtacatgatttaagcagtaatgggtttggtcactatttttttttttattctgaaacattccttacatgagatttttaatacaaagcctgcaaatggtttatcttgaggaagacctttactgtagtcactatgggatatgggatttaacagttgattgttggagatgttaaactatgctttctgcttctctattctctatcttcctcattcaatgataagtggtactagcagtggtgaccaaccacaggctacaaagaacagtaggccaaggtattgaaaacattaaagacctgaaaggatgctaggagaaacataagaatgtcccctcccttgctgggcgtggtggctcacgcttgtaatcctagcactttgggaagccaaggcaggcggatcacctgaggtcaggaattcaagaccagcctggccaacatcgtgaaatcccatctctactaaaatataaaaattagccgggcatgatggcgggtgcctgtaatcccagctactcgagaggctgagacaggagaattgcttgaacccaggagacggtggttgcagtaagccgcagttgcgccactgcactctagcctgggcagctgaccaagactccgcctcaaaaaaaaaaaaaaaaattccctcctttcaaagagcttataaattggaaatactaaaaatatttattcacaaatatttatgaatattatgaatattcatgaagctacagagcagccatgttccaggagcccaataagtatctgaacattcggttaactttctttcaatgacagccagtatctgttcatcagatcaacataaccaaaaggtagcatttatgaaaacaaggttttaagtgtcaaccctattaaagcgtaacgccataaataacttattctaggtttcatccccccaaggcttgtcaaaattcaaaagcctatatagtggcaaggccaagttcatggattctacctttaagacagtaaaattatcaccacgatgttccacaaatcatttgttatcccaatctctaccatctattttgcacgtcatcacacaaaggtcatacagaggacagaacgcagtagtatagatacatttcctctcagcactttccggaaaactaaaagcttatgccattactaaaggttaatttcttgtattctatttgagagtctatttctttcagaactaaagacaagatttacatgactcaaaagacaagatttgtatgactgtgaatcagcattataaaaacagcccttgcctcaaaaacctatactgagcaacacaaaacactgctttggggactggaagagatgataaaatgaggtgggaaacaaagggagtaagtgccttaagaaattttaagaatcatcctcaagaagactttacaaccaacctagaaaaatacaaaggtgcgaaccaacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggattaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcgattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaagatatttggtgaatgcattcatttttaattatgaaataacactgctatggtagcaagctcaagaccacaacatttccaagaatggagagttttatttcattaatttcaaaatactggttttggcaaggggaattaagtcattataataaaagacaaaccacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccctgtatctgtggttcttaatcagagaggagcttcagaatcacctagaaaattttcaaaattatgtgtttccagggaaaatgatttagtaagtctaagacccccatgcagctgtatttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaaaatttttttaaaaactccaaatgttctggaatataaatgtaattcatgtcacacccaacaatatataatattcagtaagctcttctatacgctaacagatacaagaaaactgctatttaaaaaaagaatgcaaaaaccaacctaggtttgagattttaatctgaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatctagtgacacagtagttcatcccagtgatggagcattcaactttttatttgtataaataacaaaaactagaatcaacactgcagatgagcatgatgaaagaaaagtatgcagtgtcagtaatgcatcctttttcaaattaaacaaatactgaggtcctattattatcagcatccttcagtcacaactatcctacacagaaagtgagctggctatcaacaagctttgaggaccatatatgaaacacatgcaagacagtttacccagcctatatactagttggggacaataaatatattttgttcactctaagacatcctaagcagttaactggcacatgttagttttcagtgcttgaagagactaccccaaaagaattaaatccacttctactttcaaaatattattagccaaaatcttaactcacaaattagctataacctaagagtaaagctaactcccaattacttagatgtataagtgggagagcaaagcagcttatttcaggtaacaaactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggcaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaaggatgatatcaaactgtagttgttaagagcacatactctggaccaggctgcctaggttctaatcccaactgtcacaacatgaacctgggtcatcttcttaacctctatgcctaagtttttcaatttcgagatggagataatcttgaaattatctcagtggaagtggtggtaggagggaaacgaagatcaaatgagagttttttaaccctttacccatggtttccctgctagccgcttgcttataatcatatataaacactaaagtcatacttccagaaataaaaacccttacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatacattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacagctgaaaaaccaaaccacatgcacacgtcaaagtttctgtaagttgaatcaataatgttcacataaacactggtttttccaatatgccaagtttttatgttgtgtctatattacataaatcttcaaaatatttacaaaaggagacaacctggttaactaagagtactaaactagaaatcaaagttcttaaacaaaaacggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttagccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatttcaaaataatttttactttaatccttaactcctaaaaagcgtttcttcctcttttctttcatttcacaaagatttaaatttgtatttcgcataacccaaaatgacgatgttatgaaggcccaaaacaaaattcacgatttcatatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaagaaataaaggaagggagacttgatgtgtattgctatcctcgcagcgagctattctgtgtcacccctgacgccaccgtacactcactccgccttccagcgcgctcccgcgcgcgcccgcccagccacctccaccacgcgcccgcgctgtccctgaggctccggcttaggcgcgaggacgcgcccattccccctcctcctccagcaggagaggccgcggcttccccaaccttcccaccctaacccaccgcacccaataggctggccgctcaagccgcccaggtcccgcactgcccctcttacccggccggccactgggccggcctcccttccctgccctagccgtccacacccacgcgtacagaggggccggggcctccctcaagctgcggcctcggcctcctccccgcgcggcagctggtgcctccccggccctacggggctcacgcgcacgacacagccacaagatgtccgctctgacggaactactgccagctgccacgctccgcccctccccctcctcctgcctcttcaccgccgcggatcagtccgccaacgccgccgtcccgagcacaggaccgatgtgaggccgaagccagacggcttgcttcccacgtccggggccgagtgaatacgtgtcaagcccttttccttctccttctcggaacagcaccttcttactaaacagatcggagattggaccaggagggcgggggagggaggaagatcatgagctggggggagggtgaacgagtggcggaaacccttaggctcagagaagcatcgagaaccggaaggagaccatgggaggaaggtaaaggaagcagccgctgcgcgatccagccccacgcccctccccacagcgtcccccagtttcctcacttggtatcgaggagacgactctcgcgagaacttcgtggctggctaaccgaagcggtagctctgcaatgacttaagagcagttttgtgcgcttttcctgacggggttccgcctccaaaatgcataagttctcgcgagacgcagtaaggcaccggctcgaactggggcgggccactgccaggaaagcaacgcccctgaatgcttatgcc

SEQ ID NO: 2084 - DNA, 40352 bp, Homo sapiens
tgaaagcagaaagctgtttattttctgtgacatcacttcactttgccttcgaaggctggtctgtgctcagtgttttcgtggtgatgcaagtcggctctctcctccagcagttggatccctcccatctcacagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattgtaaggcccgtaagcattttgatatctaatttacgatttaaaaattccagccggtggatttggggctttgcatgtatttgtagaagggcatggagagagagattcctcttgcatgcttggccatttgacagtgctaacatttgctgcatttagaatttttgatttttttagctgctactgaacatgcttagatacccccagccctgaacattatcatgagaaacctgtagccgattcatttctcttacttcatctgggaaggaatagtatcgtacttcataaaatagtgtcaaaatagtcactgttatgctaaaccggattaacataaggtttgttctgtgtgtgtgtgtctctttgtgtgtgtctgtttgtttgttttctcttttttgttttctttcagatcctttgtgagatctggttttactgaaatctcagaagggagttttttattcacgccatcgctgcagctcttgtgagaaatatttatatcatgactatttttaatatggcatatatttggataagccttctagtaaaatgatctcaatattaattttgtcaaatgtgattctatttctgagaaaacagaatatccgtaaagtgagaggtagatgggtttgtttgcgacttcacaccaacagtgcaggttgattcttacaatggtaaatctgttaacctgtcatgctgtctactttaatggctatttatgaagttgttggaatcttgcaacaatgatcccaattccattccactattttactttcatttttaacttgggaacttgggttcttttgccctggagtttttgaattagtcaatacagaacccagcataacatatgcgctcaagatgttgtctccggggatctggggcaggctgctactctgtatgatttaccatgtggggaaaaaaaacacctcagctctttctaggtaattccttaaaatgttaattctcaagagactgttttttaatctcatctaatttataactagttccattacaaggagggaaagaaaatattaatataggatagtgcaaaggattactctctgctatatgttttgagttggccacaagggaaccacatactcagtctatgcctgaaaatattcaaaaaaataatatttgactaagaaatcagatctgttcacaggcataatggaacacataaaatttgttctgatgtgtaatgtttggcaattggagtcctagtccttacagcggtatcacatgggggtcaagaggtctcccaggactcaggtatcaggtcgcagacttggtttgtagctggacggatatgggcagaattagacaattgtggatcagctgagtcttggctatcttaactgcatgattcaggacccaggcctttcacttgtttgttttttatttttttattttcttgccttacttggccattttggctgtttgaagttacatacacagaggcaaacagcatggagtggacgttggagagacaagtgtttaaacctcaccctgccactcatagaacctaaacatgtagtcttgtgcagattagtatatctcactaagcctcagtcttcttatctttaaaatggaagtgagaacacatacttccaaggtttaagtagataaaacacttggcatagggtgtgccaaatgcttacacatttataaatggtagggtttaaaaattttatatcaagctaaaaagctaaaagtcactcatctattgttttgtgtatatgaaattcctaaactggtttgactgtttcattggattcacaaacttgatcagttgttttgacattatgtaatgatgttggctaatgcccttctactggctgatgtcttcaaatgattagcaattgactagatattcctaaggggtttatctgtttgattgatggctagtggtgtgactgggggaagtgttagttagcacatcaaacaaatccaaaaaagatagattctttcccacagaaaggggcagagtctctaatgctgggatccttccataggataagaatttgctgtctctgagaaagtgataaattgtgtttctggtcctcacttgttaaatgaataaatagctcttttaaaaagcatccttttgatatgctaaggcacctcccttcccctaggaagttacatagatctagttacatagatcagtccttaaaattccaggagtagtgtcagtagacactagatggacattagctgtggcacagaaagcctggagtgattaacctaatcaattaccacatctccactttgtttttgttgggtggacccagtcacggcaagcacagatgctggacaatgttatagaaatagttaccggctgctgcagggtaatgtgatttcacgtatttagaatcacagagggaagccaagggactggtttttaaatagcccaaccgagtgtgtgccatgcccgtgccccatgctccgagttcctatggaacattccagcctttatttctaaaagcagttcaggtttcagaaataacaaaaggcgagtaattctctcccagtgtgttctcggttaactcagattggctaacctcaacatggtagacttgtgccagagctgaacttatgcaaaattgtcaggggccaaagtttgtccctaatctccaggaccctgtgcctgaagactctgctctccatccttcttgcccaatattctctgcttccgcctatcctcaggaaaaggtctaataaactcatgtgcggtgtgtaggaaatatatgagaaggctctgaatatgaactatgaaacgatcataacaattgtgggaatgcatggatcccacagagaaagatctcttctgtgagacagggctgtccagtgccctgaaaaccccatatgggctgccaatccccctttggaacatgaagaccaatggcattggaccaccagattaggcctagatcacacaagccattgaggtttgcaatgaattccaacagcatttgtgattgtgaattgccacactcacccatcatacactgtgaagagataaatttcagaatcaattcggcttgattgacgtaggaagacagttcgttggtttcttgctttattgttgggaagggttaaagcaaatgtcctatttccatcatccaccctaaaaatctgataatgtcagtatgcccccagatgctttttcagagcttctgaaaaagctatgatgagaagtacttgttgaaatgtcagtctggggtactgaggaaaatagacatggtatctgaagttacatgcagtgtttgggaaaagatcctggtaggccatggctggcagtttgtgttggagaacaagaaaaacaaaaacccacattccgtagagaagagagagaaagaataaaattattcaataaaaattcattagattagttgtaatatacattttttaaaaatctcatttatgggtttaaacataacaataaaaacctttcccaagcaaatgcaatttcattcatgttttacatagggccagtttcgaaacataaccaatgacaacgattatgcgttctagcttgcttttagtgatagaaagtggtacttttagtgaatgcagtttagggaaatgtgttttcacacattacagccctgttccttctcaactacagactgaagtccccaatgatatgggctcatgatggaagtgaaattcaaatttaagaggacaaaatgtggccacttcgccacccacttataacatattttaattataaacccctgtaattcccgagagtgttctattttcagggagtgatttccagggtagttttagtatcatgctcaaataaaacaacacaaaacaaaaacactgcacgtaagaatccgacatgaccagaaaaaatttcttagtattccaattggatgtggtcttgtttgaaagacagaattgatctttcagggtcaaaggaggggaatagcgttattttaaaaattaatccacaatcaacacataaatacctgatccataagaaattaaaaactaaaaacaaatggaaaagcaaaaggcatgaacaaaagaaggaataagtccatccttactaaggctttatcatttagtccttcaaaatatgatctgtccaggaaaaaatatccatggcctcctttacctttaaagcaattgctacctttttctattcctccttatattagaagcctacaatttagcagtcttcaatgaccactcaagccaaacctatcagccaagggtgtttttggaggaattattagctggttataggtgagcacgttttggtttgtatccagctgatgcccccatgatggaccaaaaagcaaaaatttcagtcatctaggctgttttgtctacagtttgcccaatgatccatagatctaatctttaactttttaattaattacttcttttttgtttttactttcttaaaaataattttaaattttattttagattcgagggtccatgtacaggtttgttacttgaagtgaattaattctcgtaactgcacaaactagcactcaccacaattgttttctctgaaagtgtatttcatcctttcagttattcaggcaagaaacttcagagttacctgacccctctctttcactctccacttccacctggacaagcatcctgtccgacagcatgagaatctgcctcctcctcttcaccacagcaccactgctttcactgaggctgcatttcattcactgtttcacaggctgtggcaggagcctccacgcctcactgtctgctttcagttcccatctgacccatctccattagcgctgcctttcctgagacacagctctccgtgctttcatgactccctagaaacagagaaagtccagacacctgagctggcatccatagtgtttggccctttctatttgtccaaggttatcactcacatcattgactctacacacacagacacacacacacacacagacacacacacacacacgtgcccaaacaagttctgcaggatctcattctatgacctctgttgattctcaaattctctagactttactgatgtctggcactgtgtgccatttgctagagttatggtgcttgtatctgccttgtgtctttcatggaggatcaccaataaactgtggtcccagagaaaaacccagacatgttttcccatgtatttgttgaatccagtttatgtttccatcgattttgtgctgaagactcctgtgttactctcagcagataatgctggtcatgttcacactctttctgatgtttggtgcaccctatctgaattcacgtggactaatagtgtggaggtctgggaagtgagccgaactaaaaaaactcgaggagatatttgctcatgaagttgtgaattcaaacttcctcagcagagatttccagcataccagatttcaaaggcaaagcatctaagcctttccttagacccaccgctcgaatctcttgtgtcccacgctgacttcacatttggtctccttggtttttagtcagactgcagaggccgactagtctgtcctgggaagggtaagatgctcctttatccagcctgaccggacatccagagggaaatgttagttaagcattattaatatgaaaagaaaaatcaataacacaaagataatttcctttttgatttaagtactgcttagccaaaataagtatttatttattgtatagttgcaagcagcaacaaaatgaaaacaaaagcctcccattttagcagacatgttttgaggctctactgggtagcaggtacaatgttgggctttgtgaaggacacaaagatgagtgacacgctgtcacttttcaccctgatatggcagctccaagctggtagtgattcttgatatggtaaattatactttgcctgtatttgaatgcattagtttcatttaaaaaattatttttatgtaagtagagatgaggtcttgctatgttgcccacgctggtctcgaactcctggcctcaaacaatcctcccacctcacccttccaaagtgctgggattatgggtatgtgcctggcctccttaaatgtattataaggtagtcttgataagcattctcattttgttcaaaatgagattcagttgattagtgatgatggtgatgcttgctggttgttgatcctgtggctaatacgggctacagaatgtctgcaagggctttacagcatcagctgtaatatcaaaacagctgaccctggtgagctggcaatgaggcagacaacacagacttgtgggcagataagcatgggttcaaatccccactctgcttcttcctagttgtatgatttggggcaagcttaatcaagtcttgatatctatatctacaaaatgaggaagaaccgtagtacctattgcacagaattacagtaaggattaagtaaaacaatgcatgaaaaatgctttgcaaggttcctgtaactcaatacacattagctttattacagtatctgaaaatcactttaattggaactaccataacatcagattagtgtctgattgtataatctgggtttgccgataatctcagctttaaacattttgtggttctacacacagttccccagcagaacttgctgagaaatcttttctttaaatacttcttacaggaaacatgaactatttacctttcaaaaaaaagtcataaccctctcctttcttcctcatgaataaaatgactggcaccacgttttgtaaaacatgccagattttgtttaaataattaatattggcagtcttcagatgagtggttctatggtagcatagaaagaggcctaaactagaaatcaggaaacatgggtttgaaactcagtttggccactattgggctgcgtgatccaatagtttgggtaggtcacaaaactacctaatagtttgggtaggtcacaaaatatcactggacctcagcttttattgcataaaatattagaggtagattaaactgtggttctgaaactcaaatgctagtggggtttggggcggtaagaccaatgaaggaagcagttgagtataagacaataaggagtagtggtgactgaggtaaaccagagaagacatgtcttacctaaaaatcctctgctccaactgactattgctgatgggattgtggtacatgcacatggagccctatcttcctcatttttaggggaaggtggaattctggaagtagatttttaaacaggataaagaccaaacaaatataagttggcattttgagacccttgcattcaattacatctaaggtctcctcctatcttaaaattctgttgtattctacaaacagttacgttaatataatatagaaatggcatggttaaagaaatggacaacgatggcttggcgcggtggctcacgcctgtaatcccagcactttgggaggccgaggagggtagatcacgaggtcaggagatggagaacatcctggctaatacggtgaaaccccgtctctactaaaaatacacaaaattagccatgcgtggtggcgggcgcctgtagtcccagctactcgggaggctgaggcaggagaatggcgtgaacccaggaggcggagcttgcagtgagccgagatcgcgccactgcactccagcctgggcgacagagtaagcctccgtctcaaaaaaaaaaaaaaaaaaaagaaatggacaaagattattgaatcagttctaacaaaccaatacattaggttgttcattgaaagaaactcataatatgaaactggctgttataaggttattaatacaataattgtagttcccaatctcccaaacaggtccaaagggaccttaccaggctctccctgtggtggttgatgataaaatgatgtttcagtatccctctcatggagcaaggattggaaaaaaattgttaggcccatttttatatagcaagatggcaggtgcttgcatgtgtaaaatgtgatcaaaaggcaataaatctttaaaaatacaaactagaatgtatacatacaaataactcttgacttcacagagggccatagattttgcccaactgtgcttccatggctaaagatttctggaccctcctttgagaattgtcttcattgccagtttacaagccacgcaataaaaccaggcaaggttttattagagacattagttatttttgtattgcttggtgctaagcattttatagatctcttttttttttgagacggagtctcgctctgtcccccaggctggagtgcagtggcgcgatctcggctcactgcaagctccgcctcccgggttcacgccattctcctgcctcagcctcccgagtagctgggactacaggcgcccgccaccacgcccggctaatttttttgtatttttttagtagagacggggtttcaccgtgttagccaggatggtctcgatttactgacctcgtgatcctcccgcctcggcctcccgaagtgctgggattacaggcgtgagccaccacgcccggcctatagatctcatttttaatgtcatcatcatggtaaccttttgaggtagatataattatctccattttgcaaatgaagcgctgagtcctaaaagataacctcctcaatgtcacgcccctattaagtagcagagttggagtttaaacccatgtcctcacttttaaccacttctgtctacttcctcctgaacatgaatcatcatgcttcactttgcatagttttgttcccaaaatcaaatcccctctcaaagggtcaacctttgccattaacaagagttttcaggagaatgtgccctaattcctggagacaatgactgaaaggagtttcaaaagccctttgaaagagtggccgcattgctggcaagagcagctagtttccctaggttgcaactctcatttatatgtgtaagctctgatctccttgcttaaacaaaaatagagagaaagaaaagaaaaaagcaaaagaaaaaggccttatttactttaaagttacaccttagactactgttgtctaaacttgtgtcctgtggagcagttgacctgaaagaagagttctgtgctcaaataaatttgggaaactgcacgttctatccctgcttggttatttacaatgaagttaccttggcatagaaacatctctgaaattattcaaaattgtttcacttttcttaacatcccatagaatattggttctatggaacatacagtactttggaaatatatgcatgtgataattcatcttatttttagcttaactatttgtaccccacctcattctagagaggttggatagcaaaggatacgcaggtggaaagaatctcatcctagtggatacattaaacggtctgtctccatataaggagcaactcaagaccattttgttagtgtggattcgttgatgtgacctctgggagtcaggctcctcagtaggctctctacctggtcaagcaatttagcacacaccccttctttagggacctcccagtagatctccatctttgggaggaaggagatgacttcttgcagctcattcaacaggaaaaggcttctgagtgtgtaaatatacactgtcactgtttttatttggagcagatttcatcacagctattttctaaatggctaaacaagcatttccctgggtatgttccatggaatattcattttgtaggaagctcaatgataaaagagtcgcattgtcaatgagaccaggaaactgtatatttaattccattttgaagagtctcaatttacttaaggatagaaaaggcacagttaagaaccctgattaacttctttaacccacttttcctaaatgtatctgccagtttttgtgtacataaacctctcaaccctttgaagatcgtgcgttccagggaatacactctgggaaattctgggcaagactgttgcaggtttgcagcagatactaggcagagctgatactaaaaagagggagctggcttcctcatggccactcaccagtcctggggaagtcggggagggagagaggaagcctgagcctggaatcccagctctgccacttacaagcttcaaatcacttcacctccctcacctcggttttctttatctcttacgtggagaatataaaacctacatcttagtattcatttgaggattaaaatcagatgtcaagctgttgaagatgaggcctggcatggagtagacccttctccttgatgttccaggactggggagatccagggtgattttataaacacatggggagggtgggctgctgactagctgtgccaattcctagaaaggaagagtttccactgctctgggatgagagataatcccaggaggattgaggattaccaaaagggggttaccactccaaaaggagagggtccatgctcgaatgtttgctagtgtgcatgtcaaggacatccctgcaaatctgaaatccacatcctaaatcctagccccaccactgacaaaagatgtgaccttggttaagtcacttaacctctgccagcctcagtctcctcatctgtaaaaagaggagttggactacgtatctctctggagtacccccaaccctcagattagtgtggaaccaaattaaggttattccaatcaatccaggttgaagagttggtaatctaattaaggatcagctgaattttcaaggttgagagtcaaaaagaactgtcaaataatgtacttgtgtgtgatgcttccaattttaatgcttttctgtgttaggagcatatttttaaatattcaaatgtgaattattcacatggcacatgcacttataatgtgtgcatttaactaaagtgaatcatcagcctattattaattatcatttaaccagccctattcttttggataaaggagagtgttagtaaaaaccaaagggtttggatcatttaagcaaagccagctctaagcaatttggcaagcccctccagctgtccctccatatcttccaacagctataacctgtgcatcctgtgctctttcatttacatatacatatacatatgcaaataaacccatgttcacttgggagtgtgcacactcatgtttgtacacactgtccgtgtcctacctaatatcctagatgtccatcaaagtcttcttggggcaggtgacatcctcacgggacctgagtttccttagcagttaaacacgtgttcttttcctagatctaagtaagagctcttccagctctgacatttgatgtctgtgctctttacttagctattccttggcagaagcattggagacatgctcatacacattatctcacataattcttaaaatcatccaggaagtctttttgcatcctcaatcctattttaacagatgatgaaacagatttacctacttgatgtgtaaacatacaataataactggcagttacaagcttagaaacctgattctctattctgaatccaatcaattcattctccaagtgacaaccaggcactggctactcacttttcccttcttaatcagagtggtttttgtggagttgggaatcatctggaagagcctcctagatcatctcccctccatagccaggaaaatctgctctaggctgaaacatgggatgtaggccactcatgggccagatacaattctaatggcaatcaagatattataggtgactggagagagtctgaagaagtacatgtcattagagccagggtgcctggcacgggaccaaatgagcagtctagtttgagacaatgggaagttttcttagcaggagtcacccttcccccaaccattcagccatctgcagaccagcctccccgctccccagattccacatgcctactctttcatgaatgaaggctacagtgctataagcatagactcacacatctttagagctacaaaagacctcacaaatgatctagtctagtctcctcgctttacaacatagagaaaagtggtatgctctaggacacagaaggtatggtcaaatttatattaggcttcctgattcactcttcagtgtgctgcttccctggcctctgaagaggcgaggccccagggcaggaaagcacctcagtggcccaccagacttagcaccaacacatgagcctgcccagtcctttcgctcttatgcattcccgtctctggcctctcacccggtatttgggcagccttacccttgaccccttgtagctatatcctcattcttagatcctctgcttcttcatttacttctctgttgctggccctggttccctctgaactctgagctccatgttaaccctgttgcctacttttccgttccttttgaagtaaattctgtgtgtcctacctctccgttcaaccaggaaccccctaatagctttatgaccttggtgtgaaagtgtcacttagtcatgacccgtccctacagacagcagaatctggaggaattagagcttaatgttagcattttacaggtcacatcctctgatcccagagcaatattaataatgaaattatgaaagcttttttttaaaaaaaacaattacaggcaattttaagaatattattctaaattcccattgaaatcaaatacgcaattttaaaagatgagtacagagcaaaacttactggatgcattacacaaagtaaagttccatttctaaatactttcattttttaatcagaaagaataaaagtatattattgagcactaaacttaataagtatcctaaggaaatcaggagaaaagcaataaagaaaagataaaataataaattagaaaacagtgggaataaaaaaataaatcgaagatttgatccttggaaaatgccaaaaaaaaatgtgccagacatttgaaggatatcacatactcaaataggggagattctgttaattctgttaattattcaacagaaagccttgggtaaatttgggtaaatatttagaaaatatcaaggctgtgtcttacctcacatcatacataaaagtaagtcccaaatgtattgaagagttaaatattaaaaagaaaatgttaaggggaagatgtaggcaatatttccttgatctcaagacaggaaaggatatttaaagaatgaaatcatgtcttttgcagcaacatggatgggttggaggccattatcttgagtaaaataactcagaaagtcaaataccgcatgttttcacttataagtgggggctaaataatatgtactcatggacataaagtgtggaatgatagacatgggagactgagaagggtgggggtgtaggaggaagggagggatgatgcaatacttaacgagtgcattgcacactattcgggtgacggttacaccaaaagcccagacttcaccactacacaatatatccatgtaacaaaactacacttgcaccccctaaatttataatttttttaaaaaaggattaaaggcaggccaggcgcgctggctcatgcctgtaatcccagcacttgggaggccgaggagggtggatcacgtgaggtcgggagttcgagaccagcctgaccaacatggtgaaaccccgtgtctactaaaaatacaaaaattagccggcacagtggcacatgcctgtaatcccggctactcagaaggctgaggcaggagaatctcttgaacccgggaggcggaggtggtggtgagccgagatcgtgccatggcactccagcctgggcaacaagagtgaaactttgtttcaaaaaaaaaaaaaaaagattaaacgcaaagaaataatacataataggagttgatgtattttgttaaatacaaatttaaacttctatatgttaaaaatcattaatgaaaaggcaaattggtaatcagtaggaaaaaacttttagcatcaaaagaaataggaaaagatgaagtaatatccttaataaataaaaagtgcttagaaagcaacaaaaggggtcaaaggacatgatttcatagagaaataaaaatgataattttaaatgttggtgaggatatggtcagataggcatttccttactcagagttggacatgtaatttggtacaagtcagcagtaaagaactagagatttaaaaaccttctataatctaataatggtacttttagaaatctatcctaagtctatcataaggaaataagtagagataggaaaaatatttatatataaggatggttataatcatgtttataatagtaaacattggaatcgataatttaaaaagttacatcatgatatatccataatacaaaacttactcatctatggaaactatatttttgaaaaattgattgtcatgagaaattgttcatgatataataagcaaatgaaaagaaggatacacaatgatataatattacatcaattttataaatacatatgtgtatatatcatatatgcattatgcttatgcatatcagtgtctttgggtagtatgattatggtgcacttcattttcttctttaagcttttgtgttttccagaatttccacaatgagcatatattatttataaacagaattcaccaaagtgtattcaaggctgggtacggtggctcatgcctgtaatctcagcactttgggaggccgaggcggttggaccacttgagtccaggagttcaagaccagcctgggcagcatggtgaaactccatctctataaaaaaaaaaatacaaaaattagccaggcttggtgttgcgctcccgtggtcccagctacttgggaagttgaggtgggaggattgctggagccagggaggcggaggttgcagtaagccaagatcgcgccactgcactccagcctgtgtgacagagcgagactttgtcaaaaaaagaaacaaaaaaaaaaaaactggaaaaacctcacaaagcgtgttcaaaattttcaaactttctacttgaaaaacacagattgatattatctggatgtgattttaagactgcttactctaattaattcctctaagaaaggcattattgtttaattacatttcttaaatccgtatgagctgagtggtgttattatggctgctcgccagaacgtggttattatgccattatgtgacctgggacctgtgctgagaggccacccagtgtgtggaaaagggtactgaaccaggggtcttgggccttgcgacctcaaggaaagtgtttggtagccttctgggcctcagtttcctcttctgtcaaatagatcttacctgctttactactttcacagaattgtctaaagaccaaataagaaaatccaggcaggagtctatgacatgtaggctattatgaagccaaagatcattattcaaagaataagctagtacctgcctggaattcatagttcatataaatgatttttctaaatctccctcttggtaaggaaacatactcccgtggttgcagaagaaaaaagcctcccctctcctcccacagccccttttcttactgaattaataagtgcacagccctttggggagggtgtagacagatcaggcacacccctgtgtccacctccaccaaaattctaggggaaaatgcctggcttcttaggaaaatgcttccctaaaaaaagaggagaaacctcaagtgttcccatggaactggggcagagggcaaattccgcacaacctctgcacaaacccacgggctggctgcttggcaggcctacagggtccagatctctgatctgtggctcagagtaacgaggtcatttggatggtacattggtttcataaacccctccatgatgctgctgctgttgtgaggatagttgtcacttccaactcatattattgcagactctaggctacacgtagttatagggacaagaaagtccacagctcctccactccccacaccaacggctccaggcagacttgctgcaaggagcagagaccccttggtcaccacaggtaaaggggacagtgttttgactgacttggcaagcttaccatgtgcaaccctggctgcatatgagtctcctagggagctttttagtaacccaggtgacaccccacgtttagaatttaaccagaatctccaggagtgggaaccaagtatcagtatttttaaagctgtctgggtgattccaagagcaagcaggattcagaagcattggctcaggtttcaacacagatctaggtatctctcccacaccagtcttcaaaaaacttatcttggtgggttttccaccacaattctacactctcctaagcattctttgcacgtaattttacctaccatggatccaattcaaccctaaggcatcctttatcctttagcttctctaccggctggctccatttctcagtctgccaattccagatccccaagaagggtgtcgtcttagcccaactcacctttttaaaccaggctacttgggccatgggatgctggttgatttagagactggctactctgtggaaagggacagaggttgtgcagtgtagaacacggccaccctggtctgccccagttctgttttttgtgtaggtggggtgggttgggcacggtttcccttaacagagactgtggaatactttaacatatctggttcaataacaaattataataatgaaatcaaacatatttagaggaatccatacaaattaagggtcagagtttcatcctctgtatagaatatgatgtaggagtctttttaagtatacgtaggataataaaatggatagcccactcaactatctttagaatgtatgtataattttatacatctttttccatagaaactacaattgaatttagcattgagagattatggtattcattattatcttagccagagggtgtttttttagcttttataagaaacttttaaattgaagtataatatacataaagaaaaagtgcacgttataaatgtacatctcaatgactttttacaaagtgaatacccttgtaaccagcacccaggtcaagaaactcaatattatcattaccccaaaagatgccccttgtgttctcttccaattactccttgcctccaagggtaaccactctcctgattctagcagcatagattagtttttgtactttatataagtacagtcatataggatgtactttattgtgttttggctcctttccttgaatattcatccttagttttgcatatgcatttgtagttctcaccagaggttttagtccttgaaatgtagttcaacaaacattattcagccaggaactgtgcccggggctggggacaccaaaacaaataagggcaaattcctgctgtaagaaatatttaatccagtagtctcgtaatgatcagaatttagtgtaaggtgaattcctctttgtccaacaaatatttattcagtgtccactagaggacaggcgctgtatcacaggtgctagggataagaaatgaacaagcagacaaaaaatctagcagaaatcctctcttttcttcccgtgacgtgcatgggcaagttctgcccactaatattcatttcccactatgtcctgcatctgatttaacataaagggaagtagcaatggaaactatttcttctggcaacttggaatatgagaagtccctggtccttgggccatttttcaaatcagtgagtgtgggaggtataatatttgtgtgtaccaatttcttccttattccattctctccactgctgatgctgcctatactgaatgcaatgaaagtctggaacctaaggaagcctttgggtgttagcttaccttggagtcaagctgagcagtcttcttgttttccagagccatgaagtgagaagagacacaattgccaaagctgtgatggaaatcatacagctttgaatttgttttagtaacatggaattctaacatgtgtcactgttcattagtactggcttttcagagcctcgtgaattacttgggtacaaatccatgacattagaggcatgagggattagaagacaatccaacaccactctaggattgatagtttaggaagaaatgcaagaaatcatctcattttgtttggttggttcattcctaccccccattctccacatttttatgaaaaattttaagtatatataaatgtagacaaaatagtaaaattcactcttatgtatccatctttcagcttcaaaaatcatcaactcatgccaattcttctctaaccccttgttgtccccctcctctgattatttgaagcaatcccagatgacaaataaattactcataaatgttcacaaagtgagatctcctagttttaattcctgtagttcacaggttcagcggtgaattcactaagctagttagtggtacttatatttaatccctggcttcagaagtaaaagtgataagctttactaacagaattactattattattattacattatgacataatataatatattcttgtactgtttggcctaaaactacctcttttaagcctctcattcagttctccaaggagttcaacagggtgtgggatggctgattgatgttctttttcatcagtaatttctaaaccaaatccttgtggattttgaaattgcaaatatatttgtccaagtaaaagcttcaactatttggtaataaaatgggtctaagactcttcccaaacctcatgtttcccattttcagtctgtgtgcaaaggaggaggttggctgttgttcatggagccagtgtcaactgcctgtctgttacgagatgtcacagcacaaccaggcatgcagcttacttttttttaggtttcccaggctcaaaaccgcaaagtaccattgtttttgccagttagaacactccagaggtttctagaacaagcagaaaagattgttagtgcctttgtcatgaaaatatgtaaaatgttgctttggctgctttggctatcatagctgctctgattgtatctcaaaatgtcacccagggtatgtggcagtcattgtgaggaatcgggcaccaggcaccccttgatgagcctttgatgaggagatgattaggagtaaaaaaatgctgcatagattatctgcataactaacactgtagcagacagccatgcagacatttttctgtatacaactcccactcatttttctgagagataaaagcagccaagattgacaatctgtcagtttcaccattttcattgtgtactttttctgggcaggttattcacatcgaactcctttgatgtgatcagtgatgatgcttttattggtcttccacatctagagtatttgtaagtaaaaaagcttttttaaaacatgatgattcaggacaagtactctcaagttcctgtaactgtttgacaaaaaatattataacttattgcagattcatagaaaacaacaacatcaagtcaatttcaagacatactttccggggactaaagtcattaattcacttgtaagtatgaatgttgctattactttttaagcttgctaatggacaatgcagtttgatcacctgtggttaatgcacctactttatgagtgtccataaaaatttaagaaacccaaatgacttctctccatgcacacttgccatctttccctgtcatctgtcagagggtgttcaataaattgattactattaatatttttatccaaaaccaaccacaattagaaaagcaatctaatgcagggaaattgtgtgcctgaaataacttcttttattatctacatcattacttgcttcatggatcattatgagttgactgtataatttgatatcagctttttttccctctataagccctcactttatatacatttaaacataatatagccacaggcgatgtcttcatagtacctgatcaacttgtttatcagtgaaatatttaattactcaatggatgattacagctaacagcagttgttcttaacagggaacaattttgtctcccagggaacatttggcaatatctagagacatgtttggttgtcacaactggggatgtaaatggcatctagtgggtgaaaggcagggattcttctactgcttaggacagcccttcacgaccaagaattatccagcctaaagtggcatcgtgggcaggttgagaaaccctgaacaacaggacccaaacaatttgtttcttctagcctccctcaccctctacagacaaacacattcacacacacacacacacacacacacacacacacacacaggcacacatgtgcatacacacacacactcacacacacactctcacatacacacagattattttaaggaaactagaagagcatggaaagaaaaggcactaacatttacatcacttttcatctaatcctctcaataatcctgccaaacaggcacaataatccctgtttcagaaatgaggaaacagtcttggaggggatatatgcctcgtgagctgattagttacggaattatgagaacatctacttaattgttgaattgcagtgactcttcatcctttcaacagctatttctcaatctacctaatatgtatcttatcagttctagatacagatgcaagagatccaagtgtcatagtcattctgtcagctttaacctgttctctcatcatacttcattcccagctctgctctaggccctaggatgcagcagggaacaaaggagacaaaaatgcctgtccttggactgagcctgatttccagtgtgtccacgcggttgtcactctgcctccaccaggcccctttctctcctgttgcttgttttgtagcaaagagaagctaatagccagatatattttacaaaatcatgcctttcaaggcttctgtatagagttattgtaataaaaaaacagtgtttgcaatactactcttcatgtcaatgacatgatatgatgcaaagatggctgtttacagaatgaatgctatgcaattttatcacagagctcaacactgccaaacctcatttttcagacaacaaataaacaaaagaaacaaatatatggaaggagaaatggaaattcatgacctcaacttgaaatccactagattcacatacatcccaatccacatggcctctgtccagtgcttagcatcatgagagctgtagggaggatgcacagcccaattcatccagctgtgtctcctctccagcctaaaagcctgtggtttctctcaggctccatgcacagaacaggaaaaaatgtttccctgtcttggaaggaaggagggaaggaaagaaagaaggaaggaaggaaggagggagggagcgagggagggagggaggggaggggaggggaaaggagggaaggaagggaggaaagaggaaaggagggagggagaaagaaaaagaggaaggaagatgagagaggaagggaagggggagaaaggagggaaggggaagaggaaaaagggaaagaaaaagtctgtttgacatcctagtgtaggacacccattttgtttactggagcctatgatgtgtatcaaatgaaatgggaatttaaatatgggtcttaatgatgccctttctttagcagtatggagcctgtaagagagagagactgatacagaacacgcttaacattcagaaaatttcaggttcgaggaacaccaagggcagccttcaaagagaggcatgactcttaacaggcagtgaaagagaagtcccacctctctgagctggtgctggaggtaggaaggtgttatgagggaacaggggttaaggctgtggctaaatgaatatgacccttaggtctcttgtatctttagctaacacttattaggttgactgatacggcattgccaatgttaggctgttttttatctacaaaaatggcaatgccatatggttcatcttaaatagtttctaagatgtgacacatgctttacaaggagtagggcctacaaagatgagtaagatctagtcccaccttagagaagctcaggctagcaagagaaattggacaaatattttctcactgagtgcctttgtccccaagttatgttctcctttcaaattatgctattcttcatggtacaattccttccttccatccttcattctttccttcctttcttccttccttccttcttttattccttccttctttcctttctgtctttcaaggagagatggagtagggaggatctgaaacccaaatttccctctgccggctcagtaagtcaggttcattttccattatttatggcgtattaataaatctggcatttgtctgagccattagtttcctttttaagacattaggcttcaaagtgcacttttctccacctcagatcaatccttcccaatcaaggcaaacattcaagctgtgaggaattagtacctcaccctctaacctgcatgcattgcaggaagaggttacaaagctttctcatattcttgacttcatcatagtctcctgacgaccccgtgaaagagacagggcagtagcactaggttcatagatgaacgagcaagtggaggtataccatgagttgaagctgctccccagttactaagtggtaaagccagacagctcccaccgtctttgatgagacgtccagtgctacgtccactgtgccagttaccgcaggaccagatagcttttattgagctggctggatccttccatgggacatgatttgaggagaaaatatgactagagaagaaagaaaagatcctgaaaacaggaaacctaccctcatatttcatctcaaaatgcagatagttgggattagacgtatactttcaggtccagctggttcccactctggcctaacattaaagccactcccttacctgcgcctttatataaatttagttcacgcctaagaaacaatgcactttctcaccttcttatacagagatgtcagtagatttctcttctaagagacatttacagataacttaaaagttattataggccgggcgtggtggctcacacctgtaatcccagcactttgggaagccaaggagggcagatcactaggtcaggagatcgagaccatcctggctaacatggtgaaaccccatctctactaaaaaatacaaaaaattagccgggcgtggtggtgggcgcctgtagtcccagctactctggaggctgaggcaggagaatggcatgaacccgggaggcggagcttgcagtgagccgagatcacgccattgcactccagcctaggtgaaagagcaagactccgtctctaagaagtaaataaataaataaataaataaatataaaaaagttattatatatacctggctatcaggcgagatcctcccctcccctgcaaattaacccttaaaaccctgcaaattaacccttaaaaagggagagagacttcttaaagttaagtcctttcaaagcctgtcaaatgttgggattctcaattactttgttttgaatcattgttctaatgttatgcatgtttcactttaatgtttgaatggtttgtatattttagtaatcttttgtatatttgaatttttctgatgaatatatgttattttggtaatcaggaaaacatgaataaaaaattagtttatgaataaaaaattaatttatggccaatgatgacaaaatcttcaaacattatgtattggcttctagtaatacctatgagtctttagtaatgattgctttgtgtgccattaagtgtcactgtggctaaggcccagtggagccagcattgtttgcatgcatatatataaatatttggagaaaattatcatcaatctatatgtattgtagagtatccaatggttgctcagcactgagggggtacaaaggactatataacagtccccaaactcaggatgcttgtgtgttcccaatcagttgcacaggatgtctttgttttagccttcacattgccttatatgtaaagaggtagtgcaatgtagcagctaagagggtgatctctgccaccagactgcctgggttcaactgtctctctgccagctcaataggacaagtttattttccattatttactacttattaataaatctggcatctatctgagccattagtttcctttttaagactttaggcttcaaagtgcacttttctccacctcagatcagttcctcggctttgcaccttaacagctgtggaatttggggcaggccatttagcttcactatgctacagactgggcatgtaaaatggggttataataataatctcttaaaatgggatggggaataacaaggcatttaagagtattagtgcccaaggttgtcttgagattaagtcagttaataaatgcaaagtgcttagaacagggcctggtatgtagtaagcaccactgtataactaaaactcactgcccaacctccattagtcctggatcagaattctaaatgctatagtgtatataccatttaaacattttctgtgaaatttaagtaactacaaagtgctcagaacagggcctggtatgtagtaagcaccactgtgtaggaaaaaactaaaactcactgcataacctccattagtcctgaatcagaatgctaaatgctacagtgtatatcccctttaaacactttctatgaaattaaagtaactgcacttgcaccgccgcaggttcagagagacacaaacccaagctgagaatctgcattgcaggggggctggtgcaccccagatggctgtgggcgatgctttcttagcagcagagcccggtggcactgaaacaaacgcggtgtttgagccagtctggtctgccttagagagaagactttccagtgggttccacagtcacaatcggaggttttcttgggtaaatgatgaaaacaccaaagggcaggaaatggtcatcatttctgtgaagaaggaatggccgtctgcctttgagaacacttgaccttactcagccagtttcaaggtaactagacattcagctgcgcaatatctcagttgttttaaagaatgtttctggccaggtgcggtggctcacgcctgtaatcccagcactttgggaggccgaggtgggcggatcacaaggtcagagatcgagaccatcctggctaacacggtgaaaccccatctctactaaaaatacaaaaaattagctgggcgtggtggcgggcgcctgtagtcccagctactcgggaggctgaggcgggagaatggcgtgaacccgggaggtggagcttgcagtgagccgagatcgcgccactgcactccagcttgggtgacagagcgagactccgtctccaataaataaataagtaaataaataaataaaagaatgtttcttaggtgaactttgaaccaggacctagagaatggtgcttagttgaaggcaactttaaagagcctccacgttgccttgggatttctaccacagtggggctgtggggagggagggtccttcctgaggtgggggtccacaccagctggtggggactgcactagtcactcacagggctttgagctttctcccccagtgccttggcacagggggcctcaaaggagcatcctctgctcttttctttgcctagatatgtacgcgtcctctcgtctactccagcctgcctcattcattcattcatttaaaagtatctattaggctgtgtgcggtggctcatgcttgtaatcccagcactttgggaggccaaggcgggcggatcacttgaggtcaggagttcaagaccagcctggccaacatggtgaaaccccatctctactaaaaacacaaaaattagccgggcatggtggcgtatgcccgtaatcccagctacttaagaggctgaggcaggagaattgctcgaaccagggaggcggaagttgcagtgagccgagatagcgccactgcattccagcctgggtgacagagtgagactccatctcaaaataaataaatacataaataaataaaagtatctattgagggcttactttgtgccaggcactatgctagcactacagataatggaaagagaaccatccttctagtactcattgcagaattatcctagaaataaaagaacattgattaaatgtttcctcaagtctctcattgactgtgtcttcacccctctcccaatcggctccaccccaccccagtcagatattctagtgccacctagtgtgacctccatgccctggaaaagcctgttgtcaaactcactgacccctaagtacgtggcctaaagtatcacctatcctagtgtcatctattaattttaaagatgaagccatagcctctcagtgaaaatgacaaagctgtgatttaagagcaagaataggacttggagatcattctgacccagtgatcattcactttatagaaaagggaatagcctgagctcaaactcagatatccacttccctgtccacgtcacccctgtactctgtggctgagttctgggccctaaagtgagtctgactggcaaggggtccactttggccaacacaggagcctggtactccttaaaccaaaacatgtagaaagtctttttcctgacaactctggtggctacctgggactccttgcctctctgtccttcataatttttcttcctcctattcctaagaattaagaattcttatatctagtattaaaattcagctctgcttaacagctcttggctaacagatctttgcagaggaaggagggtcccctactgcaattcagggtgacactctctcaagtcgtgacactctctctagtcatgacactctagaggaaagagaaggactagacactctgtgggccaggatccataacatgatgttccagaatcacttgcttttgatgggctctgtattaatggctggaagaaaacatgactaaatcttaacagtggttacttctgctatgataattattatttctctccttttttaaaaaaataatttttgcactttccaacttttcttgaagtgaagaaataattattattccatatatatgtgcatatgtagtgtgtgtatatgtgtgtgtgtgtatcaataaaagtaaaagatgggacttttaagaataccaatgcataggattatccctactaagagaggcagaaagaatagatgatctcagcttcctgaagcaaatattttaaagtgtttagatatttaatatcactgtttaatgacaataacaacaaagaaaaagattagttttgtggtcttaacacataaggtttaaaaattcacctgcagatacagtttttcctggaatccattacaaagatatgtatataaaaatattagtagctacatgtgttaattctcacaataagtgaaattcatatcctttactcagttttgcagatgtcaaaacagaaacccagagaggtgaaattaacttggctaaggacacattcctaagagtgatgacgttcaaatttattccctggtggatttggacgaagttggcacttaaaccactatactcccctaagtgatgcaggaaagaatagctacaaccagttttaaaaatacttagcacgtatagcaactagagcttctgttgaggaaaagttaataataatattattatatcattactctgtgaagctgggagtgggatgaagacagaactgggaaaattttatccaggtattttgctttctggtagcaaaactcggtgcagaggtggaatctgaagaatcaaataatcctaatatcaaccctaaaataaccctaaccctaacccacaaagtgctatctcagtctctctagctgttaaaattccctgatagacacaggatctcattctacttaccccttttttaatgactaaatgctgaggaggcttcagggaacgtcgcgtgacttgccctttttttttcctgttgcccctgagcccggtgccctcagcagccctccgctgcagcaaatctccctgaagccctcagatgcccatgatgatttgtggaggcaacaggccctcatcacagctggctttaagctggcgcaaagaaccacagcggtggcttcaagcctcggctgccctgtagccccaaacctccctaaagggtgagggcctgaaaccgcatgagagttttctaggaaacaggcagctccccgctgcaggaggtcttgtgaaagacatttgcatgacctgaccactcaggcccccgagttcggtaattcctaatctaaccctgtaggtagctttggaacttgacaaatgcagccaaacgattgatttcgaatgactgaaccctcattggacagaaccatagatatatacaaatactaagcaacaggatcctttcaaaaagtcaactttattctttgtttcttctgattataaaataataatacatgcttgatgataaaaactcacaacataaatatgtatttacacagaaaagtgaaagattccagtaaccctacacctacctcatttttaaaatctcctacaaaatattccgtgttacatatggaccatagtttatttacatgatcccttatatctctttgttgttgttgttgttgttgtttttgaaacaaggtctcactctgtcacccaggctggagtgcagtggtatgatcatggctcactgcagcctcaagttctaggctcaagccatcctccaacctcagcctcccagagtaactaggaccacaggcacacaccacacccaactaatttttgtatttttcgcagacagaggattttgccttgttgtccaggctggtctcaaactcctgacctcaggtgatccgcccacctctgcctcccaaagtgctgggattacgggcgtgagccaccatgccctggcaacctgttacattttttgcagagtaattctcaggctctgtcagcattgctttcctaagtcgttctctgcccaaatccctctgcctactttctttttatctaaatgtaacctgtcactggagcctcccagagacttagggaagctgtctgaactccagctccctagccttggatgtctggaagcctcactctcatttctgaatcttgcttcctcttgagtctgcttctcttagtgaatccaggcagccttctcatgcccatcactcaccaaacctagacatgaagcttcattctctctcctctaagagcagttcattgtgggcaaggatttcattgaatttttggtagcggagcatcagagggttgacactgggttcagcgaatccacccaccatttctccctctggctcccctgcctcccccaccctctgattcccaaggcaaaagcctgtcacaagaggttctcaggaaatttaatgcctcattccacagcccatcgggccagcctgtccttctcagccccatctcacaattctggtgaattagaagccctccatcttgtcatgcaaaaatactgcctctccattctggaagccccatagctccaagtctgcagctctgttttgccatctgttctgtggttagcttgcacgtggatcatgtgaggcctaaagctctactcctttgggcaggaagtagaacttccagattcactcattatttaaaagaatcccacagggtacagtggctcacacctgtaatcccagcacattgggaggaagaggcatgaggatagcttgagcccaagagttcaagaccagcctgagcaacatagcaagaccctgtctctacaaataaaaaaaacttagttgggcatggtgggacacacctgtggtcccagctactggagaggctgagcccagaggatcacttgagccagggacgttgaggctgcattaagctgtaattgcaccactatatttcagcctggacaacaaagtgagaccctgtctcaaaaaaaaaaaaaaaaaaagaattccccttggacagtaagacaagcatggtgccttctcctgtatagcccctattggcagtagtaattcaggatttgactgcttaatcattgcatgcccactgtcctgtgactcagcctcctctaaatttatgctctgcagccagttgcagtttttaccagcttcagaggaagggacatccacttagaagttagtatgataactttaagccacattgtgccagaaaataaactgagacacataacatgggagtgactctggactggtccaagacatcagaaaatctcttcattcaaacaccagtcagtaagatgaattatggagacattctcttgaatagtcttccttagcagcattttattaattttgctgtatgtggacagccatagcagttcattcatgtggtctgtttctaaacgttgtttcttggacaacatacgtacagaagctgttctcttctgacaccagccactctactgagagtagttcagacacctgcaccatccttgattatctcatttccttttttcaataatcttatgagataaggtattattatcttcacttaaaaatgaaacaactgaatttccaagaagatacattaccaaagtcacacagccagtaaatgctggagtcaggattcaaacatagctcagaatcactccaaaagccatgctctttgtcacaattggaccgtcattgacaatggaacattctgactcagttcctattcttgcattccaaggttcattgagaaccattttccaaactagcagtaatttctaaaacctagaaaaacaacataactaacttaaaaataagttctaaagttcatgaatgtttgcacttgagaaaccttatatttaattagtggaggtagaagacatagacttttgagaatgttttaaagggaagttgagagaattttcaagggtttagaggctaatggtatgggctctttagttttagtttagttttttatttttattgtggaaaaaaaaaacacctctaagaaaagtttataacgtgtatatatatggtgctggttaaaaatagaaaattacactacttggtgaccttccccagtcatacagcattagcactgtgctatgtctatatttgtgtactagggacacatttccctttccttgacattatcaggacaattttttactcattaacctttattagaatcattctagtgatttacggaagaacaaatagaaagggaaagggaaaaacattcctgtgatcacaggaaaagaaccagaagaaggagaaagagggggatgattaaagagaatagatggataggtttttataagaaaacttttttctgaggtggaatgaatggtgctagaaaggaaaaggaggcgtgggctttagaaaggagaaaggatgtactggggaagagatagagctactggcactgtgggttggaggtttggttgctctccggagcaagcgaggaggaagcaggcagaaggggcagcccaggcaagaggagggggcgcattttggagatggacactcaccagtttggttagtcatcatttgggagatatcccctagattgagcgtctgagagtgtgaatctctcgtgttctgttctaaatggaaagatcaatgcccaggaatcattgttgtttttaaccaacataaagtgttgtttaaatattgagtgcacctgtaatcccagcactttgggaggccgaggcgggtggatcactgaagctcaggagttcaagaccagcctggccaacatggtgaaaccctgtctctactaaaaatacaacaattagccgggtatggtggcgggcacatgtaatcccagctacggcaggctaaggcaggaaaatcacttgaacccgggaggcagaggtttcagtgagctgaggtcacaccacttcactccagcctgggtgacagagcgagacttttgtctcaagaaataaaagtaaataaatatggagtgggtgttgaagtgaacaggttaggaactgaaaggacaatagcaggaatctgagtagtagttcagaagaaaaaaaaaggaccacaagtcttttagtaggctggaaatgacaaaagagactcatcactaagctttatcattaaatgcctttgtttaatttatcactacagtttacatcacctttttttttttttttccaggagccttgcaaacaacaatctccagacactcccaaaagatattttcaaaggcctggattctttaacaaatgtgtaagaggacctaagaaatcactgaacaattaattaatttgcagtcattaacaaggaagcctggtattgattattataatttttaattggcttttaaattaaaattaggatttttaaatctaaattttaactggccaaaaatttaaatttacatggactaacatttgagtcttctatggtatttatcattgggaattctgaatacatggcacccaggcattcctttgacaaagtgtgtgtcaatacggcagggagcgatgataaaggactttgacggggtgggaagagacccggctagaaatttcaaaatcccttttttctcatgaggtccaggaaatagggctacaaaggaaaaacataaaggagtctgggaaactgacagaataaagatgaaaggttacatccttgggttggtcaatcaacagagaaatggaacaggaagtgggggaagggagaaaagtttgccttttttctcattagactgaacaacaactctaagcttaatccccaggaatttggcttaagccccaggaagggaatgaacttaattatttttgaccctttttcaaacaaaagagctttcaaactttgacttttaagcctccgagtgaaagatctttgcaaggaatttgtatattttgctgtaagcaaagcaagtaatatatgcctaaacttctcaaaagcaattcagcttcattatttgccttccagaacattagaaaggtatttaaatgtcataaggtggaagacaggaacaaatgaaaggatatatgaaaacaaaagcttttttaaaaaattattcaggtacttgtctgtagaatatatattcaaaacaacttttctccaataacaaacaaaaagaaaatctgagtcaagtactttcttccaagcccagtatttaacttcaaatcagtagcctaatgaaaaactttctttgttccttgcagtatttccccagcccctcctccatgtctattacctcaattcctgaatgatatggtttaattccaggagaatgcccaaatcaggattcttccaagagagtcctggacagaccatagttatcctctctggtttacagtagcctgaaaggttgccactcattagtgtgggtcagagttctcttgggagactaggtcagttctgggagtgtcttggaagttagaacacactccatgggtgacgtgggatgtagctcattgggggtcctttaccccatttttgtgtcagtctataccctacactagtgaaagacaaaacaaaaaaatattgaaattggctcagtctctcatgggaatcccaagatgggtttagccttttggacctactctaatatgcccaaatcaagaattatcttagaagtacaaggatccatgccaacttgccttttagtggatttcttggctttcttgaaagtatcctctaaaaaacatttttaaatgtttgggcgtttaaaaattatttatgtgtggtgtgaagagtaggcagcacctatcttaagaattctgtgtgaccaggaaaggaggtggaattcctgaacagaagcaatgcaaatacacagagaacttggtgagttggggtcatatgtggatatgtaaatggtctatgctgtataacttattacaggcatgagcgattgtatgcctgtgttaactctgctgtgtcaaagtcatttcctatttaaactgaatttgtagaccacggaagaggatcaggattaattatgtctgtgaggaagaagaaaagcaaatagctcacttgattaaatacattacaataatcactacattctgtcctttagacctgtgctgtccaatagggtagccaccagaccttatggtcactgagcacctaaaatgtgctcctagtacaactgagagactgaattttaaattttacttaattttttaacagttaaatttaaatttaaaagctgattctcagctcaattattggaaaatgttaagtacgcttggaataatttgggtatatacacctatttttttcaattatgaattttatgacatctaaatatagatcacctatttctggtaaaatttagcatctgaattgagatatattgtaggtataaaatacacactggacttcaaagacttagtataaaaaaggaatgtaaaatatctcaataatgtttatattgatgatgtgtcaaaatgataatcttttgtatgtattgggttaaataaaacatattattaaaatgaattatacctgcttctttttacttttttaatgtggctatagaaaattttaaattacaattacggttcatatactgtttctattgacagcacagccctagactaagccgctttggaattcaagagggagtaagtgatgaggttccattgactgggtagtcttcaagtgtgcatggtgctaactctctgagcccaaagtgaatgagtggtcagtcaggttccaggcaggttatagggcaggatgcaacgccgggtaaggtcattctgcacatgttaattgttgatgtagaactctttcctgcgtgggtagggcccttgtacagcaaaagcagctgaagtttgtctttcagggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggattttgattgcatcattacaggtaatgtactcatcatcattccacctcaaaaaattaaaataagggctacctttttttttcatgtgcaggaactgatattttttatatcttaaaaactagctgagcaacttaattttaaaaaaattatgaaccattgacaatgcttcatgtgtttaaaagtaaaatggccattttactattctctgaaataaatgtatttcttgtgaatatttaagatctagccaaggaaagaggtattagctcacagttacttattatttcctatttttgcagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacaggtatgaaaagcctaatgatattttgagtggtaatttaaactgcttcagccaagggcaacaaggaaagatgagtggtataggggaatgctttagcatttgaattccaactctaccatttgttaagtgacctgggattgttctctaagccataatttccccacttgtaaaacgggaataatattaatacttaactcacaaggttgttaataagatcatgtgaacacatattcaagaaacttagcatagggtctagtataatacataaacagtaaatatttgattatttttcttcaaataaaagtattggatggtgaatcatgagttctagtccaggttctgccacagtctatttgggcaagctgctcatactcactgacacccctcaacccctttttcttaactataaaataagaaggttattttagatcaataagtctcaaatttgttacacaaacgtgtcttctacaaaatgttaatgtatgccttgtaatgaaaaggattttgtggtccaataaattcatgaaccatatcttggtcttgtaggttcataatacagacatctgtggatctgagaagtcctgcagtgaggaaatttttccaatatttttcacccttaatttggccatggaatttaattctttcttttcttttcttttttctttttttttctttttttttttttttttgagacagagtctcgctctgtcacccaggctggagtgcagtggcacaatctcagctcactgcaacctccaactcccgggttcaagcaattcttctgcctcagcctcccaagcagctgggactacaggtgcgtgccaccatgtccagctaatttttgtatttttagtacagacagggtttcaccatattggcaaagctggtattgaactcctgacctcatgatccgcccaccttggcctctcaaagtgctgccattacaagcgtgagccaccgcacccggccggaatctaattctttctatgaaaacttttacttatctggatctctctttttttttttttttttttgagatggagtcttgctctgttacccaggctggagtgcagtggcgtgatctggggtcaatgcaacctcagcctcctgggttcaagcgattcttgtccttcagcctcccaagtagctgggactacaggcatgtgccaccacgccctaataattttttgtatttttagtagagatggggtttcaccaagttggtcaggctggtttcgaattcctggcctcaagtgatccacccgccttggcctcccaaagttctgggattacaagagtaaaccaccttgcctgggcttacttagctgatctcttaagtttctttcccattttaataatttttaaaattataagtcataagttagaacatagggctccctctacaatttttaatatcagttttagcttctaatacctttaaatctgctctcaagagcactcacacctccccataaaaggtaaccctttagacaaggcatggagggtcatgatagattttgctggtagccatcaccctcattgctcaaaggaccaagacaggtctggggcttgcttgaggctggggttgcttaaataaagggatcccttccaaactgagacccttttggaatcctcctttcttttagaatcctcctctctgaaggaagaaggtcatgcttccttaggcccccataagttttccagtggactatagcagggttttgtgcggtcgaaaccaggcttttcttacttgtgtatggttcatcaatttctttgaatgactctttagatgagcacttacaagagaaataaatcatacatctgcaaactttctgagggcatctcagagctcatcttgtctaggatgatgtcttagtcccttcctgctgctgtaacaaaaaataccttgactgcgtaatttataagaacagaaatttatttctcatagttctggaggctgggaactccatgatcaaggcaccaggagatttagggtctggtgagggctcactctctgcttcaaagacggtgccttctctgtgtcctaacatggcagaagggcaaaaaaagatctaacagactcgctcaagcccttttgcaagggcacaaattccattcatgagtgtggagtcctcatgatctaatcacctcctagacaccccacttcttaatactattacactggggattaagctacaacataaattttggagggacagaaacattccaaccatagcagatgacaaatatatgccccatactcagtcattatcccttccttcactctagacaggcaccactaatctatcatgggaatctttcatgtagagtgcagacacggccacagaatccttctcaacacagttccccagacaatcacacgcaatgagccaatcagtattggtacatgtgttggaatctggtggccatccttaatctagtctaaagtctcattgtacagaaaagaaaactgagcctcagagaagttaaatgattttcttaagatcatacaatcagtttagccctgaaaagagtcagaaataaaactattttgcctatggatgaagccaattagtagaaagaattaatgtagaactttctgccccgcactagcgctgtagtcagaagaggcctaaagcccagatttgttcagctgtctctggattttctagagccaaactcctgcaagatcagaatctactgataaatgtcaaactcttccccaaaggataccaagctaggccactgacagatcccacatcattttctgtgattttccaaaataactttcaggagcagtgcccatggctgcacccttctttcgatttttttaaagattccttttccttctcttcactcctgccaccagtgacctaaagctccagaaaagtgacaagtggcatctcctttctttgcaggggaaaggcaaattattctagagcaggaagcagttcagacttagagcaaaacaattacagtagagccatgggctacccagaccacaacgctagcctttggttatctaagatcttagataaaccaaatttgaagtcctggaatagctaacttgtccccagcttgggttaaaagcatagagatgctggtaggcctggctttgaatccccaactctgccttctgctaccagaacagcctctctgagcttcagtttactcatgtggaaaaaggataatatttatctcttaagattgttgggaaaattaatgaggtaaattgagaaagcacataatagatgctcagtaaacagtagttttcattagaattatgattaactcatttgtgtcagggaaactaatgctttctttctgcaagaagtaagaggagaacactcgggccatagctgtgtgtcctgaacgtctagcgcaggctagatatgacattaacaactcaattgttggcaacaaggccccacgaggcacaaaggcacggaactttaggacactgctgccattgggctttggagaccagccttgcctaatcaaccaaggagatctcttgtttcaggctgatttgggtggaagttgtatggccccagcccgcatgtttacatgctccaaaagaggatggccacacaactaatctctcctttgtcttttcccaggcacatccactgtagtatgcaagcctatagtcattgaaactcagctctatgttattgtggcccagctgtttggtggctctcacatctataagcgagacagttttgcaaataaattcataaaaatccaggatattgaaattctcaaaatccgaaaacccaatgacattgaaacattcaagattgaaaacaactggtactttgttgttgctgacagttcaaaagctggttttactaccatttacaaatggaacggaaacggattctactcccatcaatccttacacgcgtggtacagggacactgatgtggaatatctagaaatagtcagaacacctcagacactcagaacgcctcatttaattctgtctagtagttcccagcgtcctgtaatttatcagtggaacaaagcaacacaattattcactaaccaaactgacattcctaacatggaggatgtgtacgcagtgaagcacttctcagtgaaaggggacgtgtacatttgcttgacaagattcattggtgattccaaagtcatgaaatggggaggctcctcgttccaggatattcagaggatgccatcgcgaggatccatggtgttccagcctcttcaaataaataattaccaatatgcaattcttggaagtgattactcctttactcaagtgtataactgggatgcagagaaagccaaatttgtgaaatttcaggaattaaatgttcaggcaccaagatcattcacacatgtgtccattaataagcgtaattttctttttgcttccagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttcata

SEQ ID NO: 2085 - DNA, 28173 bp, Homo sapiens
gttaagtggcttagatgaaatgtcttttttttttttggttatcagataaccctttgtgaaaatattttcctttgcattctttaactagctgggcattccacagcttcactgttggtatcatctgtgatactatcaacatggcagctcacagactgggcaggccccaggaattctttttttttttttttttttttggagacggagtcttgctctgttgcccaggctggagtgcagtggcgcatattcggctcactgcaagctctgcctccagggttcacagcattctcctgcctcagcctcctgagtagctgggactacaggcgcccaccaccatgcctggctaatttttttgtatttttagtaagagacggggtttcaccacgttagccaggatggtctcgatctcctgacctcatgatcctcccgcctcggcctcccaaagtgctgggattacaggcatgagccaccgcaaccggcccccaggaattctttaatggttccagagagttctctggctaaagactgctgctgcatctgttaggcaatgttgacaatctcatcagaagtggtgctaccactgtgtttcatgtttttgtgtttctttctttctgtcggtggttcctgagggttgtgacgatcagggcagaggcagaaggcaccacctcaatctgggcctgtctgctgtggctggtcagtttcactatcatcctcagactcttccagtcaatggttggtgatgtcatcagcaaccatttttggagacagacccagggagctgaccttgggggccagtgcagatgtggcactgacttcaccactggtacacctcagatatacaactttgatctcgctggggtcaaacgtaggtggctgcggttggttgaactcaggttcaggatgactgaagcaagttgcacttggctttctctgagccgaaaaacgaaaggtgctcaggctcccagcaactctgtgaagaaagagttattatcatctcagtttacagatgaaacagaagctcagagagggcaagcagctagcacaaggtcccacagctggactcagggctgctggctacagggcctggctctacatgctgcacagtcagagagggagagtcccatgcgcagttggaagggagaagggaaggggaggctggcgctagatagtaacaagctgtgtgttttgggcatttcccctgtaccagacactgtgctaaatgacccttctgctctgtttgcctggaaaagtccccatcttagtgaattctgactttccacctactgtcccggagcagctgactgtggtggagaaaactgcaggacagggaccctcagctgctgctatacagccagtgatcctgccacgtccctgactccatgggctttcaacacgaggcctccccaacgcagtgtccacaccagcattactgtggaacttgggagacatgcagatcccacaggagagggaagggggagctgctctcaattcagatcaagtttcccctgtgccagaagaatcagtcctccagatgggtgggcagcactgggcctgaggtgaatgttactgtgctgtacgctcacaaagttagagggcagagctcatattaaaggttcatactgagaggtgaagccagctggacttcctgggtcaaatggggacttggagaacttttctgtgtagctaaaggattgtaaatgcaccaatcagcactctgtaaaaatgtaccaatcagcgctctgtgtctagctaaaggattgtaaacataccaatcagcacgctgtaaagtggaccaatcagcactctgtaaaatggaccaatcagcaggacgtgggcggggacaaataagagaataaaagctggccaccccctgccagcagcagcaacccacttgggtccccttccacactgtggaagctttgttcttttgttcttcataataaatcttgctgctgctcattctttgggtccacaccaactttaagagccataacactcaccgtgagggtctgcggcttcattcctgaagtcagcaagaccacaaacccactgggaagaacaaacaactctggatgcaccatctttaagactgtaacactcactgcgaggtccacggcttcattgttgaagtcagtgagaccaagaacgcaccagaaggaataaagtccggatacattttggcgacccagatgggaaacactcaggcatcaacaggctcacccttgaaatgcatctaagccattgggaccagtttgacccacaaaccctgaaaaagaggtggctcatttttttctgcactacagcctggccccaatattctctctctgatggggaaaaatggccacctgagggaagtataaattacaatactatcctgcagcttgaccttttctgtaagggagaaggcaaatggagtgaaataccttatgtccaagctttcttttaaggagaatccacaactatgcaaagcttacaacttacatcccacaggaggacttctcagcttacccccagatcctagcctccctatagccccttcctattaatgataagcctcctctaacctcccctgcccagaaggaaacaagcaaagaaatctccaagggaccacaacctcccccccacccctgctatcggttatgtccttttcaagctgtatggggaggggaatttggcccaacccgggtacatgtccccttctccttctctgatttaaagcagatcaaggtagacctgggtaagttttcagatatatcctgataggtatatagatgtcccacagggtccagggcaaaccttcaatctcacctggagagatgtcatgctattgctagatcacaccctggcctttaatgaaaagaatgcggctttagctgcagcccgagagtttggagatacctggaatcttagtcaagtaaatgacagaatgacagccgaagaaagggacaaattccctactggtcagcaagccgtccccattatggatctccagtgggacctcaactcagaccatgggtactggagttgtaaacatctgctgatctgtgttctagaaggacaaaggagaattaggaaaaagcctgtgaattatttgatgatgtccaccataactcagggaaaggaagaaaatccttctgccttcctcgagcggctacgggaggccttaagaaaatatactcccctgtcgcccgactcactcgagggtcaattgatcctaaaaggtaagtttattatccaatcagccacagatatcaggagagagctccaaaagcgagccctgggccctgaacaaaatctggaggcattattaaacctggcaacctctgtgttctatgataaggaccaagaggaacaggctgaaaaggaaacgttagatcagagaaaggctgcagccttagtcatggccctcagacaaaccaaccttggtggttcagagagcacagaaaatggagcaggccaatcacctggtagggcttgttaccagtgtggtttgcaaggacaccttaaaaaagactgtccaacaagaaacaagctgccccctcgcccatgtccactatgccgaggcaatcactggaaggtgcactgccccagaggacaaaggttctctgggccagaagcccccaaccagatgatccaacaacaggaccgagggtgcccagggcaagcgccagctcatgtcatcaccctcactgagccccaggtatgtttaactattgagggccaggaaatcgacttcctcctggacagtggcatggctttctcagtgttaatctcctgtcccagacagctgtccttgaggtctgttaccatctgaggctcagtgttaatctcctgtcccagacagctgtcctcaaggtctgttaccatccaaggaatcctgggacagcctataaccaggtatttctcccacctcctcagttgtaattcggatgctttgctcttttcacatgactttcttgttatgcctgaaagttccacacccttattagggagggacatattagccaaagctggagctattatctacatgaatatggggaacgagttactgatttgttgtcccctgcttgaggagggaatcaaccctgaagtctgggcattggaaggaacaaactcaagctccagccttaagccttcccacaggacaaaacttctctttatacatcacagagagagcagaaatagctcttggggtccttactcagactcatgggacaaccccacaaccagtggcatacctaagtaaggaaactgatatagtagcaaaaggctggcctcactgtttatgggtagttgcagcggtggccgtctcagtgttagaggctatcaaaataatacaaggaaaggatctcactgtctggactactcatgatgtaaatggcataataggtgccaaaggaagttatggctatcagacaaccgcctacctagataccaggcactactccttgagggaccagtgcttcaaatacatacgtgtgcggccctcaaccctgccacttttctcccagaggatggggaaccgatcgagcatgactgccaacaagttatagtccagacttatgctgcccgagatgaattcttagaagtccccttagttaatcctgaccttaatctatatactgatgaaagttcatttgtggtggagaattggatacgaagggcaggttatgccattgttagtgatgtaacagtacttgaaagtaagtctcttccccagggaccagtgcccagttagcagaactagtggcacttacccgagccttagaactgggaaaggaaaggagaataaatgtgtatacagatagcaagtatgcttatctaatcctacatgcccatgctgcaatatggaaagaaagggggttcctaacctctggggaaccacattaaatatcacaaggaaatcatggagttattgcacgcagtgcaaaaacccaaggaggtggcagtcttacaccgccgaagccatcaaaaaggggaaggagaggggagaacagcagcgtaagtggctggcagaggcagggaaagaccagcagaaaggaaggagagaaagagacagacagagagaaagagaggaagagacagagacaaaggagtcaaagagggagacagagagaggaagagacagagaggctgaaagtcaaagagagaaggagagagaggaagagacagacaaagaagagtcagagagagagaaacagaaagtcaaagaaagagagggagagacaaagagggagtcagaaggagagagaaagacaaagaagaagtcaaagagaaagaaagagagatggaaatagtaaagaaaaaacagtgtaccctattcctttaaaagccagggtaaatttaaaacctataattgataattgaaggtcttctctgttaccctataacactccaataccaccttgttatcagtgtaagcaagggcgtagcctgaaagtactgaggccactgacaacccatagccttcctatcaaaaatccttaacccagcaggtttcctaacaggggatctaactcttaactaattaccatacaaaggtccaaccagacctaggaggaactccttcaggacaggaccatagatggttcctccccggagattaaggaaaaaagacacaatgggtattcagtaagtgataaggaaactcttgaagaaacagagttaggaaaattgcctaataattggtctgctcaaacctgcgagctattggcactcagccaaactttaaagtacttacagaatcaggaagaagccatctataccatttctaagataatatggactgaacgaggttttattaatagcaaagaaaaattaaaatcccaaacttataaggttttcaacaaaagtaaagtttgctaaaatttaacagtgtaacatgtattatcctaacctctaatcttatggaaatcagaccctatcagcgcccctcaaagctcaagtccatcagtgcagagccatccactaatacccctacttatagggttaggaatggccactgctacaggaaccggaatagccagtttatctacttcattatcctactaccacacactctcaaaggatttctcagacagcttgcaagaaataacaaaatctatccagtaaggatagtaactacgatcccaaatagactctttggcagcagcgactctccaaaactgccgaggcttggacctcctcactgctgagaaaggaggactttgcaccttcttaggggaagagtgttgcttttacactaaccaggcagggatagtacgagatgccgcctggcgtttacaggaaaaggcttctgaaatcagacaacgcctttcaaactcttataccaacctctggagttgggtgacatgacttctcccctttctaggtcccgtgacatccatcttgctattactcacctttgggccctgtatttttaacctctttgtcaaatttgtttcctctaggatcgaggccatcaagctacagatggtcttacaaatggaaccccaaatgagctcaactaacttctactgaggacccctggaccaaactgctggccctttgactggcctaaagagttcccctctagaggacactacaactgcagggacccttctttgcccctatccagcaggaagtagctagaatggtcatcacccaattcccagtagcagttggggtgttccgtttagagggtgggttgagaggtgaagccagctggatttcctggatcaagtggggacttggagaacttttctgtctagctaaaggactgtaaatgcaccaatcagcactctataaaaatgcaccaatcagcgctctgtgtctagctaaaggattgtaaacacaccaatcagcactctgtaaaatggaccaatcagcaggatgtgggtggggacaagtaagggaataaaagctggccacccccagccagcagcggcaacccactcgggtccccttccacgctgtggaagctttgttcttttgctcttcataacaaatcttgctgctactcactctttgggcccacgccacccttaagagctgtaacattcactgcgagggtctgcggcttcattccttaagtcagcaagaccacgaacccaccaggaggaacaaacaactctgaatgtaccatctttaagatcataacactcaccgcaaggtctgtggcttcattcttgaagtcagcaagaccaagaacccaccagaaggaataaattctggacacaataccacaaaaagacaaagaaagcaaaggtgcgggaagaaacttttggacaagtttgtccaacctgtggcccaggtggctttgaatgtggcccaacacaaatttgtaaattttcttaaaacattgagatgttttgcgatttttttttttaaagctcatcagctatctttagtgatagtgtagtttatgtgtggcccaagacaatcattcttcttccaatgtggcccaagggagacaaaagattagataccctgcttttggaggcgagggatgtgtttattgccttggccgtggtgatagtttcctgggagcacaaatatgtctgaattaatcaaactgtatatatcaaggatgtgcagctttgtgtaccaattatacctcagtaaaaccattacaaaaaggaaaagaacaaaggaaatgcaaattcctagagtccaccctggacctacaggcccagctctctggggctgcccagccacctgtgtccagcaaggtgggggcctgagaagcactgcccaggcctttgctcccctaatggactatttcacccttccctaactcgtcagacctcccataccacatcctcactctcagctgatcacctgctttcctatttcactgagaagtcgaagcacctagaagacagcttggtgtttcccagcaccaagggccccagctcctgctcagcacccttctgctcagctttccctcttgaggctggggaggaaccggcagggtgaacgcgagtatttctcctcatgcacaagaagctactcaatgcagcagctatggccgcccctgggaactagctggaagcagctgggggttgctggggggaggggtgggtgggtgggaatctgcatctttaatagtttctaatttcaacttttattttaaatacagggggtacatgtgcaggtttgttacctgggtatatcgcgtgatgctgaggtctgcagtaaggatcgcatcacttagcatggtatccagtaggtagtttttttgactggcccccgcacccctggactctctccctctgagaatctgcatttttctttttttcaggatccctaggtttgaaggaatctgcattttaacaagactctagttgcttcgtacagacattagactcattcctcctcctcactttctgttggaccattctctcagcaatctgtaaactgtaatctgctccattaaaaaaaccaaaacatcgatccacatccctctccactgcttcatttgcaagctccaggttctgccttcccattctctctcaaacctgctctgatctttgtccagctcctcaccgaccccttcacggaggcccccagtgcacctgcgcagtgaggtcagcttcgcaggggcccccagtgcacccgcacagtgaggtcagcgttggctcttggcctctcttccctgcgactctgcccgggcaccagccagtcctcattccctccctactgctttttttttttttttttgaaacagggttttgctctgtcacccaggctggaatacaaaagtgcaatcatagctcactgcagccttgacctcctgggctcaaggaattctcccacctcagcttccttggtagctgggactacaggcacaccacgcccagctaattttttgtattttttgtagaggcagggtctcaccatgttgtccaggctggtctcaagccatctgcccgccttggcctcccaaagtgttgggattacaggcgtgagccacgtgcctggccattgctatttttaaaatgttgtttcaattacccccagggtgtcactccccttcaggatgctttgggccttccagagtaggaagagtaacaagagacctggttcacctgtggtgaagccaggagaggtgtcatgttggttgaaatgcctgcagaaccctcctgttgctgtgctcaggccagaagctgcacagagcatgggccgataaatgcatccactccccgtgctttcccaggagcgcccaggcctgtcctcagtatcaagtcaatcacattttcagcatggtaggaggaggcaggttctgcaaatgctgcagggtgggttaatcacacaggccaatcaagtccctgtcgtcaccacgattggcagaggccagccctcactcccatcttgtttccttctcagtaaaaatcatgtcacgcagccaggcttggtggttcacgcctgtaatcccagcactttgggaggccaaggtgggcggatcacctgaggttgggagttcgagaccagcctgaccaacatggagaaaccctgtctctactaaaaatagaaaaattagccaggtgtggaggcgcacgcctgtaatcccagctactcaggaggctgaggcaggagaatcgcttgaacccgggaggcagaggttgctgtgagccgagattgagccattgcactctagcctgggcgacagagctagactccaactcaaataaataaataaataaataaataaataaataaataaatatcacaccacatcactctttccaactgaaagagtgtaatttaaaaaagtgtaaaaactgccaaatgtaagtccacattattatccattcttgtaggaaacgtaataaatgtgctccacaaatcccccaccctcctagatactggcattgaatgaggcgcccacgtgggctctgccctgaacttttcttccttcttgcccttcttctttccttcatgcctctgagaaggaaactctccttctgcatctggagctgagctccccaagggcttctaagcctacttcccacaccttccgaagagccttatcccacagagccctcactccctcaccgctggcttcctccctctgtgggctcctttcccagtctgtaaacatgccacatgctcatcccctcactcaccctctcggagaaaactactgtcctgtcaaactgctttcttctttcctttccttcaccacacaatgcagccaagggtgcagagagttgctcaggcccctgtgcagcccatatctcccacccactcgcatggcccaacctccagtgatcaaatccaacagccgtttctgtccccaacctgccgcccttgcctccagttgaatttgacagagattactctgtctacatcttaaaaaaacggaaaccaatgaaagaggcaacacacaagactcaatatggacagtaatacgatggagcataagacggccatgaaacacgacattcacaaagttttaaagagcattaggatttgcttgtaaaataaagttagagggccaagtgtggtggctcacacctgtaaacctagcactttgggaggctgaggcgggcgcatcactcgaggtcaggagtttgagaccagcctggccaacatggtgaaaccctgtctctactaaaaatacaaaaattagccaggcatggtggagggcgcctgtaatcccagctactcaggaggctgaggtatgagaattgcttgaacccaggaggtgcaggctgcagtgagccgagattacgccactataccccggcctgggtgacacagcaagactgtctccaaaataaataaataaacaaagttaagggaaaaactgcacgtgcagcatcagctcaaccgtatgcattttatttattttttatgtaggtattttttttgagatggaatctcactctgttgcccaggctggagtgcagtggcgcgatctcagctcactgcaagctccacctcctggattcacgccatactcctgcctcagcctctcgagtagctaggactacaggcgcccgccaccacacccggctaattttttgtatttttagtagagacgggatttcaccgtgttagccaagatggtcttaatttcctgacctcgtgatctgccccccttggcctcccaaagtgctggcattacaggcgtgagccaccgcgcccggccctgcattttattttttatttcttgagagggagtctcactctgtcacccaggctggagtgcagtggtgtgatctcggctcactgcagcctctgcctcctgggttcaagcgattctatgcctcagccttccaagcagctgggactacaggtgtgccccaccacacctggctaatctttttttttttttttttctgagacagagtcttgctctgtcgcccaggctggagtgcagtgacatgatctcagctcactgcaacctccgcctcccgggtttaagcaattctcctgcctcagcctcccaagcagctggaactacagtcgcatgccaccatgcccagctaacttttttgtatttttagtacagacagggtttcactgtgttagccaggatggtctcgatctccagacatcatgatccgcccgcctcggcctcccaaagtgctgggataacaggcatgagccaccgtccccagcacgcctggacaatttttgtatgtttagcagagatggggtttcaccatattagccaggctagtcttgaactcctgacctcaagtgatctgcccgcctcggcctcccaaagtgctgggattataggtaggggccaccgtgctcagccctatatgcatttttaaagactaagggaaaataagagtggttccatctgggtggtggaactatagattatttttgttttctcctttactatcttctgtattttacaataggccttacaaacaaaagtctgggagattaaaagggacatttttctggtctgccacctgctggtggattctagcaacgtcctgggttaaattaaattcagtgcttgctcctccctcttctcactgtctgagcaccctccctatagttccctccagcttctttagcctgacttttgccatctcgtttccattttgtgatcctttccctcttgtcttgtgtattttctcgtgtaagtttttttggtaatatatgttaggtcctcgctattttcaggtcattacaatttttacctctttgcatctcttttcagcgacttctgctttttttttttgagacggcgtctcgctctgttgccaggctggagtgcagtggtgatcttggttcactgcaacctccaactcccgggttccagtgattctcctgcctcagcctcccaagtagctgggattacaggcgggtgccaccacgcctggctaatttttgtatttttagtaaagacgggatttcaccatgttggccaggatggtctcgatctcctgaccttgtgatctgcctgcctcagcctcccataatactgggactacaggtgtaagccatcgtgcctgggcgagacttctgctttgattgagcttagtaacacacactcaccatgggagcgggtgtgcttttaggacaagctgacagccctggtggaagtgggtgttagttaaggcaatcagaaatcctggcaagtgtagtacgtgctctgggaggcaggttaagccacaattggcaatcaatgcccttggtcacattagtgagaacgccctggcagccatgtggagggtggatttgaggacttggagaggtgtatttaagacatggctgccactctctaggaggagagtgagagagcttgggcaggagtcgcagtagggatggtgtggaacaggcagattagagagccgcccagcagctgtcctctgcagggactccttaagagggaggagtcatgactgacccccagctttccaacacaggttgggtgagctgtgatgccaccaaccaaggcaggaatgcaggcctgtatgtcagtgggttgtggggaaggctgggttttgaataaactgaatgtgagatggcctcagaacatccatgcagaaacgtaagcaggcagtggaaagtaagggctagagagagatctgagtgttactgacattagggtgtagctgaaacccgaggcatggacgacaacgcttcaggagaaaatccagaatgacggagatgctggagacagaagctggtacgcatgagcacggagggccagcctgacagaggagtgcagaggcagagaaggaaaaggcagaaagaaaaacccaggagtgcattattgcatgtggcaacagtccagaaggggtagtgatcagtaagtgaactgaaagggtcagtaatctaagggctaaaagtacatcacttgaaatggcaagcaggacgtcactggtatctgaaaggaagagtctgcacagagcagcaacaacgacgccagactgcggggggtgggaggtgcctatgagctgagggtatcaagtagagactcttcatgaaagtgtgtatgggaaaagatgctccagagggaataataatgagaaggggctgcagggtgcaagagtcagaggacaaaatgagacaatctaggtaagggcttagcacactatctcgcatttactaagtgctcaatgcacataaagggcttttatcgcccattcattaactatataataattttaaatttaaatgacaaaaatcagtccaaggagcctgcataccagtcggggagaaaaacaatcaacaaaataaataaattatatggtacatttgctaatagcaaatgctaagaagaaaaaataaactggggaaagaagatatcaaatgttgaagaaaaggacacaattttagatagggtggcctgggcaggcctcgctgagaaggtggcttgtaggtaaagacccaaaggaggtgagtaaagtaactataattagggagtaatagaaaaatattagttatcattgccagagcattcttcatatattattgttatggaaacatctggttattattctattattgctactctctttgctgcaattaatgttctttttttttttttttttgagacagagtctcattctgtcacccaggctggagtgcagtagtgcaatctcggctcactgcaacctctgcctcccagattcaagcgattctcctgccttagcctctcaagtaactgggattacaggcgcctgccaccatgccaggctaatttttttgttttgttttgttttgagatggagtcttgctctgtcacccaggctggagtacagtggcacgatctcggctcactgcaacctccgcctccggagttaaagcgattctcctgcctcagcctcccaagtagctgggattacaggcgcatgccaccacgccgggctaattgttgtatttttagaagaaactgggtttcaccatgttggccaggcaggtcttgaactcctgacctcaggtgatccacccacctcagcctcccaaagtgttgggattacaggcatgagccaccgcgcccagcccacgattaatgttcttataatcactgccatctctgggtgtttagtagtttcagcagtggcatccagtaaccacggtttctattacaaaggtgcgtggaatctaggaaaaccggggacaacagtgtaacatgctgtgtcatcatcatcagctggtttgtaagggcagaagcaaagccaagtggaagctgatcgtgcacgcagctgctgcaaacacaaagctgctcatgtgtgtgctgaggggaaagagggcagtcccagactgatctttcagtcccacctgtacacgtgaaatagccgcacaacaggaccatcttcagacctagagggcattgacgcaggcatctctggaggaacagaaaagtggtaactacatctcaaatcagtgcagatggagagtgtgtaatttagaggtcacaagacaggagtgtttctaccagaacactgatttggtggttagaaacaggaatccgctgatgccatctgggaataattaagacgaacgggaaattcttgctctgtgccaaaccgagcccaacgctgagagtaaggtgggtgtgtaataagcacttactggatcacactgaataagaggattcaatgttgcttgtgactgatgcatacaatgattaaaaagcctgatctagactaataattattctttgcaattcagagagaaggatcaaaaaaggaaaagaaagaaaaggaaaaaaaagtagaaaaagaatctaaatgcctgaggactcatcctatctttactccgtttaagaggctataatattttttaaagctaaatgtcaagtgtttcattccttaagtcacaggcttccgtgggtggatgggacaggccagaaaaatgggttttaaagacaaaaccccattcttaaactcaggttaacagaagttttgtaaatatcttagttacattttctttttttctttttttttttgagacggagtcatgctctgtcgcccaggctggagtgcagtggcgctatctcagctcactgcaacctctgcctcctgggttcaggcaattctcgggcctcagcctcactggtagctgggactacaggcatgcaccagcacagctggctaatttttgtatttttagtagagatgaggttttatcatgttggccaggctggtcttgaactcccggcctcaagtgatctgtctgcctcagcctcccaaagtgctgggattacaggcacgggccaccatgcccggtccttagttacattttttacatgtatttattacttgaagggggtcaatactgaatttatctattaaaacaaacaaaaaccctcaagattaaaacttgatagcttaactagcagtgcttagaatatataaaagtttttattaatttcttgtaaatgcctgtgtaaacagattataagtatgtccttcttggctacgaaaccaaaagtgaaccattgtaatggccaagtaaaagcttatgaaggaagaaattaaatgggccaactgcattttatagctcaagctaatagcaacgtatgtgatatttttgttattattatcacagccttaccatgcagcagttactataagatatttcatatgtttgtgaaagtgtgtatgctatattatattcatgcatggtacatgcttctctaaggatcccacagcctgatcgcgcaaacgttatctattctactttaagagtacaaagagtgaaatatggactacgggaagattatgactgtgcttgggactccataatgtgcctgtcatggagctgggaactcagccccctgatcactgggaactcctcagcaggagtggaacatgcaggatgagggaagggaggaagtggaggagatggaaaactggcttccaactggtttcgctgaatctgtgactgacttaagaagcaggatatgaattaccatgcactttattgcctcctcttggaaacatccttatgtcattgcgctatggccagagccctgaaggacatctgctctccttgggagctgctgagccagggtgcccgtgatgtcttcagaatccttcagtcccgactgcaggagaaacttggcacaggccaagtgctgacctgcacaggccagatgcagggctgaggggtgacaaaaatcacatggacttaaaacacaatccctggagcaatactgacctcatgagttgatagtgcccaataaaaatatcaattctttcaatatcttccgtaatccatcttcacaacttcacctatactagatcaaaatatttttgtttctaacctgattgggttgaaaatagttttaaagataacaaaaccagttagagaggatttaagaaatttatctaggctgggcgtggtggctcatgcctgtaatcccagcactctgggaggctgaggtaggcagatcatgaggtcaagagtgtgagactagcctgaccaacatggtgaaaccccatctctaataaaaattaaaaaattagccgggcgtggtggtgcatgcctgtaatcccagctactcgggaggctgaggcaggaaaatcgcttgaacccaggaggtggcggttgcagtgagcactgcacgccagcctgggtgacagagcaagactctgcctcaaaaaaaaaaaaaaaagaaaaagaaacttatctaaagcaagaagcaacagagcaagttaacaagatataggatacatcctcttcatacgcctgaatgctctggaaacacactttaaatggtacaaaaaactttctaaaaggcttattgaatttgctttgtaagtaaaaatatcaccacaaataatcacgtagccaaaaaaacacttttgaacaagcttcccactctgggtgcagaaatcagcactgaggttcctggtgtgctgagttcaggggcactggtgattctgctgctttccctccagcagagaagctgtgtcccttcctgggcagagcagctgccctttccagccctagagtgagtagttaggtacctgcgagtctttgaagcatcagaaagatcccactaggccaggcgcggtggctcatgcctgtaatccctgcactttgggagggcgaggtgggcagatcacttgaggtcaggagtttgagaccagtctggccaacatggtgaaaccctgtctctactaaaaatacaaaaattagctgggcatggtggtgggcacccgtagtcccagctacttgggaggcagaagaatcgcttgaacccaggaggtggaggttgcagtgagccaagatcgtgccactgccctccagactgggtgacagagcgagactttgtctccaaaaaaaaaaaaaaattccactaaacccttgcaagatggcctttggctcacagaatgttagagggtttattttaaagtccaagtctaaagaatttgctctcagcagatgtttctgaatattctaaataaaaaaaatcataatgaatatagtttctaaatatactccaaaatggatgacctgtgaagaattgatacgatacctggctagcaggtgtcatcatggattagaaagaaactgcttttatgatgcatatattgttatggtttaaaataacaacaaagattaacaacagcagttgtaatgagtggcagtcatcatcactgttataataacaattatatgaaggctttgcagagaaaaagatattttaaggaaaagtagctgagctattagaagaataacattaaggctggtcacagtggctcatgcctgtaatcccagcactttgggaggccaaggcaggtagattgtttgaggtcaggagttcaagaccagcctggccaacatagggaaaccccatctgtactaaaaatacaaaaattagccaggcatggtggtgcatgcctgtaattccagctacttgggaggctgagacatgagaatcacttgagccaggaggtggatgttgcagagagctgagatggcgtgccactgcactccagcctgggcaacagagggaaactcttgtctcaacaccaccaccactaaaaaaaaaaaaaaaaaaaaaaaaaaaaaggaagaatattaaaatcattgttttaaatataaaagtgtattggttatactcagtttactaatttccaaggcatatataaaattaaacggtacctgatcgatttttttcatctttagaattgatgtcagctcccaaggataagagagtctgaattgtacttgtatgtccttcctgaattgaaacaaatttgttatcactgtgatgaggataaaagaaaaccttttgcaaaccaaaaagtatctgagacaggtctcaatcaatttagaagtttattttgccaaggttaaggacatacctgagagacaggtctgtgtctctctccaaagatgattttgagggcttcaatatttaaaggggaaaagagggctggagtgaagaggaggagggtatggtcacattactgaatccacattgcaggataaaaggagcaggggggggattaggcaatgatacattaaatatctctttccactcagtaaattggcactttacataagataaggtgaatataaagtagctacctgtggaaatatttaaccctttatctgtagctatctgcttaggaacaaaaggaaaggcagctttctgcatgactcagctttcagcttaattttttttcttttggcagagtgagttgggggtcttacgtttttattttcctttcacactttaaacacagactctaacatatattaggcaccttttctaaaacagtcgactgctaaaagtgaattttcatctttttttccctaatttattcttttttttttttttgtagagacaaggtctcactatgttgtccagactgatcacaaacttctgggctcaagggatcctcctgtctcagcctcccaaagtgttgggattacaggtgtgagccactgcgcccagccaaattttcatatctaaagtaagatattgtatcattctcaattctaatataaatcattaaataaatattttggtgacatttaattattagaatatagatgatcaactctgtgagccaaattactgacccaatgcagttagtttccatcattgtgagcagtacaaatcttgtgatttatacagaacccaaaactctaaaatttcccaagcaaatatactctttgttgaaatctttaggggagagataaactagaaaagatcataaccgctcataaatgggaattcctattacagctagtaggaattattataataaatattttataaaataaaaatattatttatatatatatatatatatatatatatatatatatatatatatttgagatgtagtctcactctgttgcttggctggggtgcagtggcatgatcttggctcactgcaacctccacctcccgggttcaagcgatccttctgcctcagcctcctgagtagctgggactagtggcatgtgtcaccacccccagctaatttttttgtattttttagtagagacagggtttcaccatgttggccaggatggtcttgattttttttttttttttttgacacagtctcactctgtcgtccaggctggagtgcggtggtgcgatctcggctcactgcaagctcctcctcccaggttcacaccattctcctgcctcagtctccctagtagctgggactacaggcacctgccaccatgcccggctaattttttgtatttttagtagagacggggtttcaccgtgttagccaggatggtctcgatctcctgacctcacgatccacctgcctcagcctcccaaagtgctgggattacaggcttgagccactgcgcctggccggtctcgatctcttgaccccgtgatccgcccgccttggcctcccaaagtgctgggattacaggagtgagccactgcgcctggcctataaaataatttatacactctttgtctagccagttagtctgctactatgtgatgagactacagttaaggttccaggttcactcttcctatgggagcaccctgcggccacagagcacatcatgtgtatctacccagctgctcgaaagcaggacatcaggcaggaaaatgtaattgatcagaaaaacaagtaggccgggcatggtggctcacgcctgtaatcccagcactttgggaggccgaggtgggtggatcacaaggtcaaaagttcgagaccaacctggccaacgtggtgaaaccccgtctctaccaagaatacaaaaattagccaggcatggtggcaggcacctgtaatccagcctgggcaaaaaagcaagactttatctcaaaacaaaaacaaaaacaaacaaacaaaccaaaaaaaaaaaacaaaaaataagtaaaagcataaagccaatagataatgttaaggataatatgcaaaacgctcctagcatttaaaacagctacttttccagtgaaaatgtttgcttatcttcaatataccccagagagcctagtaaatgcaattctcttgccctggctgaagagttcttaacttctgaaatccagtataagaacagagagccaggaatttcatacaatgggtatttatagcttcaaataacgttattcctgaaaacaaaaacctgtgtgtgagggggaggcactttatggagtaaaaggcttttttttaaagttttgtctagcaacaaattcaagtcaggtttctatttaaagagataaagcgcttcagaatcctgaccatttcagaagaatatcatgggcaatttcttccatagagatggggtcaaagaaaccaggctgcagagctactgatcaaagaagtaaggcaagcctcagggaagctcggacaacgttataagaagtaacaaaccttagctgcataatgaagtgctgtgaggtgggttgatgtggctctcacatctacatcgacgccaagttcagagaccaagaatcggatggcttcgtcctgccctgtgacagctgccctgtgcagagcctgggcacccaggctgtcttctgctgaaaggcaagcctagtgggcagaggagagaaaggagcaaaggtcaaagataagaaacagggcaacttagatctgggcatctgctggcacttcagcaaaactgagctgtttacgcacaactctctgggcagaggatatgtggcttttgtctgattttcaaaggattctttttttttgagacgaagtctcactctgttgctcagggtggagtgcagtggcacaatcttggctcactacaacctccatctccttggttcaagcgagtctcttgcttcagcctcaggtgtgtgccaccacacctggctaatttttatatttttagtagagatgggttttaacatgttggctaggctggtctcaaattcctgaccttagatgacccacccgctttggcctcccaaagtgctgggattacaggcatgagccatcacgccctgctctcaaaaaagggctctctaatcaaaaagatggttatgattcaatgttccaggctatggtgccaaaagcactatcagcagagacagtttgttgttattattgctataaaacagctaccatttactgaatattttgctaactgctttatgtacattatattatttaatccttgtaaaactttctgaagaaactacatttctctccattttacagatgggaacactggtgcttaaagaggtcaccaagttccagagagagagtttggaggggctggggaatggaacctgggatctgagtaacaatgtgctctgcttaacctgtgacctaaaatttataggaagaaccaaaagaataaaaacacaaccatttttataccccatgttcatcgaggagcagcctagcgacgtcgatgtgcccacactggattgcgtccatcaaggcggtgacgccacagttgtctctgtagtctggttcatattggcacctagagccaaaaccccaagtaagagctgagaaaattcaatacctcaaacccaggggacagttgacacctgatcacctgcaggtgaactgcgtgtgtgcaaatgacctgtgagcatggagctctctctattctcccccatctcagtgtccgaactgagcactaagccttcaggagcgtgatggtcttccctagcagacctgctgctcctctaaccttctccatcccatttgacagcacttggtctcttcagcttcctgcaccagagacctggaagccaccccttgccactgcctttcctgcatccttcataatcaattgattacccccatccttcaattccacagccaaaatatttaagacatctgtgtctgagctgggcacagtggctcacgactgtaatcccagcactttgggaggccgaggtgggtggatcacctgaggtcaggagttcaagaccagcctggccaatgtggtgaaaccccgtctctaccaaaaatataaaaaattagccaggtatggtggcatgcacctgcaatcccagctacttaggaggttgaggcaggagaatcgcttgaacctgggaggtggaggttgcagtgagctgagattgcaccattgcagtccagcctgggtgacaaaagcaaaactccatctcaaaaactaaaaaaaaaaaaaaaaaaaggaaaatcctcaatgtggctgatagcattcattctcccaccccttcactgttcaggctcagcatattctaggcgtcttttgttttcttaaatgtaccacagttgttcctggtttggagcatccgtgggtgctgttattgctgtctggaatggtcccttgcctcccgctttcagctaatttctttttctccttcaggtcacagcttaaacactggcgctgagattctttactcttaagccaaattgggtcttcccattatttgttctgtagggatcctgcaagtccttgtaatgcacaacagactttcgggactccttcatggtctgtctttcctgccagtctgttgagttccaggagggtagaaactacatgtgtcttctttctgttgtggcccttgcacctggtacagggctttatttattttttatttatttttttttgagacagagtcttgctctgttgccaaggctggactgcagtggcgcgatctcggctcactgcaagctccgcctcttgggttcacgccattctcctgcctcagcttcctgagtagctgggactacaggcgcccgccaccacgcccggctaattttttttgaatttttagtagagacagggtttcgctgtgttagccaggatggtctcgatcttctgaccttgtgatccgcccgcctcggcctcgcaaagtgctgggattacaggcgtgagccaccgagcactaaatgaatgtataaatgctcgttgaaaaaaatagagaaatggatgattttgccgctgaaaacattttccccagatatttgttatttttgtttcatattctttatctgctatgtcttttgttcatttttcttttgaaagcctaatttttttcttaaaaatgtgtctgagctctttatgtagcactgatatcaactctttgtcatagttagcaaatattttccctgacttgctgtattgttcttacctcttaagaagcaccttgactgcctccaaatggccatgcattgctgggaggagaaagaaagctgagaattagagctttttagtgcacacacaaaatgcttcctgcctcctggctttgctctctgccccgttctattagtgatagcttacaagaaggagtcattaaattgggtacactgttaccgccctacacgaataaatatttaactggataaagcggtaaacaataatgttttcactttatatgtacacagccaacacttgattatcttatcttcacgtgcactttcatgggaaactttcaatcctaaagttacacttctgtgctgtggatccccaagactagtccatttttgcccaggaaatgcaaaatattgtaacagtaatccatggcaaaatagcctggatttaattcccctactaaaagtaactatactcaaaggttatgactatttgtcttccactattttgggtgaatgatggagtgctgattgtttctccaggggagaaactggtcaaataattcatgagctaaaaaaaagttttctacttacttaagaagttttagaaatgattccttggtccctaattgccaactgtggctcatgcctgtaatcccagcactttgggaggccaaggtgggtggatcacttcaggtcaggagttcaagaccagcctggccaacaaggggaaaccccatctctactaaaaatatgaaaattagctgggcatggtggcatgcgccagtaatcccagcttctcgggagactgaggcacgtgaattgcttgaacctgcgaggcagaggttgcagtgagccgagatcgtgccactgtattccagcctgggtgacagagcaagactctgtctcaaaaaaaaacaaaagacaaaaagcaacactataaaacatcacaagtgatgatttttagagaaactaaaagccctctatcctaatcaatgtactacctagaaagctacaagttatattctgaatttcttaatctagactcttgagctccttaatatctaacttctgaaattacagtaattttactttttactaattgttttctttttactttcttcaaacaaatgagcaaattgaaactttttactaaaataatctacaaatagataattcagagttaagagtcactactccaaataataaaaactgtaacccaaatttacattagatgttattgggccaaggtatttaattatgagtatctatatttatttaaaagtatagcactatggtaggtgttactaaggctatgaggatatatatttccctcctgcctttaagagtaagaatgtaaacatgataaagaaaatagcactaaccagttattttgtgctatgtgccaagcattgtctaaaggatttacatacatcatgctctttaaactctacaacaaccctgagacataccatcactgacattattatttggttgatgaggaaacttgctcaagagagagactaatttccttacccaaggtcaaagactatgtgctacagaaccagctcatgggcaaataatctagggaggataacacagatacacacgaaaaataaattaataccacagcatgctagccaagttatgttaactttagaaattgattatatgccaaaaggcccctagatgctttttttttttttttgagatggagttttgctcttgttgcccaggctgtagtgtaatgtagtgcaatcttggcttagtacaacctctgcctcctgggttcaagccattctcctgcctcagactctggagctccccagtagctgggattacaagcagccgccaccacgcccggctaattttttgtatttttagtagagacggcgtttcaccatgttggccaggctggtcttgaacgcctgacctcaggtgatccacccgcctccggcctcccaaagtgctgggattacaggcgtgagccactgcacccgcgcccccgcccccaccccctcccccccagatgttcttattctctgccttctgttttccaaaatcctcctttcccctgaaggtgacctgaacaagatgcggttgggcagtgctgggtgaagcagccacatgtgtgtactgctcacctgcagagctgtaggctgtacctgcagtatgcagaggagtccttctaattttgctctctgtcttccaggcacctgggcaaacagtgagcaggtactggaggatcagagggtcgccttctcgactggcaatgtggaaactgttccagccatctttgttcttcaggagtggattggcgccatgttccaccagctcctggatcacccccaggttcttccttgtgcaggccatcatcagaggagtcctaaggccaaccaggagaagctgtcagatggaggcagctgagacattagaagccaggggccaggtcttcaaaacacacacatccttggcacagatggaaaacctagaggattcaggggtctggcaggcaggaaaacagctttgaccggcaacctctgtgccttctgtgaggaccctgggagaaataataaggggaaaatgattgtaacgaacgtgtacctagaggagagggtgcctgggagacaaagcagcttataagctagttcacaggatagcagtgaattggagcagagctaagaaaacccacagacaaccctcaacacataacgaagtctattcccctgccccagtggggaagatgtacttccctatgttcctaaagatgttcacgccctctaacgaacctgacctagtgagtactaaaatcagtgtcaatctaacaaacgaaatgcaattggcttgtgtgatggtggagcagagtatctctgactgtggtggttatgcaaggctgcacgtatgtgatacaactgcactgtgctctacacacacgagcgcgtgtataactcaggaattctggatattgattggagcaatgccacttgaaacaatgcattggtgcagaagtaacttagctaaatgtccccagaacatcgcatccggaggctatctgtatagtgcacacacttcattgtttggtaacattctctttggttatattctacactattccgtgctctagaaagggaggtgactgccccgaccagttaacccacaagggcaggaacgagggactctgcaggtcatctgcgttataagggaaagttgggcaggaggtccctgccgctgagcaggcctggggtgagaactaggagctgagaacagctacggtgtccaaggggacggagaagcacagggaactcgctacgactctgcgagtagaggggaggcggggtgtctttccgctccacacctaccagtcggccttcttcaggcagtcgaccgctgccccccggcccagcaggtagcgcacgcagtctcggtggcccatggaggccgcctcgtgcagaggccgcttgtagtctcggttggtggcctcgatgtccatgccccaggcctcggccagataggccagcacgtcccgatgcccgtggcgcgcggcgcagtgcaggagggtatccccggccggccccgggcagcccccggccgcctgcagctcctccttcagggcgcgcagccggccctcctgcaccagcctgcagaggcgccgcgggtccccgggctgggccatcgccgcgggtcgggccgggctgcgcggggaggcggcgggcgggacaccggcggccgggcagggagaagccgagggcgagtgggactttccgcctcttcacgcaacctgccccgcgcgccccgaacccggcagaaccgcccctcacgcccccggctttgtccccggcagagccgcctcctcaaacccccggcctagtccgcaggcgggctgccccctcacagccccggcctgccccgcgtgggagaagccgcggttccgggcacggggcggtttttcctcagggacggagcggtccgggatgagcacggaggggcctggggatccgagagcgctggcgtccgccgtcctggagctgcagcggcccgtacgtgattcgggactgaacacgtaagggagtggggcgcgccgctacaccgcaaagccccaaagtggagggtccgggagggcgcgcacagcctcgcccggcgccgtgcagggtggctcctgaggcagccaggcccaagcgtgacctgccccgcacgcgtcctcagggccgccccagcc

SEQ ID NO: 2086 - DNA, 11812 bp, Homo sapiens
atatgaattaccatgcactttattgcctcctcttggaaacatccttatgtcattgcgctatggccagagccctgaaggacatctgctctccttgggagctgctgagccagggtgcccgtgatgtcttcagaatccttcagtcccgactgcaggagaaacttggcacaggccaagtgctgacctgcacaggccagatgcagggctgaggggtgacaaaaatcacatggacttaaaacacaatccctggagcaatactgacctcatgagttgatagtgcccaataaaaatatcaattctttcaatatcttccgtaatccatcttcacaacttcacctatactagatcaaaatatttttgtttctaacctgattgggttgaaaatagttttaaagataacaaaaccagttagagaggatttaagaaatttatctaggctgggcgtggtggctcatgcctgtaatcccagcactctgggaggctgaggtaggcagatcatgaggtcaagagtgtgagactagcctgaccaacatggtgaaaccccatctctaataaaaattaaaaaattagccgggcgtggtggtgcatgcctgtaatcccagctactcgggaggctgaggcaggaaaatcgcttgaacccaggaggtggcggttgcagtgagcactgcacgccagcctgggtgacagagcaagactctgcctcaaaaaaaaaaaaaaaagaaaaagaaacttatctaaagcaagaagcaacagagcaagttaacaagatataggatacatcctcttcatacgcctgaatgctctggaaacacactttaaatggtacaaaaaactttctaaaaggcttattgaatttgctttgtaagtaaaaatatcaccacaaataatcacgtagccaaaaaaacacttttgaacaagcttcccactctgggtgcagaaatcagcactgaggttcctggtgtgctgagttcaggggcactggtgattctgctgctttccctccagcagagaagctgtgtcccttcctgggcagagcagctgccctttccagccctagagtgagtagttaggtacctgcgagtctttgaagcatcagaaagatcccactaggccaggcgcggtggctcatgcctgtaatccctgcactttgggagggcgaggtgggcagatcacttgaggtcaggagtttgagaccagtctggccaacatggtgaaaccctgtctctactaaaaatacaaaaattagctgggcatggtggtgggcacccgtagtcccagctacttgggaggcagaagaatcgcttgaacccaggaggtggaggttgcagtgagccaagatcgtgccactgccctccagactgggtgacagagcgagactttgtctccaaaaaaaaaaaaaaattccactaaacccttgcaagatggcctttggctcacagaatgttagagggtttattttaaagtccaagtctaaagaatttgctctcagcagatgtttctgaatattctaaataaaaaaaatcataatgaatatagtttctaaatatactccaaaatggatgacctgtgaagaattgatacgatacctggctagcaggtgtcatcatggattagaaagaaactgcttttatgatgcatatattgttatggtttaaaataacaacaaagattaacaacagcagttgtaatgagtggcagtcatcatcactgttataataacaattatatgaaggctttgcagagaaaaagatattttaaggaaaagtagctgagctattagaagaataacattaaggctggtcacagtggctcatgcctgtaatcccagcactttgggaggccaaggcaggtagattgtttgaggtcaggagttcaagaccagcctggccaacatagggaaaccccatctgtactaaaaatacaaaaattagccaggcatggtggtgcatgcctgtaattccagctacttgggaggctgagacatgagaatcacttgagccaggaggtggatgttgcagagagctgagatggcgtgccactgcactccagcctgggcaacagagggaaactcttgtctcaacaccaccaccactaaaaaaaaaaaaaaaaaaaaaaaaaaaaaggaagaatattaaaatcattgttttaaatataaaagtgtattggttatactcagtttactaatttccaaggcatatataaaattaaacggtacctgatcgatttttttcatctttagaattgatgtcagctcccaaggataagagagtctgaattgtacttgtatgtccttcctgaattgaaacaaatttgttatcactgtgatgaggataaaagaaaaccttttgcaaaccaaaaagtatctgagacaggtctcaatcaatttagaagtttattttgccaaggttaaggacatacctgagagacaggtctgtgtctctctccaaagatgattttgagggcttcaatatttaaaggggaaaagagggctggagtgaagaggaggagggtatggtcacattactgaatccacattgcaggataaaaggagcaggggggggattaggcaatgatacattaaatatctctttccactcagtaaattggcactttacataagataaggtgaatataaagtagctacctgtggaaatatttaaccctttatctgtagctatctgcttaggaacaaaaggaaaggcagctttctgcatgactcagctttcagcttaattttttttcttttggcagagtgagttgggggtcttacgtttttattttcctttcacactttaaacacagactctaacatatattaggcaccttttctaaaacagtcgactgctaaaagtgaattttcatctttttttccctaatttattcttttttttttttttgtagagacaaggtctcactatgttgtccagactgatcacaaacttctgggctcaagggatcctcctgtctcagcctcccaaagtgttgggattacaggtgtgagccactgcgcccagccaaattttcatatctaaagtaagatattgtatcattctcaattctaatataaatcattaaataaatattttggtgacatttaattattagaatatagatgatcaactctgtgagccaaattactgacccaatgcagttagtttccatcattgtgagcagtacaaatcttgtgatttatacagaacccaaaactctaaaatttcccaagcaaatatactctttgttgaaatctttaggggagagataaactagaaaagatcataaccgctcataaatgggaattcctattacagctagtaggaattattataataaatattttataaaataaaaatattatttatatatatatatatatatatatatatatatatatatatatatttgagatgtagtctcactctgttgcttggctggggtgcagtggcatgatcttggctcactgcaacctccacctcccgggttcaagcgatccttctgcctcagcctcctgagtagctgggactagtggcatgtgtcaccacccccagctaatttttttgtattttttagtagagacagggtttcaccatgttggccaggatggtcttgattttttttttttttttttgacacagtctcactctgtcgtccaggctggagtgcggtggtgcgatctcggctcactgcaagctcctcctcccaggttcacaccattctcctgcctcagtctccctagtagctgggactacaggcacctgccaccatgcccggctaattttttgtatttttagtagagacggggtttcaccgtgttagccaggatggtctcgatctcctgacctcacgatccacctgcctcagcctcccaaagtgctgggattacaggcttgagccactgcgcctggccggtctcgatctcttgaccccgtgatccgcccgccttggcctcccaaagtgctgggattacaggagtgagccactgcgcctggcctataaaataatttatacactctttgtctagccagttagtctgctactatgtgatgagactacagttaaggttccaggttcactcttcctatgggagcaccctgcggccacagagcacatcatgtgtatctacccagctgctcgaaagcaggacatcaggcaggaaaatgtaattgatcagaaaaacaagtaggccgggcatggtggctcacgcctgtaatcccagcactttgggaggccgaggtgggtggatcacaaggtcaaaagttcgagaccaacctggccaacgtggtgaaaccccgtctctaccaagaatacaaaaattagccaggcatggtggcaggcacctgtaatccagcctgggcaaaaaagcaagactttatctcaaaacaaaaacaaaaacaaacaaacaaaccaaaaaaaaaaaacaaaaaataagtaaaagcataaagccaatagataatgttaaggataatatgcaaaacgctcctagcatttaaaacagctacttttccagtgaaaatgtttgcttatcttcaatataccccagagagcctagtaaatgcaattctcttgccctggctgaagagttcttaacttctgaaatccagtataagaacagagagccaggaatttcatacaatgggtatttatagcttcaaataacgttattcctgaaaacaaaaacctgtgtgtgagggggaggcactttatggagtaaaaggcttttttttaaagttttgtctagcaacaaattcaagtcaggtttctatttaaagagataaagcgcttcagaatcctgaccatttcagaagaatatcatgggcaatttcttccatagagatggggtcaaagaaaccaggctgcagagctactgatcaaagaagtaaggcaagcctcagggaagctcggacaacgttataagaagtaacaaaccttagctgcataatgaagtgctgtgaggtgggttgatgtggctctcacatctacatcgacgccaagttcagagaccaagaatcggatggcttcgtcctgccctgtgacagctgccctgtgcagagcctgggcacccaggctgtcttctgctgaaaggcaagcctagtgggcagaggagagaaaggagcaaaggtcaaagataagaaacagggcaacttagatctgggcatctgctggcacttcagcaaaactgagctgtttacgcacaactctctgggcagaggatatgtggcttttgtctgattttcaaaggattctttttttttgagacgaagtctcactctgttgctcagggtggagtgcagtggcacaatcttggctcactacaacctccatctccttggttcaagcgagtctcttgcttcagcctcaggtgtgtgccaccacacctggctaatttttatatttttagtagagatgggttttaacatgttggctaggctggtctcaaattcctgaccttagatgacccacccgctttggcctcccaaagtgctgggattacaggcatgagccatcacgccctgctctcaaaaaagggctctctaatcaaaaagatggttatgattcaatgttccaggctatggtgccaaaagcactatcagcagagacagtttgttgttattattgctataaaacagctaccatttactgaatattttgctaactgctttatgtacattatattatttaatccttgtaaaactttctgaagaaactacatttctctccattttacagatgggaacactggtgcttaaagaggtcaccaagttccagagagagagtttggaggggctggggaatggaacctgggatctgagtaacaatgtgctctgcttaacctgtgacctaaaatttataggaagaaccaaaagaataaaaacacaaccatttttataccccatgttcatcgaggagcagcctagcgacgtcgatgtgcccacactggattgcgtccatcaaggcggtgacgccacagttgtctctgtagtctggttcatattggcacctagagccaaaaccccaagtaagagctgagaaaattcaatacctcaaacccaggggacagttgacacctgatcacctgcaggtgaactgcgtgtgtgcaaatgacctgtgagcatggagctctctctattctcccccatctcagtgtccgaactgagcactaagccttcaggagcgtgatggtcttccctagcagacctgctgctcctctaaccttctccatcccatttgacagcacttggtctcttcagcttcctgcaccagagacctggaagccaccccttgccactgcctttcctgcatccttcataatcaattgattacccccatccttcaattccacagccaaaatatttaagacatctgtgtctgagctgggcacagtggctcacgactgtaatcccagcactttgggaggccgaggtgggtggatcacctgaggtcaggagttcaagaccagcctggccaatgtggtgaaaccccgtctctaccaaaaatataaaaaattagccaggtatggtggcatgcacctgcaatcccagctacttaggaggttgaggcaggagaatcgcttgaacctgggaggtggaggttgcagtgagctgagattgcaccattgcagtccagcctgggtgacaaaagcaaaactccatctcaaaaactaaaaaaaaaaaaaaaaaaaggaaaatcctcaatgtggctgatagcattcattctcccaccccttcactgttcaggctcagcatattctaggcgtcttttgttttcttaaatgtaccacagttgttcctggtttggagcatccgtgggtgctgttattgctgtctggaatggtcccttgcctcccgctttcagctaatttctttttctccttcaggtcacagcttaaacactggcgctgagattctttactcttaagccaaattgggtcttcccattatttgttctgtagggatcctgcaagtccttgtaatgcacaacagactttcgggactccttcatggtctgtctttcctgccagtctgttgagttccaggagggtagaaactacatgtgtcttctttctgttgtggcccttgcacctggtacagggctttatttattttttatttatttttttttgagacagagtcttgctctgttgccaaggctggactgcagtggcgcgatctcggctcactgcaagctccgcctcttgggttcacgccattctcctgcctcagcttcctgagtagctgggactacaggcgcccgccaccacgcccggctaattttttttgaatttttagtagagacagggtttcgctgtgttagccaggatggtctcgatcttctgaccttgtgatccgcccgcctcggcctcgcaaagtgctgggattacaggcgtgagccaccgagcactaaatgaatgtataaatgctcgttgaaaaaaatagagaaatggatgattttgccgctgaaaacattttccccagatatttgttatttttgtttcatattctttatctgctatgtcttttgttcatttttcttttgaaagcctaatttttttcttaaaaatgtgtctgagctctttatgtagcactgatatcaactctttgtcatagttagcaaatattttccctgacttgctgtattgttcttacctcttaagaagcaccttgactgcctccaaatggccatgcattgctgggaggagaaagaaagctgagaattagagctttttagtgcacacacaaaatgcttcctgcctcctggctttgctctctgccccgttctattagtgatagcttacaagaaggagtcattaaattgggtacactgttaccgccctacacgaataaatatttaactggataaagcggtaaacaataatgttttcactttatatgtacacagccaacacttgattatcttatcttcacgtgcactttcatgggaaactttcaatcctaaagttacacttctgtgctgtggatccccaagactagtccatttttgcccaggaaatgcaaaatattgtaacagtaatccatggcaaaatagcctggatttaattcccctactaaaagtaactatactcaaaggttatgactatttgtcttccactattttgggtgaatgatggagtgctgattgtttctccaggggagaaactggtcaaataattcatgagctaaaaaaaagttttctacttacttaagaagttttagaaatgattccttggtccctaattgccaactgtggctcatgcctgtaatcccagcactttgggaggccaaggtgggtggatcacttcaggtcaggagttcaagaccagcctggccaacaaggggaaaccccatctctactaaaaatatgaaaattagctgggcatggtggcatgcgccagtaatcccagcttctcgggagactgaggcacgtgaattgcttgaacctgcgaggcagaggttgcagtgagccgagatcgtgccactgtattccagcctgggtgacagagcaagactctgtctcaaaaaaaaacaaaagacaaaaagcaacactataaaacatcacaagtgatgatttttagagaaactaaaagccctctatcctaatcaatgtactacctagaaagctacaagttatattctgaatttcttaatctagactcttgagctccttaatatctaacttctgaaattacagtaattttactttttactaattgttttctttttactttcttcaaacaaatgagcaaattgaaactttttactaaaataatctacaaatagataattcagagttaagagtcactactccaaataataaaaactgtaacccaaatttacattagatgttattgggccaaggtatttaattatgagtatctatatttatttaaaagtatagcactatggtaggtgttactaaggctatgaggatatatatttccctcctgcctttaagagtaagaatgtaaacatgataaagaaaatagcactaaccagttattttgtgctatgtgccaagcattgtctaaaggatttacatacatcatgctctttaaactctacaacaaccctgagacataccatcactgacattattatttggttgatgaggaaacttgctcaagagagagactaatttccttacccaaggtcaaagactatgtgctacagaaccagctcatgggcaaataatctagggaggataacacagatacacacgaaaaataaattaataccacagcatgctagccaagttatgttaactttagaaattgattatatgccaaaaggcccctagatgctttttttttttttttgagatggagttttgctcttgttgcccaggctgtagtgtaatgtagtgcaatcttggcttagtacaacctctgcctcctgggttcaagccattctcctgcctcagactctggagctccccagtagctgggattacaagcagccgccaccacgcccggctaattttttgtatttttagtagagacggcgtttcaccatgttggccaggctggtcttgaacgcctgacctcaggtgatccacccgcctccggcctcccaaagtgctgggattacaggcgtgagccactgcacccgcgcccccgcccccaccccctcccccccagatgttcttattctctgccttctgttttccaaaatcctcctttcccctgaaggtgacctgaacaagatgcggttgggcagtgctgggtgaagcagccacatgtgtgtactgctcacctgcagagctgtaggctgtacctgcagtatgcagaggagtccttctaattttgctctctgtcttccaggcacctgggcaaacagtgagcaggtactggaggatcagagggtcgccttctcgactggcaatgtggaaactgttccagccatctttgttcttcaggagtggattggcgccatgttccaccagctcctggatcacccccaggttcttccttgtgcaggccatcatcagaggagtcctaaggccaaccaggagaagctgtcagatggaggcagctgagacattagaagccaggggccaggtcttcaaaacacacacatccttggcacagatggaaaacctagaggattcaggggtctggcaggcaggaaaacagctttgaccggcaacctctgtgccttctgtgaggaccctgggagaaataataaggggaaaatgattgtaacgaacgtgtacctagaggagagggtgcctgggagacaaagcagcttataagctagttcacaggatagcagtgaattggagcagagctaagaaaacccacagacaaccctcaacacataacgaagtctattcccctgccccagtggggaagatgtacttccctatgttcctaaagatgttcacgccctctaacgaacctgacctagtgagtactaaaatcagtgtcaatctaacaaacgaaatgcaattggcttgtgtgatggtggagcagagtatctctgactgtggtggttatgcaaggctgcacgtatgtgatacaactgcactgtgctctacacacacgagcgcgtgtataactcaggaattctggatattgattggagcaatgccacttgaaacaatgcattggtgcagaagtaacttagctaaatgtccccagaacatcgcatccggaggctatctgtatagtgcacacacttcattgtttggtaacattctctttggttatattctacactattccgtgctctagaaagggaggtgactgccccgaccagttaacccacaagggcaggaacgagggactctgcaggtcatctgcgttataagggaaagttgggcaggaggtccctgccgctgagcaggcctggggtgagaactaggagctgagaacagctacggtgtccaaggggacggagaagcacagggaactcgctacgactctgcgagtagaggggaggcggggtgtctttccgctccacacctaccagtcggccttcttcaggcagtcgaccgctgccccccggcccagcaggtagcgcacgcagtctcggtggcccatggaggccgcctcgtgcagaggccgcttgtagtctcggttggtggcctcgatgtccatgccccaggcctcggccagataggccagcacgtcccgatgcccgtggcgcgcggcgcagtgcaggagggtatccccggccggccccgggcagcccccggccgcctgcagctcctccttcagggcgcgcagccggccctcctgcaccagcctgcagaggcgccgcgggtccccgggctgggccatcgccgcgggtcgggccgggctgcgcggggaggcggcgggcgggacaccggcggccgggcagggagaagccgagggcgagtgggactttccgcctcttcacgcaacctgccccgcgcgccccgaacccggcagaaccgcccctcacgcccccggctttgtccccggcagagccgcctcctcaaacccccggcctagtccgcaggcgggctgccccctcacagccccggcctgccccgcgtgggagaagccgcggttccgggcacggggcggtttttcctcagggacggagcggtccgggatgagcacggaggggcctggggatccgagagcgctggcgtccgccgtcctggagctgcagcggcccgtacgtgattcgggactgaacacgtaagggagtggggcgcgccgctacaccgcaaagccccaaagtggagggtccgggagggcgcgcacagcctcgcccggcgccgtgcagggtggctcctgaggcagccaggcccaagcgtgacctgccccgcacgcgtcctcagggccgccccagcc

SEQ ID NO: 2087 - DNA, 11812 bp, Homo sapiens; identical to SEQ ID NO: 2086

SEQ ID NO: 2088 - DNA, 1103504 bp, Homo sapiens
ttttttttttttgcccttatacctcttcgcctttctgtggttccatccacttcttccccctcctcctcccataaacaactctcctacccctgcacccccaataaataaataaaaggaggagggcaaggggggaggaggaggagtggtgctgcgaggggaaggaaaagggaggcagcgcgagagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcggtaagttcctcgcccttgggggcgcgaacccgcggcgaggagggcgcatcccgggcgcgcgggcagcggggctcgacggccgcccgagcaaggcagaggcgctctgggtcccagttgttggtttcagggtggtgggttctcagcgatcctcagagagggaggtttcgctttctccagcttcccttgtcttaggctttgccactggagaaagcccaagtttagtcctgggttggggcctcctgaaactttttaatcctttggggtttggctcaccaagtagatcggaaatgtgccggctgctttcttgtgggtgatatgaacttggctttggttaggagttgctgattctgggcctcctttgaaggaggaagggtgagtcccgcaggattttaacgccttcccttcacttggagtccagagtgtggagatggttaggggtttgcttctgtgtctgtgaagtctctgcaaggaaggggcagtgcactgacattccccgacagatgtggcagagttttttggcaactcaatgtccagcagagaggtgcagtctgtaccttgtgaatatgtgtaatatgtgagaattataaagttgttattggtgggggtttttttttttggccaagtcatctcaagaaattttgttttcacaatattttggtttggaggatgtttttgcacttcactgcatcagaacagatgaacgaaattatggaatatcacatgtaggccctgaagaagaagaattttggaagtttagcaattatttgctacaccttttcccacttaccactgaaaagtattcttcccgggtctgcttcatatgatcaggtttgagaaattagctgattatctcatttcgttgctgaggtagcattatgtttatgccattcataaactaatttctatgatctaaatatctgtataatttcctgattactatataatcactaacacatagcggggtttcttctcaaacagtaaattaacacgattacacatcacaaattccaacatgcataatagcttttccccctggtctttatgtatccgtctaatagacgtttgggttaattgaatttttataaaactcagcaccatgccaagcagagtctgcctgtgatggagagtgtgtcagttcttttaaatttgtgtctggtgggggccaattatttaaatttctggttggcatttgtggtggttaagtcctgctgttaattaatacctgatgatttggttttaatgacagcaaagatcattgttcacccaccattcccttatctgaacaatgtactttgtatgccagagacctgttaggattgcaccactcagtggacagaagctgttcagagagtggtgctgaagaaagctaagtggcatagggattccccgagacccactgatagatgtcactccaaagcatgggaaatgctctgctgggagctgtcttattaggcaaccgaaaagctcagcaccatcgtactgcagcatatgttactctgttacagaatctgaaacaaaaccttttaagcaacaccactgtccagttttcatatgttttatagtgtgtaattcaggaaggatttttcctttatcccaagtcatgagttttgaatcattcacaccacatggtgggaagttaatataaaggggattgtagttagctgtgatgcctaggattgggggtgcattactacattatcaattgtgttagttataccttttaactagaaataaatgtaagacttgagaggtaaagttcttacaagcatccagagaatgtttggaaatggaaaactcatgttgtttggaggaatcatattctattcttgtgcttctaaggggaaaaaacttcattgaaggtacttagttttgtccctcagtttgccagtcaaaagaaatataatacatagttgtaagttgtggcacgttttaaaaaaatgggtttttaatgagctggagatctttttgcatgtaatcgagtatgttaagaaatcacaaagttactgccctggatttctgtagctattgtgtgtgcttggcgatttttgtgttatatgatttaaagtaggatattgcttttaacctcaaatagatttagctaagttctaactgaaatcatgctaaaagtttctcctcgcatttttacaaacatagtgtttcttgtaaaactggaggataaaagcaaataatatcagctattttatatgatgtaaattcagtaaatctgcacttggaatattgagtgtaaaagtgtgtgtgtgtgtgtgtgtgagagagagaatgaatgaatgtgtgaattcatccagttgtgtggtgtcagataatgccattcagaatttgccaggcaaagaaacacagaaaaatggaaaagagagagagagagagaactagcaagaggaaagaatgagaatgagaatgggggctgatttgttctggttgagctgcttctggtcagaagatttcagggagagtgatggagcagaaggccctcacctaacatgaagctgccctgggggcgtgatggttgtgtgcaggcttgagccataatgctaggctggagaaggaatagagcaaagtcattttgtgatatcatacccaggggaacagtttccagctctgctgctctcagctgctgtgttgtttcctacaagttgtttgctagtgtagaaactacacatgcaacagattagccttagggttgagttaataaaaatctttcctcttgaaattcctttttctctttccccctcatctaatataaactccggaataatgtcgataaaacaagaagctctttgaaaaatggacctttggaaacagaaactatgagtgtattttagaagacaacatggaaattcatagcttaattgctttgtagttgaagtttgtataaatgacacttcctttacagttatttaaagtgtttgtagtcttcactttttctgttgctcactgaacgacctaagaaatatccttgggttttatgttcattggaatgcaggataatttgctgtccgattaaatctctattattcaaacaagtcattgtttgatgtgctacacttttagcttccaaagcattgtggttatatgaggcagaagctgatttccaaaaaggagtacaaacactgaggttgaataacatctacaattgggctatgccagatttgtacatcaattctgatcttacaagccaatataagtattttatatcatatgatggtagaatgaagatgtatacatgtatgcatgtattgataatgtaaacatctttatcaaatatttatgatacatagcacttgctctttttaatatcttcagtcactatttaataaagtgtgctaaccttatggtgttttgaaaatgaaagaaaatgctgcagagattttccagtcagcattaaagaaaactattcttaataaaagctatattaaggaaatagaaacagtaacagatatagcctgactgcttgtatgttgtaaatacacatgtaaatttaatttcccaagtgtttgtgactgctctttttaaactttataaatcttgctgtcaaaaatctataccggatttaaaatagctacttctactgagtagagaaactatgtatttatttatatgtatgttaaaaatgaaaccaacataggtcatttgggagaagaactccttagaataaaaatattttaaaaagtggatttaaatatctgagttagaatatttcactagcactaggggatcgttcttgttgttgtggggtatctataaatcctctgaatgtagggaaagtcttaccatatgtcctgatgtattaagtaagactaggagctttagacaacagagaattaaaacagtgagctgtacttcctctggcttgtatatttatagcaaatgagagcaaaagatgtgattgggcgggttattgcccttgtcaaatataatctattcattcttccggaaatctcctttgcttcgatacctattttcttcctgtttttttttcttaattataaacataatgtcttttacaaccctcttgtacatttcaatgacaatttatgaactgcttagatatccaaagatctctaaatcctcatagcaatacttagccttttatttgttttaaatatggttgaatgatctgaaaaaataatctcttttgatagctcttaatgaatgggtattttgattagctttgtatagataaatgataatgaaaacaaaaagtatacaattagggttcttactgattcaagcaatttgttaccaccccaaaatagtgcaacatggcttagtgaaagtcttcataagaaagtaaaaactaatttacaatgttcttatttcctaatcacagaaatgggcattgtggacagttttcaaccaatatatgaatactctaaatttgtgcatacatattgttactccgcttttatgttataacatgtaagttaaaattactattatgaaagaatatataacctggctagtttacccccaacctctccagaatatcagtcgctttatagtacttgaacgtttgcttagtgacacattctgttgaaatctaatgttgaattatttgtggatttacagaatatacaaattcacaaataattgtatgactaagacaaaacttggtcattttaagttgagggattgtcctagttgagaggttgtgttttcatattgcctaagttgttgagtgctgtagtgcacttcaagtaaatctgtttctgaagacttgccccctggattttcgtccctaaattatccatacaggttgaagcagataaaatacaagaaattttggtgaagttgaaggttaaaaatagattgactagtctcttcttggcatagatacaattattaggaaacagttctccctaatacagacttgccatccaggcatcctagagagagatgcatatgtggtaatttacattaatttttggtcttcttcaggagaaccaggatatttttccctacggaaaatagtttgttaggaagttctttcctggcccttgatttacctcatttggacctagtaaaatttatactttgttttaaattacaactaaaaaatcaaaaagaagaaatgttacctacagtctggatggaccgtaagagactgtcctactactttctaactcagacttctgtgttttttcttttcttcttctttatttcccctatgaagatactacaggggaagccttgggtaaatgatggggcccaggagtggattgtagtgtatgagtttaggattgctagtcattatcatatggactagccttctctcgaaaccttgaaattcagctgtccgggtccaaggaatgttggaaaatagaggtcttagatcacaagactgtgaatgcaaatggtctttctgtttctgatggagtctttgtccatcccatgaggacgtggatggtaacctgcattgcatctctagttcagaggctttctctccaaagcccaaggctctgtctttggacatctgccctggcttgctgggaacaagaaaacagctctgagtggtgcatgaatccggagctagtagccaggtttatgaggtagcaatggtccaagggaacctagaggagggaattgtttccttttcttttgctctgctgtgctagaatatgtgagctgaatcaagcccagtgcaagggaacatacctgatgagggcactagagtcttggtactgggtatacctaagagcccaggggatggacgagggataagaaatgtgaagtactgtcagcttcactaaatttggaaaatgcataccagtaatactatcatcccaaatggttgtcttttatctgggaattgccattaaggcaaagatagctaaaaaaattgagggcatactaaaaccacatagttataactaccacttatggagttggtaaatttttttggcctctttgatagacacatagagtttgatttttatgtgtagattaaattcctgttgaataattaatgaataaatgactgaaggaccccagctggttggatagtggaaatcactgttctagcctaaatttagaaagataaaaacatacttttgatttttttctcttctcatctctgatatggtgagtttgataccaggacactgttcccttctcttcccatccagagccttactgtaatctggatcgacctttggggcttcagagaaaggttgtttaatttcccaaaacttttccctcacttatttttagaacaatatttgttctgtgtagcttatagcccagcaggaaaaaaaaattccagtgttgtaaatgcttaaaagtacagaagagttttgctgtagtctatgaacccttaccactgttttcagcagaaccatttgtaaaccatcccagtttattttgggtgacagacttcagtattcagaaattttgtgttctccttggatctctcttcacaggtgtttaaccatctcagtactgtaagtgatactttatgttgaaattcattctcataactgaagatggaaaaacacagcttatatccctaagaagtaatacaaagaggttttagatcagttcctctttacttatttttcttgtttccaatatcacaacagctcttggtttacctgcaggtggggtggcatgtgcccatttgggctctgatgaataatgaggttctttgccttcacttcctcagtcggccctggaggcactgtgggagatgatgtgttatcagtgaagcagcagatgtggtggcagcattttcctccactgcagggagcatcccgtctgtacctctgtacagagcaggggagctgtctactgagaaggaaatggatggctgtgtttgcttcacatagaatttctcattagccttgggaagtggttctggcagttggggccccttggtggttgccaggatggagaggttctgctcagagtgggtgtgctcattgtcctgtcatctgcacaaagggccacagcattgagataacctaggcatgctgctgctttgcaagcccggacacctccggacaatcctttcctctgttgtcttcattcccatccatagagatgggtcacatcttgtcctcaggaacactagcacctttctttttgttggagcagaaattttataaaacaccctagcattttggaatatagttttattccgatgagcagtttagaaaaatttatggtaacataaaatttaccattttaaccatttttaggtgtgcagttcagtggcattaagtatttgcattgttgtgtaaccctcactgcaatccatctccagatattttatcttcccaaagtggaaactctgtattcattaaacactaactccccattccctttcctccttttccccaatcaccattctactttctgtctttacaaatttgactactctttttttttttttttttttttttttttgagacggagtttcgctctgtcgcccaggctggagtgctgtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctagatctcctgaccttgtgatccgcccgtctcggcctcccaaagtgctgggattacaggcgtgagccaccgcgcccggccctacctttcttaagtgtagagttcagcagtattcaatacattcgtaatgttgtacaactatcaccatcatccatcgccatactcttgaccttgtaaaaccaagactctataccaattaaattacaacttctcattttctcctcccccagccactgacaaacactattctactgtttgcctctctgatttttactaagtgcatcatttaagtggaatcatatggtatttgtccttttgtgactggcttatttcacttaccataatgtcctcaaggttcatcatgttgtagcatatgtcagaatttccttcttttgaaaggctcaataattttccattgtatgtaaataacacattttgtttattcatccatccatccatcagtggacacctggtttactttcacattttggctattataaataatgctgctgtgaaatgtcttctcaaatccctgctttcaattttttgggtatatacacagaagcagaattgctgaaacatatggtaattcttttttctttttttcttttcttttttttttttttgagatggcatctcactgtgtcgcccaggctggagtgcagtggcacgatcttggctcactgcaacctccacctcctgagttcaagtgattctcctgcctcagcctcctgaatagctgggagtacaggtgcatgccaccatgcctaagttttgtatttttagtaaaaatggggtttcaccatgttggccaggcaggtcttgaactcctgacctcaggtgatccgcctgcctcggcctcccaaaatgctggattacaggagtgagccatggtgcccggcctcatatggtagttctaggtttgctttttggaggagctatcatactgttttccatagcagctgcaccattttacattcccaccagcagtaaacaagggttccagtttttccacatcctccctcacacatgctattttctactgttttgatactagccttcctaatgcacgtggagtagtggtgagcagtttttatattgttgttgttttctatacagagttagtgtctctaattacactgtcattaacaagaagcaaaagttctcagaaaagagaggtgttcatttattcaactcttagtttaaatagcatgtaagatcctgaatctgaaaccatgaaataaggaaattacaatggataacagcttaataaaaacaatgatttaaagagtaagcttagaaataaagaattgagtaagcttcgatttaaagaataagcttagaaataaaaacaatgaaagatgtaaagaataagcttagagaatggacttacagaaaacagtcctccaaggtcatcatgagaatattgtatttttattcatattgctatcagtgtagtccagaaaggaaccttatcatactttgattagtttcagaaccttttaattgatttaatgtattcattaattgcctctaccccagcaatttccctgtctgtattcctgtccattgccccaatccccttctaatcagtacgcaccagaggctgagtcattctaaaatactacttttttttttgtttgtttcagacagggtcttgctctgtcatccaggcgggagtgcagtgggacgatcttggctcactgcagcctcaacctcatggactcaagcagtcctccacttcagcctcccaagtagctggtatcacaggcccatgccactatgcccagctaatttttgtattttttgtagagatggggttttgccatgttgcccaggctggtcttgaactcctaagctcaagcaatgctcccacctcagcctcccaaagtgctgggattacaagcatgagccactgcacttggcctgaaatgctacttttcttaggccttgttccctacttagaaagtttcaatggatgcaccatagttaactcaagatctcaacattcaatatcctccttagcctcaataaagccttatctttctcaccttcccatatgaacacttcatccactctgactgctccctgaacaggccaggcactttcctaaccctcctgtttttacatatgccatttcctctgcctcgatcttcttccaccctcatttctacctgtggaatttctgttcttccttctagggacagctcaaatcctactgcttccataatgaaactagtaatgattcctaccagggatatgcactctagaatttgaacacagagctcctctttcctgtgtaccttacacaaggtactgttacaaattttccttctgtcatattgtgtttgttacaatgtatgtattttaaaatttttctctgtttctgtgtgtcttgcctcactggcagccaacactattcttgtgtttggatactagcagggtcttcagcttacttgccagtgaaaagtgccctggcctcgagtcagaagaatcctttccactttcagctttgtagttagtacctgtgtgattgtgggtcgctgactttattcactcatttgggtctcagtttcctaatatgcaaaacgagaaggtaaaatgcttttcaaggtccgtttaaactgtatttggtcctcagaaatgacccaaacatagaaatctccttcttctggagctttttctggagcttattttctcttcctctcctcttatttagtgttgttctcaggagaacacatgtgggaaaacaactgtgaaacttttagacactctaagagaggagaaagagagctgaatgagagggaaccttcaagggaaggtgtctcttttctccaaatcttatctccatggcctttttgtgtcatttaaaaaaatattaacagttatttgcattcgctggcatcgtcttttcaaaaagcaaatatgattgcctctgcaagcctgtctttgaaatgataaagtatgattaatccacagctgtattctttagaatgagaaagttcagtcatttgtggtgctaaaatgaaaaaataaagatttgaatggttttactatttactgtgaatttatttttacaatgtagatggggcattgttttaggttctaataattagcactgttgctgaaatggatgaggtcagcacagagagtgtggagagcttggttttcaggggggtggcagcagttctaatggctgcagggcgaggcttcctgctgagatgccagtgttgggttctttctcaaattatgatttttatggtttgggcaagaaaaggatgcatttaagctcttttataagtaaaatgagcaatgctgaaacagttgtcaaatgggaataatttgatctgacttttacaatttctgcatgaagaggtattggcagctccatggcattggggcaggatgggcagggcttagctgggctaggtccattttttttttccttcagtttaacgtctccgacccctggtggattcacctactgcagaagagccaatgctgcttataaattatgtttcctcaatctatatctctagcccagacctttctttttggctctctatctgaacatctaactacttacctggtaacttatgtcctacaaacactttatgtgaaatattttaaccagtgcctcatctccactgccagtccctctgcacatttgtatcctaataatgactctaccctcactgctagtatgatcaccacagttattcccagtgacttccttggtcgacacttatttggtgccagagtagtaggcgctgagataaattcagttaacccctcaccatatggcagcattaatattttttagttacctcaaaccagatacctctcctgctccataccagattagtgaccacatcccactgattctacgtccttaacaaatctcagattcgtcccgtcttccctcacttcaacttctctgtaatagattcttactgcaactgtaacagcctctttatgcatggattctttccttctcacatccattttctatactgttgctagagtggtctttctaaaatagaatagatggtactgtgcttttacctaaagcttttcggttgacatcaggataaaactcagacccctttgaatggcatgtgagggcttttggcttttgtcccaagtgttcttgtccagttctttctcctatccagaaccttgtgctacactgatggcattctctacatatgccaggcagctttagggctctgtggatttgcacatattgttctcttttcccagaatggtctgcttctctatctacctgtttgttgtactgtcactacctgtcatttcagattgactgtccttccgtggaatggttaaataacactggatagccctataacggattgtgctatagtctttacaaatcttcttgtaggagaaaatatgatgacttagagatatgtttatattacattgtcaagtgaaaagtgttgtataatacatgtgtgattgacttttctttctttgcttttccttttcttttctctttctctctctctgtgtctccctttcctttcttccctctttctccctcccttcctccctccctccctccttcccttccttcctctcttctctcctctcctctcctctcctctcctctcctctcctctcctctcctctcctcccctcccctcccctccccttctctcccctcccctcctctcctctcctcttgtcttcccattgatctttcaataaaaataaaagcctagaactctatgtagctaaacgttaacagtgtttatctctgggtattgggattattgatctttagaatgatcttcattttgtattttctaaagtttctataatgaatgcacattactttttaacaagaagtagtaaatgctattttcaacaaaaaatactgacttgtggcaagtactatgtcttacttatctttgtctttttagaacattgccttcctcatggaagatgtattagttagggtaggctaactgcagtaaccgatgatacccttaatatataacaagtaaaatgcgatagtttatttctacctagtgaatgaacagaacacaagatgttctggtcctgactttcccctgaataaaatctgcactaactaacaccgaggcatagccaaacctcacctccagaccaaattggctgaaataggcagggttccaatttgtgacggtcatttatttttaatggcctttctattccctgaaatgtagacaaatttgccctttgctgcctcattgcagtggaagagcctcatacctgtgtgcagagctgatgatgaaaggcatctatgtgtgtatgtgtgttgtagataaatagtgtattaactatgtgtaattccttatttcaaagtagcattttatgggtgagttttgcaataaatcttcaacgtttaatgctcactatgtcttgtttcatttgatatcactgaaaatgcagagggtcaggccacattcactctgtctctccctggcatgttaggttgccttctagagctctgtgtttcacaaatcattttgatgtagagactgtggagaaatattctcaggctttatcactgctgacttaattgagtttcatgatgcgcttttttttttttcatagtaggataaattaaaaatggctgataaagctgcctgtaaaagcaaaattgttaggttaaacctgcctggtgtattaaatgtattgataagtaatttggccaccatttttaatcacttttattaactctcaagtagttttatttccagtaacttgcaaaataactgtcattatggactcagtcatatttctctttaaaatactattgaaaagtccatgaaaatgattaaagtgccaatatcatccacctacttcctgttagcaagaattgttggtgattttgtgattagctgagtatatggttgtgctctctttgtgcaacccaggaggaaatagaaccagttcatcccaggtgaatagagataatgaatgggtttgaagccgtgtaacaggagtagtcttttgtgcatctgtatcatgtatgttattgttatgctgtctttaaaacattttattaaatattgagaagacaagatacttgtgaattatgtgtaaagtgtaaagaatcatgatacgtgtaatgtgcctttcggtgtcatctttgccatcggctgttcggctttgtaaggatcttgagttcaaggtcactaaagaacagcttaacacattgtcttgctcacaggtcaataagggatatatctcttcattaaaatggatgagaagtttgtcattactttactgcttcttggctagatgtgtggcttatgcctgtaatcacagtgctttgggaggttgaagcaggagaatcgcctgaggccaggagtctgagaccagcttgggaaacatagtgaggccctgtctgtgcagaaacaaaaaattaaatttgccaggcttggtggtgtgcaccttcagtcctagctactctggaagctgagtcaggaggatcccttgagcccaggaatttgaggttacagagagctatgattgcatcactgcactctagcctgggtaacagaataagacctgtctttaaaaataaaaaataaaaaagaattccctgtattttttccaatccatttgcatagcctccaaatcccattcctttcccctcagatttcggcattcccaccctatgggagaaattattatagttgccattcttaggatgtttcccagataaattacaggaatcataagattgctaaacaaatgtaggtggctaatagaaaaagagaagcagtaagcctacttttttcatttacttattcagcaaatgtttatcaggcatctattatttgataggctttgtactgatttctggcttgacaatgatgaagaaattagacatgcccctttctgagctaagaagataggcaaaagggttacacaaataattatataattacagttgtgctaagcctcatgagggaaaagtacaaggtcccagccaggtgaacatataacagaagaatctatcttagtctgaaagatacaagaaggtctttttgagaaagaagcatttctgttagggtagggaggaggggaaaggaggagaggaaagatttgcatttccaaccttggggcagagaaggtgaggaatagcagaaaggacagtcagcacaaaggaagcaaaaatggggtctgagaagtaaggaacaatcagacgattctagacttccaggattccagattttatcttaaaaacaggggaacccaatgaagggtttttaagaagaggagttatatgcttgtcatttcaaaaacatcacaactgctggttataaggagaatggactaaaagggaataagagtgcatgcagggagctgaggtggggccccagttgagactggatgtgtgcctggactagagtgggagctacagaagtgaagagaagtgaaagatttgagatgatttttggaagcttcttttagccttggctgtgatggggcaatgcctacaaagggcggtggggaggatggcccccagtgttctggcttgagcaaattgtatgcacagtaggtgatgcgatggcaaatactgcaggagaagaagcccttgtttagtgtattgtcgacatatccacatggaaataccaaggaagcatgtgcttgtttggagctggaggtcagaagagaattccaggttgtcttttgagtgtggtggttttggacaaggacatgacatttctagctccatgaagtagataagattgcttagggaaggtgggagagtgtaaggaaaagtgaagagaaaaggaagcataaggaacagccacctttaaaggtgaggcagagtgatgggaaagaagcaattagagcagtgaaaggaagacccaaaaaggattcaggagggaagagtggctgctgcatctgtgtccctcgaacatcctgatggaagaggaggaagacagagcccaaaccaggactttttgagtggtgactattgccacacattttaaatgtaagagtgcacattgcatttaggaccagtgaggacttaggacagagttctggccaatgccagaggtggagcccagaccaggagcagactgaagtactatttgccaacttccggttaagattgggttttagtaatatttttatttatctggacataagtagcacaaagctgttttaaatactctgaggctttctttggtggtgggggataagactgggaagaataactaatttgagagacccaatggatagtttgtataaagatatgattttcaaaaaatcatcaaaattgattaagtgttactaacgtgttgctgaaggtcactcgtttatgtgtttttctcctgagctaagaattctttcctatgtaccacctaagccctttcagtgacaaattattgttcaaatttttcttggcacactgacttgagaattaactaccattcatagctggtacccaggtcctatgagaatacaatgccttgtcacataaatacttgtgaagtgacatctatcaatctaatttagaaaaatatttgagtcaaaaggtccttgaaccatgtattaggttgacacaggagctccctttatctgaagctgtgactgagcattttaatgaatggcagtcaaggaattcaaagttattattctgatagtaattgcgtgcatttttcctgcccatctatatgcagccttctcattgtctaggaagctgctgatttgatgcattcatagctattatttgcatagggaatttgaaccaccatgggaagaatgattttgaatttcctgttttcatttatttactttgggtgcaataacagtgttttcatggaaggattttttatattgggtttttcctaattttaatacagtgtaaataagctaagtgttatatttctgaaaaccacacgttacaaatttttaaaaatgggggaaagatgaaaatgaaataaaaagatgggaagacaagttctgaaacctctgaccttacctgcgggctcctccctctagttgaccatggagaaccatagatgacttactgggccagatattctgatcttggacagaccaatggtttgtaaaatgggttgcatattatagtgtgcaaattcctggactagacttccagagatgatagttcatgtggcccagggtttgtcctgagaatctgcatttttgaaaagctctccaggtgatttttagtgtgcacttaagtctgggagctcttggaattgtttttttcaactaataaagttgaagacaccctgcacaagattagaagatggataagaaaagagaattagaatttactgagtttctattatggctgaacatgtttacatatcttacgtcatttattctttaacaccatcttgcaaggtatatcattttgttccaattttaacctgagattcaaaaaggtttacagaactttaaaggtcatgcagctgctgggaggcagaacctttatttgcctccaggtcatctgatctgctgtgtagaaccacgacaaggctgggaacaagaaggtctggatagaattctagtcacaccatcacttgggtgaggtccttttgccctctctgccaacgtgggtacctgttgctaaaggtagactttcctgtttatcatcaaagagtgcctataggtagatgagtggggaggactgcatacattttgagagtagtaaaatcagatccacttggacaaaactgtcttcaatattctacaatgaacatgccatgttattgtgaccagaattgacattgtatctctaccctacgctgacaagttgattgtctgagcgaggaaacagcactcatcatacatttatatttctccaggaaggaaaagagacatggtagagtctagtggggaaaaatctggcttcagattggacttagtacttgaattaagggtcaggcattggcttctacctctcactctgtactcatgaccttgggaactccatgtttctaaactttatttttagttttctctttgtaaaatgagaatgatgtgtctctctcagatcagtgagtaccagctgagatcatgtctgtcgagcacttaggcagtggtaagtgccttctttctttctttgttttgagacagagtcttgctctgttgcccaggctggagtgcagtggtgcaatcatggctcactacaaactctacctccctggatcaagcgattctcgtgcctcagcctcccgggtagctgggattatagacatgcaccgccatgcctggctaatttttgtattttttgtagagacagggtttcactgtgttggccaggctggtctcgaattcctaacctcaagtaatctgcctgccttggtctcccaaagtgctgagatgacaggtatgagccgccacacctggccacagtaagtaccttcttaatgttaatcagcagagggaagggagagtgactctctgcagcaggattcagtggagctagagatccagactagcaatagcagcagaatgaagatgaatcttgactacttgattgctgcatttttcattattttaggaacccagcggttctcctaaaatgcatgccaaaggtcctttgacagggtgctgctccagctgtggtttgtcggtctgcagtgttgtaccaccctggtgctcattaggactgcaaattcccaggtcaccttcagatgtaccactctccagatgtttctcatgctcactgcagtatgagaagcactactttaacaggcaacctccttccaggtgaatcatgtctggagaagttgcttggtcagagagatatttgtccaggctcagccatgctggctctgcagcgagggttccttcactagaacaccatgcatttgtggtggcagcataggtagaaggcactgagcggaaacaagaggagcgagatggagaaagaaaaaaaacaactttcccggaaaagttaaaatgatagcatgacctttctgaatggactttgggacatggcaccaagaatgagcaataatgaaataccaaggaaggagactccttaggagagcatctgggaaccatgcaaccatgcgacaagaggtgatgcagggaagctggtgagagggtgaactgaggctcccccaggggcgaggggggatacctcctttctgaacctcatgctgaacccgaccctcaggagcaacagattggggtaggagcttttggagaggggaattgaaatggccttgttggcagaatgactctgaagggaactttccagcacacccaggaaaaaaacaaaacaaactccccaatctgccagactccactttcttaactggagggcagggtggttgctcaaatattttgggctcagggctttggaaagatttcttgtcttgctgcatgctctgtggaaccaggctgagagcaggatttttgcatttagaatatcttagcagaactgggcaagatgaaaaccaatctttttgtagctaccaaaaagtggacatacttcagctttctgtcttctccctgctgacttgggtgtatttggtgtgcttgctctgtgctaggcccttcctgtctcttatctcactaaatcttgacaatatccccagagattggcatcattatactcattttacagatgaaactgtctcagaggggttacggaatttgcccaagacacacagctgagtggtgaagctggaattcagaaccaagttcggcttattagaaagtattcttatatactacatgtagaaatgaaacgcaacgtatgtgacagccattataatgtaaataataaaagtaacaggattttctccctgccctccgtaattcagtatacttgttgattatttgctgcttctggcaagctatgattgattgctgttctgtgggatatggagaagtttgaggaatttatgatacagctggggagaaaagacatattgatgcttgaccaggattaagccaccatatctcacaggtgtttagacaaaggagaaggcacctctgctaaggcacatcagggaaatctctagggaagatactgatttgacatagtactttctgggtatatagaattgtttcattttgtttgccgagtatgttaaaactgtttgcagggtgtgttaagatgatttgcagaagaatgttgcatatattattcgttttgatttggaaaaacaattaaaacaaggagagtcttattatttgccctatctttgggtaacttctgtactaacaaaactccggctcaccagccactagagttaaaattctcactaaagaaattgactaaatggaagagaatttatttctgatttcctttttaatgtaaacatatgtattgacacttttccttggaagaagtgtagtttctcttttagtagaaggaaatagaattatactctggcttaaattctattattataaacatacttctgtttttatcttgagataaggctttcctatatactgttgggagtctatagtgatatagtcattttctatattatttggccatcatttattcttttaaattcatttataattgtttttgcatgttttattgctaacatttaatagtgaccacccattaaagctattgcagtacctaagtatttataaatttttctgacatgttattgcttctggattataaactgggaaataattaagattcttgttcttgttgtaatgctgttatggtgatgatttagtatttccccaaacagtttatataatatggtctttttccacattggtatgtttctttatttgctggacagggtattttaatggttacatctaaatggaataaactcatagagctgttgatttgagaaaaccttctataatgccatattaatctatttagctcccagacctttcttagcagatcaaaggaatttcctggccactcccagaggtctgaccgccttttatctgttttaatgaaggtaattaaaattcctcagcttatgaaggtctggtcctggtcctaagtgaactagtccccagcagaatctgaaagaggactataagcaagccatttatttctaaatttttaaccttatatttctgtagatcctgattaaggtagttcctgcagtgtgagggcaaacttaggttgccagtattttagggaaatatgagttcttctttcataaactctgatgattattttgattcctgtatcattcatttgaaatgaacctgcaacactttgtgggtacataggaatgaagcaaatgcactctaaataattaaccagttgtgtcattgatttctactgataggtttatagcaaatgactttacacaaagttattaattaaatgctgtgttctgatgttgtctaaaaaatgtcatctggatgtccacagtttaaatcctcaacaaaatgttaaaagtcacagaaaaagtctttgacatagcatgacttaggatctccatattcatagttatttgttgagtaaatgtgctttgagcacttatcatgagccaaacactgggctaggtgttacagagacagtgctgaacaaagacctcgccaatatggtgcatattcccattttacaatctgtcagctcagccagtctcttaaaggccatcttttcctcaaacgagtttctgaaatgaaaatgaaaagagtcatttaaggatttaatctgagttctagtctataccctgaccacacaatgggcctcagggagaagaaggaacaagacaataccttactagagcaaaatgacttcccattatagaacatggtctggcactttcaagataaatgaagctgtaaagttaagttgtgcaattagtggacagagacaggtaatttgtgggcatggaggaggtttccaaatattcacagcaccaagtgatcaaaagctgtaagtagcatttgtgcacttttcttcatacattttacattaagaaaaaaaccatataggttgatattaagcagctaactgaaaatgaactgtccttaaaaagtaagtaaataaaaaacagcacttttcctgatgaatgaaggactgtgaaaaagctgttatgggcttagcctatgtagttcccagcattattttaaaaagatgaagaaaagaatgttgaagtctttgcattttcaatgcctaccaggtgcacctgccactcctgcatttctgggtttcacttttgtccattgctagctctcatttggtctgcaaatgtctgagtatctttcatgttccaggaactgtttgtgtgagatagatgcaatggtaaataagtcaaggtcgtcaccttttaggacctcatcctaccaacttaataggtgctagcagagactcgttgtgtgtctattataggataagtgagtgaaagtcctccttaggtaggtttcatcatctgcacttggatggaatgaatttatgaatgttcttagagacacttatagatctgagaaataaaaaacacataccaagaacttattgttgggatgaagaagagtaaataggggaattttttgggttcctcttctcctcatcctccttacaactcctcctgctgataagatatttagtcctatgattgacccagactgtcattttttggggcccttctctccatgcctgtggccaagccctgcctgggcttgtattaccagggatgactccacatgcttcttgcctgctattcacagaaggccctcttgtcttccgtgctcactgcgtggatggaacacccaggcaatgggacaccaggggtctgtatgtgctgcctgtgccagtgttctgagaagctccctgagactggtttggtgtaagggctgtcagtctgctccacaaacccagaataaattggattggaaaagtaggaaacctcatttagcttttgtgcctaaactttgtatacccaagcactgtttaccaaaaaagttctggatttggaagtagttaagtattcaaaacatattcaactatttatgaaaatgatgcttattattctatgtttatttctctcagcagggaagcccaaagagtaggggagatgaggagtaggttgtggaatcaacacccttcctcctgcctccaaaccacctgcactgcccaaggaggggccattcttttttgggagcccattatgtacttagctgtggatgagggtgtatgtgtgtcttatattcctgcttacattatggatagaagattgaaggtcacacttctgtgggtgtcctactgcacccaaaagggtattttacataaagcatgaataattgcaccttttcccccaaatgtcatatactttgatataacattttgtagagttaggagtcaggctttcatggggaagagggctgggttatgtccagttaatgggcaggcatgtagattatactttgcttttgataggtgagggactctttcaagtactattctacttcctctgtggttagtttttttctcccattcttctattctttttcatctttggggctgtacatcaggggaggagggtgctgcagtttgctattataatgggaaaaaatgagagagaaagcaaagagagtaggtaactgtactcagctttatttattttatccacacctcaagctcttattaggaaagggtgggttcttcttttctttttttttaggggggcggttttcttatagaataattactggtattctctggttgataagctaagagaaaagagagtcagggaaaagtactttactgtttttctatgttgtgttcattggttgtttttgtctgtctagtaccaaactttccaccaaccacataccctcttcacggttcccctccttccttctccaacagggaaaggcaggcaccagtggattcctctgtagtcaagacttaacataaccaggaattcttcctaaaggaagaagctatcaattagctaattatacttttcccatcccaaatttgttggacttctttgaagacaggatgatttaaatgagtggagaaggcttacctgggtggagggaagcagggagtaccaacgcatagagtgggaggaaggttggaaatatgagtgagagaaggtgttgatagtggaaggttgcagagaagttgtctgagaacttattcagagccagatggaggaattgttctactgattctcaagaagaattgagagttcttgcagcaattgttattatgtggttttgcaacttctctataatctcttataagagtagtttctcttagaagcctagtcagtatacctgaaactttaattccacttaccattataatgagaaaataaattgtcttattagattctgtgcaccaaggggcaagacctgaaaggaggatggaacggtgtgtagcggggatggcagttgatctgcaaaatcaggcatggaaattctgaactgttattggagagggaaaaggaacaagctacagttaactggtaaaactcagtcatattataggttaatcaaggccatagactgtgtgcttggtactatggaagataaagtgatatggaaagcatgatcagtgaccagtgggcttgtaatctaaatgtggagacacccagaccttagaaaataactatcccataggattatttttggcaaaatgtcaaatgaacaggtcatagataaatgatttaagaattcagaggaggtagagctcacttctacctggaagggtaagaataagcttttgttgacggggagaggctggaggtggaccttcaagggtgggtgggacagagatttgtcagcagacatgaatatggggtgctgggttgggcactttacacatcacagtgtggatacaacaccctggaaaaaccctatcactcccattttagagtaaggaagcataggctcagaaagtataaatatatgacccaaacttccttaaccattgacaggacaagttatagctgaatttcagacttaagccctctggctccaaacccatcctattccagtaccagtttgcctttatgaccttctatacacagaaatgctctgagaacaagaaagcaagtattttgcacccaggatggaaaccacatcattttggtaagggtacaggtcatttgggaaaaaatgagtgatgagtttaaacagtggtctaggtttggaaaaatagtctagaactattgaaggaatttcaggcagagaatgaggtcagccaaactatgttttagagagaagagctgcaaaaggaatgattttgtagatatggcaaatgtttatttaacttgtagcattttaaactagattacttttagcttaggtctgcatctgaaaatcagtgatttacgtagtcaacctttatgaaagttttctttgattagtcaatctagaaaagcataggctttattttttttaatttttatttctcatgcttgtgttttgttgcattgcgtttatcctggatgccttaatgaaatggtgcgatatgacccagggctctcatctgtttaactttgctaatttgctccattttcaaatgagtttccttggctgcaggagcagcagcagagcatgaactctgctgaaaggaatttcagttacaccgctactgccacctctggggcccccggataattttcttatcgtctttttgccgtttgggaacaaagccacgttgttcacgactgaaatacagtttttaaatgtgcctcctaccgtgtttttatagaaagagagcctcttctcctggaaaataaaacaccattgattgaaccaacagcccttcgaaagggctttaattattgcattaattacaaacttcaggacaaaccagggcccagtagtagggagccattgagcagatttctgagcggctttaaagaaaatgttaaaagccttttagatctaagaggctgaaattgagagaaggaggtgggcatgtgggagacactaccttcttcaagttataagctttgcattaaaaaatatcctcttccctctctgatttgtgtttcctgggaaagctccaatgactcattgctccaaggcctcaacattttctaccctgacattgatgagagagaggaaagtggggaggtggtctaaatgtcatagagtagaacttctccaaaaaaataggtcactggggaaaaaagaaatactcttggaataatcctttaacatgatcatcttcaaaatgctcactttttattctgaagaaaaagaagaaagaaaaaaggcaagtaatttctttctctggcaaaacattcactgaggtgttttcattcaattactttgatggttggctgttgggaaaattatcaaaagtgaatatgggtttgggaactactagaagattctcaaagttgctttttatgatctctttcccagggaaaataaatcattaaatactgaggtggctagatgaaattgaatgctacatctcatggtttattcagaatgggctcttccatctgacatccttttgacaggttctaccacatgtggcatttctggcaggtatgagggtaggtttcacattctaaaatgaaactggcagtcacacgtttccctggtttaaaacattttagcacttattatgtgccaaatagtgctctaagctgtcaacatgttaactcatttaatccttacaacaattttgtgaggcaggaactattataactatttagcagataaggaaactgagccttagcaaggtcacagtggagagcaggctgtccggctccagtgtctacttaattctaaccgaatactctgggagacaaagacgttcgtctcaattcatatcaccttgaatattcattgccagttgatgattgttattcttaattccctgcaaagactcaaccagtcaaacaattaatcaaatactgatttaccaattttctgggcacaagattaggcattaggagatgagtaaagatcccattcctacattaggagttcccaatctaatacagaagatggataagcaaatagggtgccagaggttggagtttgtggctcagatttgggagggttcatttatcaattcattattttaacaaagtgtagtgctagtatatgccaagcactgtgagtgattcccccatcccctgctcctcagtggttgcagtctgatcaggggagatggataagcaagcagcatgttgcattttggtgtgataattgctgtaattatgggcaagtacatgcaggggtactacatttgtaaatgtaccaagggaggtaatggcctgttcaggaaactgcactgtgacttagcatggctggagggtccagtgaaagcacagagaaggtaagaggtgaggctgcagaaggccccagaaagggttgggagtcaaggacattgtctgccatttcagagactctggactccattaggacattgagaatgttacttggtacccagcagtaagagttccttttcatccaagctctcatgtcactttaattgaaaagtagaaaagcagaaagaaagagtatcctaaaattaagcaatgataagacactgcaaatttccgaagattggaaattgccacttttatgtagagcttatggctattttctcgctggagacagactgaaaaagtgaggtccatatctgtgtctatttctgggatattggctcagcaataaagatgttagaaaaaataaaatgatggggttaaaaatcaacacatgtcacattaatttctgattcttctattggaagaggatcacatttcaaggtcaaaagatggagcagtgagatttgtagagagaaaatttatgggtggatatttgaaaattttctataagtaagcattgagaacattacgaagctaccagattttgtaattttcaaaattacaaggaatgtagtggaattggataatggatggtggaacctcttattcttggatcattggtttagatagatcccagattggcaataatggaaatttatttcaattttatgtctgctcagtggctgaaatgaagtgggttaataggtgcagttttgctttttgtggaggaatgccctagtcacagaaacccctaaagcaaactggcctttatatccccccagatgtttttccaggatgggtagtaacagagagggatatctctttgtcttggatttcctttatattgtgtgtcaaaatggacagtgtacaaagagtactattcaaaagtgtgagactaatctcagtttattgtgaaattcaatggatcacaaagtactgtgtccccaaaccaaaacagatgattggaaaattgaagactagatatttggaattgcttgaatgctggaggatggtgtgggcaggggtggaggcctgggtttctggcatgtaaccctaaagtcctttttatctttagtcttgtattctacctgagtagtaggtattgtgaaaagtatgttttctatgagtttacagatacagttcctggcataatgtacagcatatagcaggaatcctgtaatcattgaaggagttaataaatgatatcatcagcatagaacagtttggctgctttatgtataactcaggctactacagattgggtatctcttatgggaaattcttaggaccagaagtgttttggattttggatttttgtggaatatttgcttatacataatgagatatagaggggacgtgatctgagtctaaacatgaagttcatttatgtttcatatacaacttatacgcatagcctgaaggtaattttacataatatttttctttttctgttttttgagacaaggtctcgctctgtcaccccaggctggagtgtagtggtgcggtcatggctcactgcagacttgaccttctgggcacaagcgatcctcccacctcagcctccctagtagatgggatgggtctacaggcctgcagcaccatgccaatgcccagctaatttttgtattctttttttttttgaaatggagtctttcccttttgcccaggctggagcacaatggagcaatcttggctcactgcaacctccacctcccaggttcaagcgattctcctgcctcagcctcccaagcagctgggattacaggcatgtgccaccatgcccggctaatttttgtatttttttgtagagatggggttttgccatgttgcccaggctggtctcgaactcctgggctcaagcaacccttccaccttggtctcccaaagttctgggattacagacatgagacactgcactcagccttatacaatatttttaataattttgtgcatgaaataaggtttgtgtacattgaaccatcagaaaaaaaaggattactgtctcagtctcccatgtggacagtctgtggttttttggcatcaccgtcactcctgactctgaatttatatgctactgataagctttgtgttcttacacttattcacgcataagtacttaacagtaaaaaatatgacatgcatatctggtgtgcacagaaaagatatatcacagatgaaggaggctgggagggccttttttcccttggggacattgaataaagcatgtgtgtgcacctgtgttttgattgcgactggtcacatgaggattgggtgtggaattttccacttgtggtgtcatgttggtgctcagaattttcagatggtggagtatctcaggtttcagattttcagatgagggatgctcaacccataaacccatatagagataaggagtcttggtacaacatgtgctttatagaaaggaaaattttaggtctcagttgtagacttagagaaattcaggactaagacatttctgtgcatttagttccttttcatttttattttcctaccaccttcccccagccagctttcatctttttctctcaaagctctgcaaatcattgaaaaaattttccatgttattttttaggacaaaaacttactaaaagtcatccatccagcactgagttcttactcacgggggtcaccactgctgtgttctagttcctttgcttttgttttgttcactggcccctcctctccaatccctgagctcctacactgcaggccttcctttttattttacgttttacactctcccaacctgactttatcctttcaatcaaagatcattaataaatcttgtattgccattacctcataaaataagtattccatttaatcacattatctatgtatctgaaatcaggaagataccgaaaggtggtaaacaggaaatgggaatattggcagaaatgtactactgtacagctgagaattgtcattctctttgtttttttttttgtcgaaaataaaccttctgacagagatgatcagagaaagggatcataagtggtttcatatgaatatcaagattggctcccattacattttggcactaggtgttaagtttttatctctctgatcctgataggtggtggtacttggtgggcagtgtcatgaaaaccaagagaaccagggccttatatttcttttattttaacttgggtttttattttttttctttgcaacttttatattatgttcaagggggtgcatatgcaggtttgttacttgggtaaattgcatgttgcaagggtttggtttacaaataatttcatcacccaggtaatcaacataataaccgataggtactttttcagttctcacccttctctcgccctcaatccacaaataggtcccagtgtctattgttcccatctttatatccaagtgtactgaatatttagctcccacttataagtgagaacatgtggtatttggttttctgttcctgtgttaattcacctaggattgtggcctccagctccatctgtgttgcttcaaaggccatgatctcattttttttaataactgtaaggaactcaaatcaacaaacaaaacataacttgagttttgagaggtgttttctaccagatacttccctttgaactttgtatgtgacttcctagagagaaagtgtgttgaggaagttcactattctattctgcagtgagagaagacgacaggctaccagggaaaaatagaagatcaaaacctttttatttatttatttttgtttgtttttaaagtatctgtttccatatgtatactattgtgcaaccaattagttggggatagcggatttttatgtagctggcaaacttatcaggcagaagagaattatcatgtatatttcagcagcaatttatgaacaggtttgtttctaaaggatgcacatgtattttgggtttcactcttagtttcactctgattaatttgcttaataaatcttccttcttaaagacagaggagaggcaaacacaagtcaagcttttgttttagccagtagatttataattaatgacttttgttgatttaagaagctttctgaacaattcttggaatgcagtggtggcatcatgaaaggagcaaagggaacattttcgtgggacataagtaagatttaggagagggaggagttcacagactatcattaattttacaggaggagaaaatcaatgtcagtaggaaaaaagatacgtacaaaagatgacttctggatttgaggaaccattctcaatagcagaaaatagagctgttctcaagacatatgttaggtctctcacaatctatcagcaataaaaaaagatagcaatatagagatgaaagaggaagagagaagaaggattaagatcagctgtcaaaatgttgcatacaaaatgtattgaatgtcactattataagaggtcttactgtaattaaatttcctgtctatttggatttgctcatcttaaagctttttcagttgtcagtgtgagaaatgtttcctatctaggtgttttttcctccctgttaagtatcagcacagtgtaattcaccatagttgggtagggtggtactgagaatgtttcctacctcagcaagcctaatgtatatgattgctttttgtgaagagttttttttccatttctaccattaacaaggtgttagacacttagcttggtagtagacaaaccattagatcaatattcccagaactagagagttctgatattggcaggcattatttattccattaaaaaatgtcatattcatttaacaaagatggaatgcagatagtttcaccgaagccatgagtgtgataaaggctatagacaaaagattcctgtgaagtgaccatctggaccagtttaggtgttaggatttctgaggttcttgaacaagagctgttcctgctagctcatgttttagaacccatgtacaggaaaattgaggttgtgtttaaaaaatatggcatgtagcacaggaaatatgtgttttcagagcaaatgataacttaatattggctgaataatttgtaagaatactgatttttttgtcatataacctatatattttcttaaggaagataggtttataaggaaaaattgcaataattaaactgagcataccaacaaggaaaaataatttaactattatgatgactcatttagttggcatcctcgagtaatgaggtgctctagattaattttcctgagagcagaaatatatccctttaaatgattaagcattttatcttcatcaatctttgaataatatatttccaagatatattttacattcctttgtgtcataaatatgctttacaatgtatagggctagaatcatagtttttttttttttttaagagtttaaagaaacactgggagatcttggaaaataatattaccacattggagtgcaacattcttgtctctgatatatgaggttttgattagatgatcatcaaaattccttctctttctaacattctctaaataaaaagtcgtttatgttttaaattgtagtatatataagaatcagctagggtctttgttaaacttgcagatactcagacatcatccctagaggttctgatttagtagatttggtgggagagaagagaatccgtatcataaataatcacctagagccattctgatgacctcatttagagaaacactgattctctttccactcttgtataacagacaccattactcttgctggccacgtggtccttgaaaagatcattgctgctttaccctcagtggcattgagttgtgaggggctgatgagactaataactatgctttgatagtctttgctttctgaacctttcctcagtattacctgtcactttgttaatggtagctactgaggaaaaccagatcatcaagcttattaaatcagatgccctgtacttgtacatttaataagtcattgagttctaatcttaggtctgggtagaggcaggggaaggactgtctattttctcctgtagtctaaagtgcatgcatttagcagtgatgattatattccctgtttggaggtcttttactcttttgtcatgttctggttgttttaagaaagtcaagttttctagaagcatgacgtcagaataagtggcacattactctataaatatcttaattttcatggtgagattcatagtcaggatggtctatgactttcaaatattaaaaatttaaatataccataaaattctcctttaaagtatactgttcaatgatttttagtaaaatctgtaaatttagagttgtatgaagccaacaccataatctaattttagaacatttccatcatcccccaaaagaaatcaggtaactgttcccactcctaaatccagtcaatcaataatttacttcttatctctatagatttaccttttctagacatttcatatgaatgagatcatacagtatatgcccttctgtgtctggtgtctttcagttagtgtaaagttattgaggttcattcatgttttagcatgaatcagattgccaaataatattctgttgtatgcagttactacattttatttatccatttaccagttaatggacatttggattgtttccactttttgactattatggctagtgtgttcaaatctttgtgcagacatacattttaattctacttgagtagttttacctaggagtagaacttctgggtcatatggtaaatctgtttcaaggtagcagtttcacatgttacagttctacccgcaacgtataagggtttcactttctctacatccttgccaatacttattattattattggatacaagtcccttattggatatatgattttcaaatactttcacctagtcagtgagttacctttttactttctgaatggtgtcctgtgaaacacagtatattttattttgatggatccccgtttatctttcatctatgcatctgggtactttttttttttttaaagaggaatctttaacccaatactcatgccttcttgaggcttactcaagatcttgtaagctttgtttagtatgaagtccctagtgatacctagcatatagcacctagtttaaacagattacagatgaatattcaaagtttttgacctgaatttactgtagtcaacagttaccctaaagccttaaagattaccaaagccatgatagactcagccaccatcatgcaatggctatgtccttcgtagcatcctttcttcacattcatctttgctttcagcatatgaaggggggaatgtaggtctttaatttaccttgtactgtggggtagcactatcctttccttactccattttcaggcccttggatgcaggacccttctctgaggtcccacagaggtggaggcccagcctgagcttttacaggttttagagtaagatgtcaggacagcagttcacactcagccacatcccattaaaagaaataaaaaagtggctgggcacagtggctcatgcctgtaatcccagcactttgggaggccgaggtggatggatcacttgaggtcaggagttcaagaccagcctggcccacatggtgaaaccccatctctattaaaaatacaaaattagctgggcgtggtggtggacacgtgtaatcccagctactcgggaggctgaggcaggagaatcacttgaacctggaggtggaggttgcagtgagctgagattgtgccattgcactccagcatgggtgacaaaagcaaaactccatctcaaaagaaaaaagttgctgctgtagagttttgtcataagaacatactggctgcagtgtccataggcaaagatgaagctttactgagggctgatatactcaatacttctgcccagtccacttgagtctgtctttgcctaaatactaaattgtttgaattctcctttagttttagattttccctactgaattgacatggagaaatgttatcaagtccaatttgcaagaatgctggatttccacttggagcttttgttttcttgggcctagaaggcatctcttgtttataaaaaaacactgggcatcattgtacatgagaaacttaaagacagtgcatatctggtagcagttgatatacagtgtattattcctaaatgtagtaataacaccttacaattggaaaaaaaatgagttatagatgaccaaatgcttccataaatatgatcacatttggtcctcccatctctgtgaagaattattattcctcttttacaggtgaagaaaatgacttgtcagaagtcatttatttccaaatataggacttctgataccaaattttgtgccttttctgtagtgccatgcttcctctccaaagcaatagttgaatttctgcaattttaagaaaatcatatatgtcgtgttatattagacccgtggctaatctataagcagtcatttatattttaaatgaaatccattaatgatatattcactttctagggcttatttccatctcaagcttccatttctgattgtaatgtgtaatgttgcatttcctgtgaaaggaattccaggctttggattgtaggtgggtaagattagtggtgggtcttagagagtcgggagatcctgagcatgggaacagccttttgcccgtaagtttatactgtgctcaaagatagtctgaatagttttaggctgcctggggtcccaaggagactttatgcctcccgatagtaaattttgggtccccaaagacccaacaatatttccatgcgatcatagcttgaccccaatttatggatgcttccttcctttcttctttaatccttgacaactttcttccccaagatttcctcgtgtcagggacccagaggccattcttactatgatctctttcttttccatttcattccctatggcttagaccatttaggtggggcagtggttctcacagtgtgaaccactcatcagcagcaacagcttgttaaaaatgcaaactcaggacccaccccatatctgcttaatcagaaaggcctgggaggttgaaccctccagtccgtgtttgatataccttccaggggttctggtgcatgcgcacatgtgagatccacttgtgcagtggttaagagcaaggattctggaatcagcagccaggtttcaaattttagctctgccatttggcagctaccacttcctgccatccatttacctatatgatctttggggaaattactttcctctctagactttaatttcctaatctgtaaacttgtggaataaaatatgaattacctacatgggaagttgtagaaatgaaataaggtaatgcatacaaagtgtctcacgtgatgtctggcactctgcaagcatccctgaatgggagctttcatggttgatatggactctgaccctagtcattgcctgcacagtgcttgatgaccttcccttgcttgtctctagcagcttggcatttaactactcaattctaaacctgaatgtttgccatgtgctccattttcagtagtatgaaaatgagactagttttcacactaaaatccctgtatgaaatatatttgaaattttgcttaggtcttgcttttgttttctgccacccagccagtttcctatctgggataggacatcgcttttgataataattcaatatttaaagcctttgtttaagaatgtgtcttaagacatgtttaaaagtctaaataaacattatatcctgtctcaatttatctaccacttaaaaaatttcaagtgttttttatctatctatgtctatctattgatatagaatctatgtagggatatagaatctatggattctaaatagattctatatagatatggataggtttgatatccctatctgtggcttttctcctataacatttttctaacttaattgtcagaatctgttctctagtagaaaatccaccgatgtcagaggatcacttgagtctgggaatttgaggctgcagtgagctgagatcatgccattgcactccagcctgagtgacagagagaccctgtctcaaaaagttcatcaacatacagtatacttccaacaaatccacagtaaaatttaatgtattggatcattttcagactcgcggcagccagtccttgggctatttctatgagtctttatgtaactttgactacaaattcgaagttgtcctcaaatccactagaactcctggttggataccattcaatcctggtgatttattttacttttatttgtcagttaggcctagtacatcccttgcatttatttttcctgaatttagcatatttagactgcttacttcagaagagaatttgttttcaaatattctctttggtaaaatatacctcagaagttggatttattccctttcctatcttttattcatctatgtactgcacttatttttataagttcatctgattcttcagctggctttctgccaatgataaattaaaaaaaaaaaactacacataaacgaaaccaacaaccagaaaacccttttaacttgttatttatttatttatttattagcaacctttaaactctttgaattatgtcatgaatttcctctgacttacaagctcacagggcagcattttctaatagtgttttgttttagcctgaaataaaaggttccatggtcaagttagcataggaaaggctacatacttattctatgcccctttatcccctagcctctgaaacagtttagtaattcataattcacagtagcatttgaaacactctgagatgtcctgcatagacaaaccagattaacttggtttgacctaatttcccccccaacataaacacttattaacaatctgtgaactagtgttccttagaccacctttgtgtccattgaatttagaagttttcttattctcatttggcatagcttaatgtttttagatgtgctttagttttttcctctttacctatttgtttctatttggtttcttcacttacgctttttccatatatatttttttgacaagtctgtgtgacccaatttaaacttttctgatgacatttactttgaattaaaaaagattttttgttcattacttatcttcctatattctatattgaaatgattattttaatatttaatgttatagcatattaatttattaaagtattaaatatttatattattaaatttattttaagttaaataatcaaataatattgatattaaatatttaaatatttatatttaaataatatttaattttaactttatattgatataaaattatttaaatattgataaggatattactttggtagtactggtggttataatgtttttaactgtctttcttattcactgaatatattcactgactatttcatggtaggtttttaagctttattgcttttattagggaataaatgactaaagttatatattaacatttacatttgtaagttaatcttcaccataggtaatttttgctttttaaaatttgttgcagtactctatatttccttgcgatacttactctctttgcacatgcttcttcttttgcatgaaggctcttgttccagatatccacatgtctgtttcctttcctccctcagttctcttttcacctgttgtcttctcaatgaggctcatttttgctgctacatttgtttttagatgtatttgtaaacatctagacaccctaccccaacactacctattccccttcttgacttcatttttattttttgtgttgatcaatatgtaagatactatgtatttcttgtattcattgtatttatttgttctttcttaatagaaagtaaacttcccaaaaacaaggattttcatctgttttgtcactgctttgtctctgctgtctagaacagtgggacatattttaggtgctcagtaaattttcaattggatgaataaatacaataatctcagaagatgtaaaaactgcattccataaaattcaaaatccattcatggtacaaaatcagtgaactatgattaaaaggtaaaaacattgagcaaacatgatatttattggtgaaacattgaaagtattcttttttaagattacaaacaagttaatacatctttaatcagcaagataacatttctatgcagcattattatataggaaattctagctaaaacaatacaataagaaaaagaagaattattagtattgaagaggaagaaacaatgctatccctagtcttagaggatattttgtctgcatagtaaccatcccaaaaaaatacagattaagtattagaatgaataaaagaggttatcaaatatgccacaaacaaaatcaatgtacaaaatcaattgcatttctgtactttgctacaaatatttggaaaaggtaacaaaataccatttatagtagtatacaaaatataaagtacctaggaaaaactcttagaaaaacaggaaaagacctgtgtggagaaaatgataaaacaaagatccttgagaaaacctaaatgagtggtaaaataaatcatagttctgagtagaaaaataccaatctacaaaagatatgattctcctaaaattgtttatttttattttttatttttttattattatactttaagttttagggtacatgtgcacaatgtgcaggttagttacatatgtatacatgtgccatgctggtgcgctgcacccactaactcgtcatctagcattaggtatatctcccaatgctatccctctcccctccccccaccccacaacagtccccagagtgtgatgttccccttcctgtgtccatgtgttctcattgttcaattcccacctatgagtgagattatgcagtgtttggttttctgttcttgcgatagtttactgagaatgatgacttccaatttcatccatgtccctacaaaggacatgaactcatcatttttatggctgcatagtattccatggtgtatatgtgccacattttcttaatccagtctatcattgttggacatttgggttggttccaagtctttgctattgtgaatagtgccacaacaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactactttacagtcccaccaacagtgtaaaagtgttcctatttctccacatcctaaaattgttttagaaattttatggaataaaaatataaaaattcctgcacctttttactcaccatggaccatgcaagctcattcctgcccgcacacagaacagcgaacagggagttttgccctcccagatattaaaactgtgtactactataaaaatagcaattaacacagtatagtattgagtagaaaaagaaaataatagatgatttcagacagactagaggacccaggaagagacccacacatttatgtaaaattctttataaagacttgactcttaagacaggtaaatgcaataaatgctacatgacaattggttaactaagtggagaaaaaaaatggatactacctcacatcacacataaaaaaatcaattctggttgcaagacaaatctaggaaattgttagaaaaatatatataagaagatagctttatgacctcagataatgaagaattttaaaaacaagatacaaaaagcatgaaccatatgggaaaagatttagttttactacattactaccctatttatccttgttaaaatgttcagtagctccaaatacaatggaaaaaagactgggaccagtgtctcacaaaagagaaaacacaaatggctaaaactaatatgagaagatacacaacctcattagcaatcaaagaagcttacatttaaatgacaatgacatatcatgttccagccagtatattggagaagctaaaatgagtaatagcaagagctgcagaggtatgggagaaacagaacattgttagaaaggaagtaggttgttagaactaatttgcaaagtactttgactttatcttgacaagtttaagataccttaaatcccatcaattccattccaatgtatagactctggagagcttttatatttatatatgtttatatttattatatattatatataattatatgcattatatatattcacacacacacacaggagatgaccataatattcacagaatacttgcttggaaaattttagtagactacttttagagcaggtttaggatcacagcaatatagagcagaaaatagagttcccatatagccttcatccccacaaaagggcaaccttttcactatcgacatcccaaaacacaattgtgtatttgctgcaattaatgaacctatgctgctgcatcagtattacccaaagtccatagtttacattagggtctgctcttagtgctgtgcattctgtgagttttgacaaacctttaatgacatgtatctgtcattgtagattcctatagaagagtttcacttccctaaagagcctatgtgctctgcctattcatccctctcttcccactaaaacctggcaaccactaatcttttcaatgacttcatagttttgccttttccagaatgtcatatagtggcaatcatacagtaggtaaacttgtcatattggcttctttcgcttagtaatatgcaattaaggttcccaccagcactgaattcccatcagcaatgaatgagagtttctgttgctccacatcctcgccattatgtggtgttgtcaccgtttggattttcaccattccaatctgtagaatcattgttattaattggggggagagacaaccaacaaataaaggaaataactcagaggttcgttagcagaatgattttaaaaattgagggctgtgcatataataaagtgacataaaactatatacacacattgtactaaagtcgatttgctgttttgatattgtactgtaattaggtaagatgcaagcactggggaaactgggtggagggcacatgaagcttctccatactatttctccaactttccgtgtgcctataattttttttcaaaccaaaatgttaaaaaaaattcgagtgttgttttctcatagataaaatactgtccagctatggaagcaatgaaccacagataaaaaccacagggctacatctcacaaacgttatatggaataaaaaaatgcagtcgaataaaaacagatgcagtataatgctcaaaacatacaagctaaatgatatattactttgggatacaactgtgataaaactcaagaaaaacaagtgaatgataagaaacagaattggtgataatgcttatctcaggggaacccccacgcttttgtgagttttacatgcaggagactatcaggtcctcatagtgaatatcggagaataattcagggggattggaaaaggaacattttgaaatataccagagcattctgtgtattcttattaactaacccgccctcgggagaaacgatcttcctagagtctaacctgctgaggttttattagagcctaacatacctgggctaagagaaaggaaggaggtttcatacaaaatgaagcgttctcttaccacatgatccagaaatcacactccttagtatttctccaaatgagttgaaatgtccacacaaaacatgcacatggatgtttatagcagttttatttatgattgtcaaaacttggatgcaaccaagatgttcattagtaggtgcatagagaaaaaaattgtggtacacctagacaatggaatactattcagtgctatcagtgctaagaagaaatgagccatcacgtcatgaaaagacacaaaagaatcttaagtgcatatcattaagcgaaagaagccaatctgcaaaggttacctaccgtatgattgcgattatgtgatattctggaaaaggcaaaactatggagtcgttaaatagattagtggtttagtggggagggaagcgtgagtaggcagagcatgtaggatcttcagggcggtgaaactattttttatgattctgaaatgatggatgcatgtcattatacatttgtcaacacctataaaatgtacagccctgagagtgaatcctaatatgagctatggactttgggtgataataatgcttcagtgtaggttcatttattgcaacaaaggtaccactgtgctgggggatgaccatcgtgagggaagctgtgcatgtgggtggggcaggggctatatgggaactctcactactttctgttctatgttgctgtgaacctgaaactgctctaaagtataaagtttaaaaatttaaaaaactctgatctttagtttagcattttacaatctattttattgaaaggaacaaataaaagttaggattaagagaattaaacatttttcatagagcatataaatatagagcatgtaagagaagacttgattctcatttcagttctgatctgtctttaactttggcttagctggttttagctgatggtttttgaaggatggtccccagaccagcagcatcaataccaactggatatttgttagaaatgtaaattctcagacctcaccccagacctattgaatcagaaactctgggagagggactgctatggcttgaatgtttgtgttccctacaaaattcatgttgaagcttgatctccaatgtaacagtattaagaggtggggcatttaggaggcaatgattaggtagtgaggtctctgacctcatgaatgggactagcaccttatgaaaaggctggaaggaactacgttggcctctttggcccatcaatctcttctgccatgtgaaaacatagcatcaaggtgccatcttggaaacagcactcgtcagacattaattctgctgggaccttgatcttggacctcgcagcttccagaactgcgagaaatacatttctgttgttattattacaaagtgtcaggtattttgttatgcagaaggaacagactaatacagggactcagcagtttattttagcacaaggcttccaggtgattctgatgtgcatagacttttgagaaccactattactttcaaccttttcatctataaaattataaataacactagatcactttttttcaacgtgtgatgtatatattactgatcatgtgcaggacagttttaggtggcataaataagagcattttaagttttaccagctctgtatttattttaaagtttgttagaaaaatataaatagcataccaaatctacaagttcactggtgtttttgcctcatatatggctaagttaaaaaaaaaagaaaacaaaaagagaatcaatggaatcaatttgaacttgatataaatagaaatagccaaaatagtaaggtgataggagaatatcacaaggtgcatggagtaatttctcaaattttgaggccttagtaaccctgcactggattaatctcctacgtattttcattctaaaactatgagatttcatatgctcgtttttcttacagatttgcctccttaattttctttttaaaattcaagctcacatattaaaaatgtagtcgatgctgtttgagcttggaggggaaatggcctattagtgtgcttttgtactgggggatacttatctgagattcatatttaaccatggttaatggacatggggataattcacatgcaaatcatcaaagttaaatatattaagaagaaatctgtcctgaaaacaccatttaattttagaagcattttcttcttttcactacttgaagtatttatagtggaataggcagatgtttttataaaaaggaaatgaaacgacatttggggacagtaataaacatattttggttaattagggatttatactttgtaaaagttttcacattataaatagctaaaacatagctggcctttttaagtggcagtttaaacagctttattgagatataatttacattgtcatagagtccatctacataaagtgtacaatttagtggttttgtgtattcacagagctatgcaaccatgatcatgagcaattttaggacatgttcattatcccaaaaagaaaccccatgttcattatcagttactccccatcccccatgtagttccaaccctaggcaactacttacgtactttttatttctatggtttttctcattctggagattacatagaaatggaatcatatatgaagtggccttttgtgactggcttctttgacttagcatgttttcaagattcatccatgttgtagtgtgtgtgtgtcagtattttattcttgaataatattccatggtattgatatatcatgttggtctatccattcttcagttaatgaacatttgggttgcttttactttttgctatataaataatggtactatgaacattcatatacaagtttttgtgtgaacatatgtttttatttctcttaggtgtatacctaggagtggaattgctgggtaacaatacttaatacttgatggtaactatatttaataattcaagaaattggatataaagcactcttattcaaagtaaaattgcgattttatttaaaactaactacatttctgttttaataaggtatgaattttgtttgtcaaggattttacataaaatctgtctccaaaatggtgtttggcaaaaatcattattaaaatacatgtttttgaacacagcagcttacagactgctattctacatcacagtttatcatcatttatcaaaattgtcatgtcctctgtgacatgtttctttttctgaatattttattgtcacatgtgtcattaagcatttagaaaaaaaatggcctggaatcttcttcctgaactgatgaaattcatgatttttgtgtatagacatttacaaataaattatatgttgttaagaaactaatggtagttttttttcttttaaaattctcacttcaacatcaataaaaaatgtttctgaaatggaaacataccattttgatgtctaactgcatctgacacttttaagttttgctgtcctattattaatattttaaagttttaggaagggctactttttatataatgagattttatattccataaattattatttgactttgttttactttgtcacaatgcttcttcaaagcttttttgccaaattggctacctttagattcctttttaggaaaggtcttcaggatggtcttttttgttgtttttgtttttgtttttgttttttgagacggagtttctctctgtggcccaggctgaagtgtagtggtgcaatttctgctcactgcaacctccgcttccttggttcaacgatttctctgtctcagccttctgagtagctgggattataggcgcccaccactacacctggctatttttttgtatttttagtagagatagggcttcaccatgttggccagactggtctctaactcctgacctcaaaggatctgccagcctcggcctcccaaagtgctgggattacaggtgtgagcctctgtgcccggcccaggatgctcccttttaatagctacttaggaaattaggttttggtaccttgttgttagaagagaatattcctgaaaaaaggaaacaactaaatgcatcgactatctggggtagtagaaagagaagcgacagcacagagaaaagatgccccttagggaggagaaagaaacaaatatcaattagacttgaacgaactaggtttctttattgatgaagaaagttaagccacactttaactttccttgccacactaaaagcaaacaaacaaaccccaaagaatagtcaagcagctgagacattcagtagccttgtaggcaaaacaagacatattcttattgttggagtatagttgtgtaaggcctgtagcccctttcttttgactaatttattccttttggaatgaaaatatttactcaatgcctgtacctgatctgcagactgatcagctgaaatcatccttgattttatttctgatagggagaacctgtcctgcacttaccatggtagagtagtgggtgtttataatgaagatgtaaaactttatagtttggatcatgtgggaggtagactctgatacagggcttagagtgtttattagggagtgctgttggaaacaacacaatggaagagaaaagaatcaggatcagacagatggaagagtcaaggtgtttctttggccaacaacatggaagctttagaactgaaatggttaatcagtttagtgccatgtttggccaaagtggccaggtctttgtaaaccacctccattagtaaatggatgcggctgtcacctcccacccaccagagcatgaccttaggtcaggcgttctctgcagctcagactgttccagcccctaaaggggcttacagctgggattgtcctctgacaacactccctacatctgggccaagaagttcttccttgaggattggtcttgatggtgtttctcctatgtctgctgcactacatcagtcattgtccccttaaccttcacaaaagcttttgaaaatatttatattttttgtttataaaagtggtacaattagacaccaatctgtattcaacagggcaatggttaaatccatgactttggagactatgtgtgctcttgtttgaatgtttctatctcccccagatttatatgttgaaacctgatctccaaagtgatggtattaagaggtaggacctttggaagatgattattagatcatgagggtaaggctctcatgattggattagtgcccttatataaaagggccaacggagcttgtttgtcccttccaggacatgcgaaacgcagtgagaaggaaccatctgtgaggaagtgggccctcactcaatctgctggtaccttgatcttggacctctcagtctccagagccatgagaattgaatttctgctgtttgtaagctacccgtcaacgatattgtcctagatccgcccaaatggacaaagacaatttagaattaacataatgaggaaatctgtgtgtactgatgagaaaatatgtccatcatgtcatagactaaaaaaaccagtttgccgactatacacatatatacactatgattatatttttatttacaaaagctatacaagtatgtaaaatacacaggtacgtgtagattcactaaagcttttaccttctgaagactgggttgggggtaaacaagaagagagaatgatagttttcaatttttgttttgtatgctcagtttatatgttcatttttctgttgctgatgtaacaaattatcacacatttggcttaaagcaacacaaattgtttatctcacagttctggaggtcaaaagtcaaaagtctgtcttactgggctaaaatcaaggtgtcaggagggctgtcttcccttctggaggttcaggggacaatctgttttcctgccttttccagattctagaggctgccttcattccttgacttgtgacttcttcctccatcttaaaagccagcagactcacatcttcaaatctctatctaactctctcttccgcctccatcttccacttcaagaatccttgtaatttcatggggcccacccagataatccaggataatttccttgttttaaggtcacatgattaacaatctaaattccatatgcacctttcttaccacttgccatgtaacataacacattcataggttctagggctttggatgtgaccatgtttggtggggtgttattctgagtactacactaggtaagtgaaactacagctttctcacaacctatgtgctagctgttcatgcttcctgttcagataataccaggtaaatgagagaagagaaacatccgtgggtaaacaattataatttagtacattattattctttaatttctatagtatttataataaagttcaataagaatttatctatgaggaagtggcttttctaaacaagtgtaaagcccccttgtttggaaaaatgtcagagagactgcatactttttcttcttgcccgcttttcccatgctggcctctgttgcagctcttctgaaatgtaatcattgctttatttctttatttatctctttcctaattttcttggaggttctttaagatgggggctatatactttaacttaccaacctattcaatgaatattcattaagtacctattatggctaactatttttctgaacatttgggatatataaattgataaaaaccaataaaaatttcacttctttaatggaggaaagacatcctatatagagggtgatgaatggaaataaactagaacaggtcaagaagaatcacaagtgccaggtttagggattgtttgtaactttaaataggttattagaataggccccattaggatggtgatatttgagtaaaggctttgatgtggtttgggtgtgtccccatccaaatctcatcttgaattgtagttcccataatccccacgtgtcgtgggagggaccctgtgggaggtaattgaatcatgggggttttacctccatgcttttctcttgataatgagtgagttcttgagatctgatagttttctaaggggcttttcctccttttactccacacttctccttcctgctgccatgtgaataatgatgtgtttgcttccccttccaccataattgtaagtttcctgaagcctccctagccatgctgaactgtgagtcatttataaatttcctctataaattacccagtcttgggtatttcttcatagcagcatgagaatggactaatacaggcttggaggagtttaaggagttagtcatggggtgtcagagtacgcttcattaggaagatgctatttgagtaaagactttgaggacttcaaggagttagtcatgtgggcaactacacaactgcattggaggcagagggaacatttactctaaagtccttaaggcaggaaaattccaagactgatcaagtaacagcaggagagcgtgtgcagacgccttgggccaagatgttgaatacatactgaagggagccaagggtgggaggtgatccgagagagtgatttttctggtgtggatcagggtggtagcaatgaacgcgatgtaaactcatcagattgtggatgcgctatacttggaagatagggcaagtaaggtttgtggacaggttggttgtgggatatgacagaaagaggttccaaggatgatttcaaggcttatagtttctctaattggaaggaggaagttgccatcaactgaaataaggaaggctatgatgagcaggtttggtagagaagatcaagagtttgtgttgggcctgttataaagttgagattctataagacttccaagggtagatggtgagaagacaatctccagatatatgaatctggagtttaggaaagaggtctggaatatgtgtaaatatgggagccatcagcacataatagatgctgagtgaacgaagagactgcctgagattatcaaatgaggcatagatggcttgagaatgagactgaggttggagtcctgggtcactctagcagagattagggtaagaagggaaaccaaccaaagagagtaagctggagccctctgcaccctttttgacagcagtaggtagtagatgtttatttagtggataaatgcccaaagaggaggtaaagtagcaaatgacaaaggggaattttatctgtctatgtagaataaattaaaaggtgaaaaacagaatcaactgtatttatctcatcagtgaatgggtaggaagcaagtgatggaaattaacataaaagtagatctgaggccgggcgcggtggctcacgcctgtaatcccagcactttgggaggctgaggcgggcggatctcgaggtcaggagttcgagaccacggtgaaaccccgtctctactaaaaatacaaaaaattagctgggcgcagtggcgggcaactgtagtcccagctactcgggaggctgaggcgggagaacggcatgaacccgggaggcggagcttgcagtgagccgagattgtgccactgcactccagcctgggtgacagagtgagactctgtctcaaaaaaaaaaaaaaaaaaaaaaaaaaagatctgttcctttttactctataaatatatttgtttataaaaataaccgttaattttaataagttaaagtgtttttttcttatgcaattacttctttttaatcttcatgatgcttaatgtgctggtgtggctaattctttgaaaaagtatgtaaaaaaatcccttctctacagagatgaatctagttcttcagattggttattcctatactttttatttgtttttgtttttgtttcagagacagggtcttgctctgttgccctggctggggtgtaatcacagctcactgcagtctcgacctcctgggctcaaggaatcctcctgcctcagtctcctgaatagctgggactacaggggcacactaccacactcagctaatttatttattttttgaagagatgaggtcttgctatgttgcccaggctggtctcgaacttctgggctcaagcaatccccctgcttaggcatcccaaattgttgggattacaggtgtgagccacccatgcttgaccatgtgaatatgaatatactggagaatagcaacactaagtagttgaaactcattttagaaattaccccatgaacatatctaaattcttcataatgagtcatagaagaatttctaaagtcaacttggtaaaatgtactgatgattttcattgaaaaagcatgattttgctttcatatatttaataatttgtagaactttcaactttcactgtggtcttaactggtattaaaggtgatttggaaattgtattgagcatgtatcttgctatagtataaaagaagtagacattttccttaagaactttatattctaggttaaacagttaaaacacttatataaatatacatataaacagtttagttgagaaaatataagatgatgtaattgcaggtctgtttgactcccacctatctcttttgagagaagaatttataaaagaatagactgaaaaagtggcaataactataaacttgcattttgacaggaagaagaatagaaaaggaagcagaatcagctgccttgatatggatacaagttctacaaataggacagccactatgcttgaatagtagtagttcacatacttcacgaagtaaattaaatgtgattatattgggcctgacctgttggtgagaagtggatgtctcagcgtggggaggtgtgtaagcttgctcaggaccaaaaagagccctaggtagtgaaatctttgtgaggggttggaacctgaataggaaatagcatttaacaatgctcatcttaaaaccgaaaacctcagtttttttatgagtatgttaagaatctctgaagatacaacctgggttggacgattacccaagatctgttacatatttaacatcagggaagttatgcaaagcttattattgtttcttgtgtttattttgggtgctgaccttcagaaaggccttagctaatctccaggtcaaagcctatagtgaccacccttgctgccgctgcatgccacacctccctctctgtgctatcttgctgcatttagggactttgttgtcatagttcctctcttactgcaaagggattccaaagctcttgaaaaataggaagtagctcatccttttctatgggctgaggggagcagtccttgatttacgataagaaaattctataatctttggacctttgatagaggtgacaaatacagagatctttcttggaatataatttgtccaaaactattttgagaaagcacacaaggcattaacatttacatttccaattaaagcatagggaaactgtttacaacaaggggacagaagttgatgctgttgtttattgtgttatatgctggttatagaccctcgttttacagttatttctctaaaatgcagtaaaaaaaaaaaagaatgcctagcaacatagcaacctctatgaaatgaggcatatgctgtttctaagactcacaatatgtttttctgaactgtttgctcataaacatgtttattgtaggtgctgcttgggcagggacggctttcctgtagaaatcctctcttgaatacactaggttctggttcctcttgtggaagaatgaagctctttttgactgccttggaaaatttgatactttcaggtatttatgacataatcaatggctgatatgtgtcttcaggatttatgactgtcctgtcataaattgccgtagtttcagagtgcatacaacatcactgtctttttattactgttattattggagacaggctgtcactgtgttgcccaggctggagggcagtggcgaggtcttggcttattgtaacctcctccttgccagctcaagccatcctcccaccttagactctcgagtaggtgggactataggagtgtgccaccatgccttgctaattttttaaaaaacatttttgtagaaatgaggttttaccatgttgcccaggctggtctcgaactcctgagctcaagggacccacccacctcagcctcctaaagtactgggattacaggtgtaaaccattgtgcccagcccactctgtcttttgaggtggtgggaaggtgagatgtagtgacacagatattctgtgtaccatagtgataccttatttatgaatcatcttgctctctctcttgaagtctctctatgctagaaacatcatctgatgtggtattcgacacgggttcaccttctggttttgtcactaaatgctttatgactttgatctcagcccttctctgtgtctagagaattgttaaattactaaattaaaatgaatttttgagagtcttttgatgtcacaaaatgtaatagctgctgagtgcccaagtatatatcaatttttctttagtgaagaagatgcagaagtggtaaaggagaggctgcttttggagagggcagagtgagaggagatggaagtttggaaatatgtcttataaggaaggccaatgaggaggcaatcattctgtaacatgtacttgtgatctagtaaagcttgtgttttgtatagaaggctatgtaggcttttatgactgggaacgtgtgaaaataatgacctagagccaatggggcatagggacatttgcggcatctaacccaggtctttttcattcccaggctagggggctacaattctcttctgaaagttacttggcatgatcatcttgctgttcttaaagcaaaatagcccaaattttgttgaagaaatgttttagagaaatgattgcctcatatttctaacaccactcttggttatttgtttactaaatagctttttattgggggaaaagtgtatggaaatttaagttggggaaattacttgggagaacttcttaatgtattagtctgttcttgcactgctataaagaattacttgaaactgagtaatttacgaagcaaagaggtttaattgactcacagttctgcaggctgtacaggaagcatggttggggagccctcaggaaacttacaagcatggcagaaggatgaagaggaagcaagcaccttcttcacattggcagagcaggaggaagagagtaaaaggagaagtgctacacacttttatttatttatttttttgaggcagagtctcactctgtcacccaggctggagtgcagtggtgcgattttggctcgctgcaccctctgcctctcaggttcaagtgattcttatgcctcagcctcccgagtaggtgggattagaggcatgcaccaccacgctaggctactgtttatatttttagtaaatacggggttttgccctgttggcgaggctgatctcaaactcctggccttaagtgatctgcctgcagtggcctcccaaagtgctgggattgcaagcgtgagccaccatgctcggcctacacacttttaaatcttttaaataaccagatctcatgagaactcactcactatcacaagaacaacaagggggaaatccacttccatgacccaatcacttcccaccagatccctgtcccaacattggggattacaattcaacatgagatttgggtagggacacagagccaaaccatattactgaggaacaacttaatgtagatagtttctgtgtatgtgtgagaataaagttttcttataaaccattctattttttaagttcaactattttatcttccttaaagataggggggttgaaagttgattttatagtttgagctcttgttatttttcaaccattagccaataaatataagtggcaattatttaagaagaataacataataatcaaatatgagaaatataagaagcttagaattgtggagttggaagggacaagtcacctcaatttatagtcagcatttatctaattgttctgccccccttaactgtaaaatggcaaaagtaatacttgatccataaatttcttttaaggattaaaagataatggattaaaagataatgtatacattcaaaaatattttttaagtgttttgtttgtttggtttgttttttcaagacaaagtcttactctgtcgcccaggctggagtgcagtggtgctatcttggctcactgcaacctccgcctcactggttcaagcattctcctccctcagcctcccaagtagctgggattacaggcatgtgccatcatgtccagctaatttttgcatttttaatagagacagggtttcaccatgttggccaggctggtctcgaactcctgacgtcaagtgatctgcctgccttggtctcccaaagtgctgggattacaggcgtgagccacagcacttggtctattgagtgtttagtatgtgccaaggcatatgctggttcagaggatatatctgtgtactagaaagaagatcctggctttactaactaggagggaaaaaaactttacccggtgatgacaaaggtgataagtacttccacagtgctcactgggacaaagtgtcagaccttacacagtacctgatactaggggagaaagagggatggacctgatgtgtcttgggtgtaaagtatacccattatataatcctaacagcaattctgtaaacctggtcttattttccttccttttacagatgagcaaacttgtgttcttgtaggtctgtgtcaagtaatgtttgttaaataagttaatgtgtaaatggaaacctgagcagttgtgcaacatgcccaaattcttcagcaagttagtgacagctgggaccagagctgtttctgacttcagcccaggggtcctttcattattctacactgcctctcagagtgtgcataggtgtgtgtgtgtatgcatgggagataggaaagttgcagtcttatatatgctacacttatcaatataaaaattatttcacaaaacacaaataatagtgaagtcagggctcctagtttaatccattttaattcctatcactagttacaggtatatttaattatccagatacgttgactttgtgctgtggatttagtgtactaaataacaggatccaaatctgtgaagttttctttttctggaaaactactggctctgaagcaatttaagccagaattcaaggccattcatccaaaatttaaggtgttctgaaatagaaggtgtatatatcactttacttaatgtgtgggttgtgtgggagacttttctttgcaaattgaatcattggagaccaatgatcctataactgcatttgaaatccttcagctggcaaacctttggtagttttaatttctttctcaaagaaaacatctgttataggtgtctgtagtctagttgtgtgtgggctaccatttcaattagtaaagctataatgacagtcttgggattttgtagaaaccctagtaatagatagaagtgaacatttctaatcctttattatgatcccgttatcaatttcaagtcagtttcttccctatgccatctatccaccaactcccagctgtcttgaaagaacatatataatatttttctaactttagggaatttcttttaagtttgagggcctctttctttttgctaggaagggaagccgggtcaggaaagcagaggagttagttttggagggccctccttttgtgcatcatttagttgcagacctaagcaatgtctttaatcccaaggaaatgatacaacactcctggagtcttccacggttttcagaaggtgagtattcactaacagtacctaactctgtcccttctgtaatttatgtggactctaaacattgctgtaaagtactgctggagaaatacaagacttgtacatttttcttttcttttcttctttccttccttccttccttctctttctctctttctttcttttttttttttgatggagtttcactctttgttgcccaggctggagtacagtggcacttaaaagtcaacctgaatcgcatttttctccagtctgcaatagtttgcccaaataattacagttttaagtcttttaaatggttactagtccttccagcacagaaaggtgatgcagccccaaataatgtgtatgtcggtactgtcactacagtgctttgggtcgaccaatctcatcctgacttctgatctggagtctactgtcatagaaaggtataatatgcttataatttttctcccccaatatttctttgcttctctgtggcagtatttctcccccaaaacacttagagatgtttgattttatccttgcagctgttataaggcagacaagctcgagctgacacacacagtttctctcatgacaaggaccaattgtgatttatgaccatttacaggatgctagtgatgtggggaagggtgtgtttttagctagcaaggctatgtcctttcacttggaaataaacaacatgttaaaaatatgtagcagggttaaaaagaggaagcttcactgtaattttcgtttagtgaagagcccttaggctaactttctataatgttcagctaatgtgtttatatcttcaaatcatcttaacaaatatttattgactgcctgcttcttgcaaggtgttatgctggctgaaatgaaagttttcatgaaaattctaatgtatagaattaggaagttagaaagcggggttattagcatgggtctttgtctgctttagttgaatagaacctgttatgaagcaatacattttcctccaaaaatttggcttctttagcaagcagcatatcaactaaagatgaaagaaagaagtggaaacatttattcacttgtaatgttaatataaatctttgttttcatcagaaattcctgaaaagctagattataatatgttacagtacaaccttgggtttggcttttagcaccaaggttaaacaaagatttatgaacacaaaagatgctgtgaaagctcagattcctgctaaaccttgaatgtcctatagtcctctaaatggtcctaaatgtggaaaaatcagtcttctcattggttaggacccactgacttccgtcattgtaattactgtgatataacctgtagggtatgagtgattaaataatttaatatcactgggagagttacttattatgtgttttatttgtatatttgcaagcagttcttcatttctcatgacagttcttgcattcatcatttactaaaatggggttctgagttaataacatttttttcctcattataaaaattctcagaacaagtcaagatctaattagacatcttcaatttattaaatcagacctctttacagagcccttttagaagcccaggtaacacttgttgttttaaatcactggcccaacatagtcacatgaatataccttgatgcaaagaagacggtgaagatgtaattttttagcctttgcatattaaaaaaaatcagaattctgatagtaagaaaaacatattgtttagttgcccaagttgtgtctttttctccacctctgatttcttcccaatactttgatgaagtactctgatgaagtactcccaatactctggcgattttctttttcttacccactataaagtgtggtgtttgcacttcatgcctgagtctttctttctgagaagaggctcctgcaagtctttggcagctttcaactacattaattttacaggtccatccttgaagcaaaactttaaaaaggtattttatgcttttttccttcctttttttaaaaaaaaaatttttcaccttttaattgtcagttctaattatctgtgcaaactgattcaggcagaaacatacaattctgagagaaaaagggaccctgggactgacaacctaggtttactgagtgggagaggcagaggtgcttcccaaataaaaactgtggctgttaccagaagaagggaacagggatgctggaaaaagaaaggacagacatccagttctggaaggtttatttggcttttattcataaaaatacgaaaacctttccttggttttctgctcttaatcttcctttaaatacatcaactagacatagtcgatataggtggttcttgtaagataaaacctccttggccccatgcaggtactctcctgatatttatacacagaattgcccatgtctcttaaaaaagagaacatctgatttgcctttaagaaaaatgtgcaggatggggtgggaatgagggtgggtgagggctttacatttcatgcagttgcagactttttggaggcagcttttactctctgggtcatattttaattcctgatcctgaagtggaggggaatcctgatgttagtgtctgggtggtattcttgatagacttttagttgaataagtaaggaaggatgcttacatgaacaaaccttattcagtgtcccagtttctgagcagcccaaggcaccaaagcctaacctaggatgaggatggtttgtgtggagctggtgaaactacagctcccgatctcatccaagattgttgttttccatttgctgctgaacagctgtttgtttggctttccagcggcatgaatatgcccacataatcacaaactcctagatattgaggcatcttaatgagaacatagcctgattttggaaggaatggaatgaaggaggccaagtgaattgcatcagggtgcctggtagaaaaactggcattagaacctcgattctatgctcactgtccgtgctctgctccagtacatgaaatttgtcagagaaaatgagatgaagcaccatggtttcctatgccctccctgtttgttcctggtacttaaccaacctaaaatctactcatggatctgtcaggttttagatttagtaacaggctcattgactatggaaataattgggtgggggctgaggtctttatggtagattcaagtaactagagcaagagtagatgggttattgtggtagaatgagggacatttgctagtttaaatcacatttctgcagtttgtggttggacttggagcttctttttctctgtagcttagtagcagatgcgcttttcgctgctggagcaaaactacctacagtagtgtgaatcagcaagtagggagtattattagtcatgtgaattcagatacttcctattgccaaaggcttgatatattcatatcttacattttatcttctctgtgacgattcattacatgtagtgagagcatatacttagtcttctgtgtggctcaactgggggcacatttggtctagtccaagtaattatatgtaacgtaaaattacatacagcacagtcatcaaagaagctgtccttccttcccctatcactaagatctagggtgactctggagtgccactgtgtgaacatttctcactcttgtgagcatgtttctaaatcccaaatcaatctgacaaaggattttctgtgaatttcttgttaatttcttgacataaaagctcttatgaacatacatattccgaacttaattctttgtttgagtcaaaatcatttttattcaagagggaacaattatattaatctagatttgcctggtaaatccataacatacagacctgaagttcaagcagaacccgaggtaatgtgagccctgggtaaggtatagtaaggatggagaggtaggtaaagaaaggcgagaatgattcatttattgagaaagatgagcaaggtggtcaaatagatttgcttctcaacaaagcgtgtagtttaagcacttagttttggtttcttttgaagctgccttccctttttcccatctctctattccaacataacagaaaaagaaggaaaaaaaatcaatacaaaacaaccatttacttatttcccagagtaatgcttctcaaactttagcaatgtgcatgcaaatcacctggcaatcttgtaaagtgcagattctgattcagtagtggtcaggcagtgattctcaaagagtgttccttggagcagccttgttggaacaactgtgagcttattagaactgtaaatttatgagccccacctaacctattgagttacaattttattagatgggcccaaaaagtgttttaggaagcttaccaggtgattcttattcacctgaaagtttgagaatcactgacatagaggagattctctggagtttttctcaggactctggtattttctactgtcactgggcttacagtatacagttgatctttagcagtggaaacagttggacagagatctttatttaggctcctgaatggctgtcggcatcttgaaagttgactggcttcattaaagtctctatttcttggtcctttgacatctattatgataaccctgatactttctaaagcagacatgccacttcatggaatcacgcacctcatggaattccatgcacttcatggattcatgcacgttagcacagctagacacctttatgtggcaattgggtaatacttactttaaaagatagaataaaggaaaaactacctaaaatttcccataacatttttttttttttgcagacttttcaggggtatggatactatatgggctttatatcttcatatcagcttagtcctagttaattgttattttcaatcatattaatggccattggtcattgctagccagtatctatgactggctggttctaatggctacaagcatgcttagcagtgccctcatgaatgttgctattattgttgaaggaggaaaacattttaataattggaattggattttctcagtattcagtattgcaaaaggtggatgtaacttcttatgatgtctcaacagctattactttattttttaatttatttttaaaaatcttattgtcacaccccatgattctgcaacagctataattttaatttctgaaagttttgatgatttcctccaaggctatagctggagaaatgtacattgtctattattagtaacatttctcaaattgtttacaaggcctgcagtatagatgggctgagactgtgtttatgctttttcattgagaaattttggtcttgcagaaggaatccatttgttctgtgaatctctataaagcaaagagaagagttcaaaatttataagggagcccaacaagtgttccaaaaaaggctatttaggcacaacatttaggtgcttatctagtatgttgtttctatcaatacatagcttaaatataaatagatctaagaaccttagttaagacgaaagggtatagcataccatgctataaaatctgtcatacagaatacacataaagtgtctgctgtaattttgtaatctttccaaaagcaatatactgtgtctacagccctcatttacaacttatagaaatttactcattttatgcagaaaattggaaaggagcagatgtttattcctaagctagaattttgaaggccaacaattaaaataaacatgtctctgccaaaacttgaactaaattgaaaaatttagcatataaattaaagctcacttaaaactaaatttatcaaggaaatacatttgttttgcattgctggtttcaattattctgaaaggacttttatttttatggaacactgaagatttttaaaagtttcaaacaatttattggacaattgcaccatttaaaatgagttacaaatgtcttgcttaaatgtatgagctattagcacatagttgatgaccttatagagagacattaaagcaaccatatcctcaagtttatgtctatattcccaggggagtacaagaaactggtctgtagacctgaaatagataaagctgtgggcagcattctcttctattcatttgttcctttggtcaggaatctgaattttgagacatattcaataaattatgcatactcaaatatttgtgctcttagcttattgccacagaggaaaagagattatttcctactttttagtatctctctgcttttgtctgatttgtacaatgttgcctaattaatttttcttaaacactttgccctccacacattttgcctaaaaccttcattggctcttgtaagatgtgctagcattctagggtctcagtttactgttgctaccctacttaaatgaatctccaatgcttcctaattgttacttcttggcttcaaccaatccaatgagtttcctttctctgacacatatcagatttatgcaaagtagtttcttggcttaagttgccctatatttctacaaaggtctagtcagatggtcagatgtgactatctctacatatgggtctgaaatctagtttaggaattctatgctgtgaatgttttagcttaaaactctaaaatttaactagttttttgaattctctctattatattacatgcttctggaataaatataaacacaatgaaatcctttcttgaaaatttaggaagatgttatacacaatataaataagttgtaagatagtgatttctactagacagttaaggtattaaggactatttgtccttgtattaaatggacccaggctatgcctttctagtgtttttgtatactctgattttttagtggctttccattaaatcctgaaagctcactactaagactcatgacattttttggggggttagaaaaattactatgattcagggctgggcgcggtggctcatgcctgtaatcccagcactttgggaggctgaggcaggcggatcatgaggtcaggagatcgagaccatcctggctaacacggtgaaaacccgtctctactaaaaatacaaaaaattagccaggcgtggtggcgggcgcctgtagtcccagctactcgggaggctgaggcaggagaatggcgtgaacctgggaggtggagcttgcagtgagccgagatagtgccactgcactccagcctgggcgacagagtgagactccgtctaaaaaaaaaaaaaaaaaaagaaattacttactatgattctctctctcaaataaaattctggtgacttttctttaactcaccaaaagtagatacatacatatttctaattcattgtttgaagaaaagccttaagatattttgaaataaaattctacacacattacacagaacttgtagctacatgaggagagcaaggtttttttgttttgttttgttttgtttttgagacggagtctctgtctgttgccaggctggagtgcagtggcgcgatctcggctgactgcaacctctgccccgccgggttcaagcgattctcctgcctcagccttccgagtagctggaagtacagtcgtgcgccaccacacgcagctagttttttatttttatttttatttttagtagagttggggtttcaccatgttggccaggatggtctccatctcctgaccttgtgatccacctgctttggcctcccaaagtgctgggattacaggcgtgagccaccgcgccccagcctgtttttgtttttattttgtaaaacggccttctccacgctgaaactctctctcttttgctctttcatctgtcatctcctccccactcccacaccccacactcctttacccaatcttgccactgcaggacaagagataggatgaaagttggaaaataataatttatggagaaagcctgtgttccttgctttatgaaagtaaattgtagataattaatgttgtgacaagatgattctattttgatgaataaaatcattgaaaagctatcaagccccactgtttctctgctgagagaactttttttcctctctgttctgcattcctattcttggctttcttcccaattagtctctgctaaagagtgataattggggagataggattttcacctaccttgtgaacagtaaaaatacccatttttccaccactgaagctatgtgtattaatattctatgctttcagaaagaaaatcccacactactgtgattcctgcttaaaaaaggaggtaatctaatgcccaagtaaaaacaattttatggtacttttatgagcttctgggaacaatggccatgtgatgttcagttgcgtgtttcatgtctgatgactgagttcacgtacgtcttagaggctaaatttggtttaaaatatcttacatcttctcaaattccttataacaagagcagtaaattaaaattaaatttcgaccttaaatggattgcatgttttccatttgtaatatattcgtatggttcaaaaatctgaaagagtaaatgagtacatagtaagagatttccttcctacatccccatcttcccagctccttttactccccctcccttctgcatgaaaactactgttactagttttttatgtgtccttccagagttttttctgcatatacaaacctaaaataaacatagattcttattctcctactttttacaaaaaatgtagcacattttataaatattttgcctcttgatttttttcttgcttaacataatatagagttatttccatatatacatacatagggacatttcttaatttttttatagctgcatatcatttccttgcactgaagtaccataatatatgtatatttcacaattacctgattcatgtatatttgactagtttcaaatcttttgatattataaacaatactgcaaagaatattatatatgcataattttatacagtaggataatttcccagtattggaattgctaggttagagtacaagtttatgaatgttgatcagcattgtcaaattgcccttgtatagggattgtgcttagttcggctcttaccaggcttatatgagattgttcctttttcctcagccttaccaatagagcatgttgtcagcctttggcattttgccaatgtgataaatacaaaataatacattagcaaatttttaacctgtgcttttcttattatgagtgaagtaacatattttcatatatttgagtgatgttcctctatacatgatttgtatcttttatttttttcaacattcaaatattttattgttgatctttttattatttatttctataggcttcatctaaattgcaccttttcctgtgatataaagtaaaaaatgtttcagaattatatcatttgtattttgactctgagtatcatctttttttctatttttgtttttttgtttgttattttctgaagaattggttgaatttttctagttcatttttcttcgtggcttctggatttttagtcataattagaaaaggctttccccttccaagattataaaggaaatctcctgggattttttgtacttttgtattatctttaatatcacataaatctctgattcatctggaattggcttgtagtaagaagtttattttttctttatatgacttaattattgaattgactatctttttcccactgatgtaagatattacccttattatacactaaattcttctctatgttgagcaatagttttgaattttctgttcaatctctttggtctgtttatttatgtgccagtattcagggactatatgttttaacatctagaatttctaaactacctttaataactgaaattgctaagctgttttcctatttaaaagtttttctgaatattcttttcttcttttttctttataaacttccagattaacttgttttattcaaacagctggtgttttaaaaatagaattttattacattttcaaattaaattgctgtctttatgatctcgaaatttattctcaaaattatgatattactttttcagttgtgtaattccctttgtttcctctaatggtgctttaaatcatcatataaatcttgcacatcaactttatcagctttatctcttggtattctatctttttcatcactgttgttagtgatttctatatgttgattttgaattctattttactcatcttttattgcttgtagttgtttttcagttaattatcttttatcttccaggtgtataatcatagcttctgtagtaaataattcctttgttttcctctttccaaatttgtatagatttaatttggttgtaactcgtctaatcgctttggattgtacctagagatcagctttaaattttatcagtgatcatctttttcttgtttctgacttctgggattctaaaattttgtcataaagcatgataatggtttttggtctcggttggctgtattttattacgttaatgaagtatccatctgtacagtcctagagttgtagctggacctgtgaacaccaccttaagacacgcatttctcagccccgcttgtatttaagccttacttgtatcacctagtgattcatgtgtgcccatgttcttgccattgtaacgtaagtaaaagtgatacttgccatttcttccacatcctttcttttcccttcttgctggcaggaaaccagaagtgatggcaacccagcctcaactatgtaaaggacaacaaggccttcagggatggctgaccatgagatggagggaacctgggtcccagaatcacttcgtggaacagactactcccctgaacaacaacttccgattattacttgagaaagaaaaataaacataattgtttttttttttttttttgagacggagtctcgctctggcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacataattgtttttaaagccattttattgttgagttttttgttacacaaagccctttattaccatgactccacatttatagttgacccttgaacaatggggttagagggttaggggcaccaaaccccagtgctgttgaaaatctgcatataatttttgactcaccaaaaacttaagtactaatagtctacttttgactggaagccatactgataacctaaatagccaatcaacacacatatttcatgtattcatgacacacgtttttcttaaatttttctatatttctagtctgcacagcaaatctccaagcaatttttatgtatatttattttttaaaatctgcataaaagtggatttttggagttcagacccatgttgttcaaggttcaactgtagtccttttttttttaggtgattttttatttaatcaaatgatttatttttttttaatcaagtgatttttttttttggtcaaaaacctttttcatctatggaaattatcttgtgctgtatctctagatatattcatataaattatattaatggttttacaatatttgaccattcttgctttccctggaataagtcacatttcatataacgaattatttgttcaagtgcttctgggaatgtttcaccgatattcatacctaagattcgtcagctgtttttgtttcctgcagtctttataaagttttgatattagtgttactcttttttgtagaggaaagaataattttttaaaatttttccttgttctggggctattttaaaatgctggaattcactgttctttaaaaatgtggtagaattttcctagaaaacttccaaggccagaggtttcagagtattaataattggcacatttctctaattcatttgttgaaatcagattatttagagtttctatatcctttggggtcagttttggtgaattatacattactagaaaattacatatctcatccagattaaatttattttggcatagagctgaataaaatagtctcttttggcttttttatttttctttgtttttgtggctttttaaattcttattttcatgtttgtagtttgttcatatttccttgaatagtttagctgtgcttcatacattaaatatttttcttaaaaaataatttttaaaatgtatttattctattttttccctaactccataaatattaactaccctcttctccttttccattgattttttgttcttttctataaatttcattcagaaactcaatttccttattttctttattcttttaaattttttaataaaaattaaatgctctgagttttcctttgagcagtgctttagctatagctcatgaattcaggtatgatgtttccattaatattatatattcagatatatcagattgcataactctttgaagagggaattgttttggagggggttttaaaattaccatgagaaaatttttatttttctccagttttatcaatttctatatttaatgtatcatattaagagtatgttttcgctgttatttctagaatttgcctatttctgaaattttctttatagcctcatatgttatcaattttaataaatattccataaatccataaatatggattgttgaaaagaagataggtctttttatttctaatataaagtatttttggtatatcaaacatccataacacattaatgatgctactctattctcatagcttgagagaagagaattactctcttctcactagtgtgtttctgtctcttatttcctgtaatttcaggtttgtgaacattttgctattcataacaattttttgtgaattacactctcttgagttatacaatgttgttttttgcatcattttgggcctaaattcttgcttgtctaatatgaaaaataagaccatctacttggattcttttctgttttgccagtatatctttttccacattttaattttaattattgtgaatcagtttgttctagctattcttttaaacagtattgagcttggttttactttctcattcaatctaaatatctttgattttaacaagtaaatttaattgattgatactgatatagcaggtatgtttgttctgagtgctgccatatgttaaattttttgctttcatgtttgctttatgttctttaacagtctttcattatgttgtctgtgtacttccctttgttttaagtatacttctgatatgtgtgaaggtgacatatttattctattggctatctttataatttagttgttaaccttttgtaaactatgtttgtacttctatcagtttttttgatctgctttaatgatattacttgatttccaggaattttagtaaaataatcaacaaacattttcaacttcctaatttcttttcccctccttcgcatttttaaaaattttaccagttctgcttggcagagcacataatattaacattcttttttggtcatcccaaccctcaaatcttttctattatttccccagtcatatttatttggctgaagaccacctactactgtcgtcaagaaagattaaatcatttttgtaagtaaaagctgtttgttgcctttattcctaaaggacaacttgactcaaactttctttttctgaggatcttgtagatggtgctgttaatacatgttttatggtgttaaatgcaactgtagagaaatctgattttcatgcttataagtaatttactgtttttgctggactaccttacatattctttctttaccatttgaagttcaataactgtctgggttgtctacactgggttagtttttccttgcctccagtgtacctttcaatatgtatagtattattttatttcaaagacttttggggagcttatatctttaagttgtctttatgtctctctgtttttcctttttaagtactctgtcttcttctgttaaggctgctatcacaaattatcataatctaagtggcttatgaacaacagaaatttatttcttacagttctggaggctgagaagtctaagatcaaggtactggcagatctgtgtctggtgagggctgcttcctggttcatagattctgtcttttcactgtatcctcacgtaatggaaggagcaaagaaaccttcgggttctcttttatgagggcggtagtcccatgcttaaaggctctgcccacatgacctaatcacctcccaaaggtcccatctcctaataccatcaccttggaagttagggtttaacataggaattttagagggacataaatagcacactccaaatacgtttgttgtatctactttgcctgtcttctgtatccgtcatctagtctctcattcttttcaagtctttattttcattttattttgttctcctttttttaattagcctttatgttccttattctattttctgtagcttttttttatcatttctgtgatttcacgctattatttcttgagctctgacaggttatatttgagcatttcctcttgacttcctgtttcttcttcatgatcttttttttttttttttttttttttttttttgatggagtctcactctgacacccaggctggagtacagtggtgcattctcagcagctcactgcaacctctgcctcccaggttcaagcgattctcctgcctcagcctcccaagtagctgggactataggcacgtgccaccacatccggctaattttttgtatttttagtagagaaggggtttcaccatgttagccatgatggtctcgatctcctgaccttgtaatccacctgcctcggcctcccaaagtgctgggattacaggtgtgagccactgcgcccagcccatgatctttcttttaaaggcagttgcttcatttattttacaaaactaatgacaaaaattttggttagacttttcattctgtcattgaagaaattcttgtgctctttgtctgttggtaagtgttactgctcttttttttcttatagtaaccgcatatcagtgttgttccatctcctttgctaatgctcaatactgaatgaattgggtcttcatgccttaggtatattagcagaggtgtttgtgaggtgggaagatctaggcagtcttctaaacttcacatctgaaaggtgttctcattaggtggttccacagagacagtgtacttgctgctaatatggccccttcttcaatctgtctgtctattatgaatcaatcaatcaatcaatcaatcagtcatctctctgtccatccatccacccatccatccatccatccatccatccatccatccatccatccttctttcttttctgcctctctagtctaaactgtatttaggaggcttcagcagccagccctactcactgccatactccttctaatttttttttttttttttttttttttgagacggagtctcgctttgtcgcccaggatggagtgcagtggtgggatctccactcactgcaggctccacctcccgggttcacgccattctcctgcctcagcctcccgagtagctgggactacaggcgcccaccaccaagcccggctaattttttgtatttttagtgtagacggggtttcactgtgttagtcaggatggtctcgatctcctgacctcgtgatccgccggcctcggcctcccaaagtgctgggattacaggtatgagccaccacgcctggccactccttctaatttttaacacatggtgaggtgttgcatattggtatattctactgttattgtaacttcttttccatggtggtgtatttttgttggtattttctgagaactgttaatggtaagctacttaacctcactcttcacttcattttctccttaatttatttccttttgcttctatcagacctttgccctattgacaggatagttgagtataccaaaaatacaattttagcattgcagggtgccacacatgttgagaaaatatttttgccagtgtctttggaaatttgcccttgaagaaccaactattctctgtttctttttttttttttttttttttttttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagatggggtttcaccttgttagccaggatggtctcgatctcctgacctcatgatccacccgcctcggcctcccaaagtgctgggattacaggcgtgagccaccgcgcccggcctttctctgtttctttataatgatttttctgtacaatatcagttgcctttgggagactatgtatgcttggaagtgtgaacattatatctgttctaacttttatgattaaggagtttatttttttcctcatttttttcttttctttgttgcttttgtgtaatacccagcaagtggaaggttatttattctgatgccttgtttgtactgtaatttgaaaactgacattttgggataattttatttattttattaagattttttttgtattggtggtcatgtatgtagtttaaaatgaagtgtggatttttaggctataaaattagccagggtttagaatggtaaggtggataaagcacatttactttttttcctccatttttccttttgaatcctgatgagtattatctagttttcatttttggtaagttctccacattcatggactgctttgttactattctgaccataaaatgcttgaatttagagttctatgtgagaaaagtgatccttgttgtgctgttatgactaagcatattgtataccacagttaggaaataaaaagcactttgcttcctgagataaatcatctatatgcatctatccatgtatctatcaattcatctatctatctgtctatcaccttatctagtactattccctcaaattaaggaaggcttgagctctttcttataagttgctaactctctcattgaaataattcattccctgaattttgcaaaactgacatccataaatttgtgatgacccttgaagatatgattaaaaaatgaagaaactgttctaccatgaataggctaattgtaactttagtagccttgtgatttttttttctctaaatacccgctgtgtccatttgtcaaagatccttgcaaatatttaaattttgcatataaaaaatacctttcaaagaatatttttatgtctgcatttttcttttaccagtgacatttcactgatcatagaaatgaaacccagagttattgctatatttatgaaaggatgaatgtataattgattaaggagatctatttaatataaagcttataattagggtcatgataaagtcttgaattgtaaatatatgttgtatttattgaatagaatgcaattagagaatacaaacctataaaatatgtaatattagaggtggaaacaagacaaagtttctttgacaaaaaggtgcatgtacatagatttaggtcagagattgactaatgcttaaaaataaagaaaaaatgaatcaatttaattgagataaatgatccatgattaggataagagaaagtctagctattcaattcagagttcacttgaatgcatgggctgctgtcaagtttttaataaaagtacagagcagcttcctaacagaggtatgaataataagtttatatgtctctgaaacaatgttaatataattgaatcaaagaaataattaaatgtataatagtcttctatttaaatttgttcttaacagtgcaatttcttatttaaattctgtattatgaatttaattatttttgtcaagattttaaaaaatcattattataaccagttggcaccataattacttttagggaaggaactgtgttgggtgcggggagcaaaacttggtaagtcacttgggattaaaggtgtgggactttgaggatagagcctccgtaacaggataagttattctacatgagaaaatgggaagtgtttattttgaactactatatggattgggattggaggctgaaggcagtcttctaggtatcaaagggcagggaggttttacctgacatatgaattattgtttcatgtaaatatagttgaaagtcatatatatttagaattttaaatacatagtttcaagacagtgcttttaattttttaagaaaatatgtgtcatttattttttccaaagctagtggaagtttctttgtgtcctaatagcaattgcgtgaatgaaatcgacatgaataatacttccagttagattttcataaactgacagatagtttcataaatacccaatatgtaatgatagtcagagggagaagctatattaagtgtgtatttcaggagagattgtcctctggagcatatactagcatcaggcagctgctttatggaaccacccaccaattcccttgggttgttgttattattgtttgttttttgtattttgtttagtttctagggaacataattttctttgtgtttctttttgcatgatgctgaccaagtcatgttcataaatcacatatgttgatatctacagtgctttcattggccttccaactcgagcatggcaaaatatgcttattttccttcagaagcgcatctttgtgttaactaggcattaacaatatgtgcttaatagcaattatcttatttctaaggatctcagagttggtttggcacattgcctcagtgctcttcaaacattatcagagaaggacaacataaacaataagatttacactgtaaaattagcctccacttacaaattcttttatcagccaatccttatcttaataacatatattaccttttattaaagtaaatatgtccctcagctctagcttttttctctgtatttttatgtacatttatggagttttactgaaatatttagaagactactgtctaaatacggttctaatttttaaaatgcataatctttagggtaaagtcttggagagtggcaagtttaatcaaacagtaacgctatcagagataaagatcataactcgcattaaattctataatttaaaataaactatgtctggtatgtattcagaaaatgtcagagctagaacatttagttcagtctctatttcatgggttaaagaaaagaaagcttagaacagtgaaaatacttcctcaaggtaatacttacagttcatggctgaagtggtaataaaagtcacaaccaactttttcctctctgctttcttttctttctgttctgtcattttaagtttcttaaaggaaaagcttagagaaaattaagtattgatgatagagcagatacaggattttcaccgggtgcagtggcttacgcctgtaatcctagcacactgggaggctgaggcaggtggatcacttgaggtcaggagtttgagacaagcctggccaatatggtgaaaccctgtgtctactaaaaaaacaaaaatttgctgagtgtgatggtgcacacctgtaatccctgctactcgggaggctgagccaggagaatcacttgaacccaggaggtggtggctgcagtgagccaagatggcactactgcactccagcctgggcgacagaatgagactccatctcgacattaaaaaaaaaaaaaaaaagaaaaacaaaaaaaggattgtgttaacatgggggcctgggtgagaagagaaaatttatttataggaggacatgtaggaagggcactgaagattactgtttaccattttgaattgtccctgctccagtcttacaaagtgggacatgcattgtgtttcttgggcatactcacttccctaagaataagctgtatcatccaatgctatttgcacagaactcacggctttatatttactgtcctaaaataagtgatttacaatcttttaaactttaaaacagtaaatttgattttcagcgatgcctttttttttgtcattttaaggccccctccaaagtgttgtaacctagctgaatgaaaaataagtggcatttttgttgttattgttggtgatgatacttttcatggcaatctttgagatacctaggaatattccaagtttttgaaaaatcatggttgggaattaccactctggaaacagattgccatggttactgtgttaatgctgtgattaatgcgtcttttagtcttgtatgtgtgtgtagatgtagacataattctatattctagtttggttaacatgtttgatctttttctatcagtcagagacataaaaatgtcttgactctcttaaaaacaagactgttcccattttttaacctaatggatatttgttgctgaggatcatttttttgtaaggagtgaaatacccagaaaactaaagtggtctagaagataactgctagttctacatttttttttttgtctgaagttgtgtttgaatttacttcctttcatcacttagtattaaaagaacagtgtgtcaattatagataagaattctacatcccctgtctttccctaagtacctgcttcgaaaaatgggtgcaactagactcagtagctagatgtggtatgtggaatgtggattcgttcgtatcaggcatgcttcttataggaatcctttaatgcactcagtcacccagagcagtcaaaggcctaagctgcttcatactttatagcagggcacagtcacttccataaatactgtgcactcccaagtaaatccagaatgtttgcaacaggatttgtgtaccatccccaattctctgttttcttcaataaagtctttgtacacaattgtttgattgtttttatctcttgatactcacaaataatgccactggagaaataaacctaagacatatccaactggatcactttatatacagagatataacatttcaacaacagaagcctttcttgttgaggggatgcacatttggaatactctcaaatgattattcgaaatcaagaaaaagagccaatgagaaacagcaaaacacaaatatctctaataaggaaaaatatttctgcaatgagatttttcttagatatatatgtgatgattaagagcatttgtttatattgtaggttcttgtcctaaacttacaatagtaagtgtagacaacactaattgttatggtaaaaggtgctacatgtgtgtatgtatgtatatgtgtatgtatatgtatacatatattatttggatattccagtcagtggtacttactgcccttggttaatgcataattgtcttgagaaaatgattatatgtatcagtgtgatctggctaaaacaactctctccaactgatcacctgattttgtttcatttccccgggtaatctggtaggtggccatttcttttctttctagtctatgttccctcctaaagataaaacttggtcaaacatctatttatggtaacctgtctttaagatagtttcaggcataccttcttcctttaatctcatttggttgatatgttagatcctttcctatcagccagagaaataaaaatgtcttcagtgtcttaaacaaaattgtttacattctttaattaaatggtcattttaaggagagaaatgctcagaaaattaaactgagtatagaaggtaactgctaattctacatttcttttctgaaattgtgtcttcatttgttttttaaaaatcatttagaagctgtgtagcccacagagaagttctcaagtttgtggaaaagaaataattaagtcccgaagttaggggtagaagagaatggagctttgttggtcaattctgacatcttagaacacctcagtaatgtggttctttgaaagcatcaaatcgctgcggttactttagaaaggtcatttttagaatgcttatactacttttcccccattttgaaggtcaactggggtttattttaagttagtattgatgtaaaagatggcacaccctcttctggggcataaatgcttgaggatgagccatagtcatgcatgacatgtgtcaagataagaaatggaaatttatctgcagagactaccatatgatgtatgtgtaaattttcagtccctgggattatgatttttttttttagtgaagacaaatgttttttgttagttagatcctgatttttggcatgatttagtaggagaaagaaggttttagtttagacatagcttttcttacatcttgtgtaaaattgtcagttatagggagggtaaacactgcactctggaaaggccttctggaatgtccttatttctgtgtgagtgtgatggaaaaaaataacttttaaaaaaatacatgtttaatgaaagatatttccaggttattccttctggattttaatttaacgcttgtttgtatctctatgatagcatgtatgaaaatgtattttaatgatttaattatctccccatattagatgatcttgctatctttatcatatgccctgtttatttttctattcctggtgataggtggagtgactgatacattgcaggtacataatatacatttttgagtagatatgtgtatgattaattgacattttgcaagcctttttttccaacttttaagttctggggtacatgtgcaggatgtgcaggtttgttacatacgtaaacatgtgtcacggtagattgctgcacagatcatcccatcacctaggtgttaagcccagcatccattagctattcttcctgatgctctccctcccacccctcaacagtgtgtgttgttttgacagaccccagtatgtgttgttcccaccacgtgtccatgtgttctcatcattcatctcccacttatgagtgagaacatgcaatatttggttttctgttcctgcattaggcaaaccgtttttttgtttgtttgtttgtttttgtttttgtttttaaagaaaaaagaaagacatgctatgaaatggccttggacctaattcaagaaacgaaagaaagtcagagatcaaggaagaaaggaacaatgcagagtttatggaagttagatgttaagatgacagctgagtatgcttcttttctcctcacccttgtttagccaggtgcttacttgacaatttgtaaattaaattattccttgaacaatattttgcacaggagtaaaggaatgcttcatggataaacagaggcaatacctggagctaatctttgtggataaatgtgtttattttgattcctgaagctgggatgcagaactgatagagggaagccagggggttttctctgctccaccaaataaatcacatatgactagaaattgcaaccagacagcaatctgtgaagcaagtgataggagctccaccgtctggtgcctgctgtggatgtctggcacccattggtaccagatttggtgtaagtggggcttctgtttaggaaactttgccaatttttttttcttgaaaagtggattttggctttgtttctgcattcttatatgggaataaaaaaatctcataattgcaaatgtgtttattatgccccaaacattagatctaggctattctttccataggatattgtaatcctgtgtgggtacatttgctgctgcatttgacacagtaaagttgtattaatgtttttcattctgctatcttttagaactaagataggcataattcctaatttatctgtgctcccccttatgcatacatttaggtagtcaaaccttgagagtttctatagaatatttttaaaacttacctttggtctgtcttatccttggaaatgttttcacgtttgagagcatcacctcctatcagatcattctgttccttgaccctctccctctgacaaatttcacatctttcttcgcaggaaaaaagaaactaaggctatatcatggctttcttcactcctcttcattctgatatgaacatttgaagcaagcattgatttttttcttccttcttcttacttttgccagaacccatgatgctgtttattctggtggggtgtgtgtgaaacgcatgttgcagttccatctctcttgaccttttctttgtttgctatgtatattgcatctcctcagttgtccaggttatcgcaagaaattgtgctggatttctactcgctcaccttctatttcttactaaatattccttgttgtatcataatccctctcaccagaattcctcctgtgtgaactcatagattacaatctacattgctgcaagagactaccaaattttccatctttctcaggtttctgcaccttcactcactcttatatctttccaaactttcctttccatctttcttaatgtcaaacctgattagtcattctcctgcttaaaatcttccaccgagttctcagggctttcaggttgaagttcaagctcattagtgtgacatacaaggctcttaggacctggtggtctcagcccctggctacttccctaaaacactgcccactcagaccagatctaactagttttagttccctatatcatggtatactactgcgattttccatgtgcgcttactttactcccaggtctctctatcctcttcctcttcatgtaactaatttcttcctggctctttgacactgggcatcagtgtcatgtccccagtgtctaatgtgatgtctttcatctgttctcttataggcttggatgcatctccttcctgtcatcttactagtattattgttcactgtccttccacggtggcacagagtccccagggtatatcatagtattgtttgcaaaggtctactaagagtaaatgagtaaatgaatctaataattttttattgctttaagtgctctgtattttaattcactgcctatcaagccttgctctctttgaattatatttatgtctaaatgttcatgatagcatcagattgaattaattgtagccttatatattgactctcaaacatgaccaagactgttattgttgactctatattcagacaaataaccagacacatagagtaaaagagttaacccatagtctgtatgacctaatgaaaagagcttagacaagaaccaaggagcaacagtctcaaatgtcagatgcctttgccatattactcccatttctttttttatagttaaaaatgttaaattttaaaggttaatgtgatgctgctaagccctctgtagggtgattgatcagcttaaatgtaaactattttggtgaccatgatatataaagtcatagtgttgaaaaaattcaacaatagttagaatcattttaagaaaacaacattgatatatgaaaatattcacaattgagaaatcttatattgatgaacttagagattatacattttggtcttgaggcagaactcatcttagtaaaactgcttaagaacttaatcttgatcttataaaataaataaagatggtattttgtattttaaactattgagtatgatttcttgctgggatctatcactatgaaaagtgattattggtttagagtggtgttctcgttattttgggttttgaaggagcacagttcatcctgttggtctgtgttaaccaggggtaggtaaagaggacagaggacacctagcaatggctcaggtattatcagtgagcagggtgagaaaatccttgtgtaccaagaggaattttgtcatggatttgcagaactttcaaaaacaagaaacattatttccacttttcgtgtgattcctctcactttttaacctcttttctcttttccttcttttcgagatggagtcttattatgttgtccaggctggagtatattggctattcacaggcatgatcattacacgctacagcctctgaactcctggctcaagtcatcttcccatctcagtcttgagtaactgggactatagatgtgtgctgtggtgcctggcagagcctcttctttaactgtaatagacctgcttatcatgcatgaaatgatctacaaacacaaagtaccctatcatcattatctctttggagtactatgtcctttaaatgtattttcttactgtaactaactacctaggctggaggtcctatctctaatttagaaatgaagaaagtgagacctacttggattgagtgagcattcgaagtacattcagaagtggaaattatttttaaaagttaaatggcttctagaggtcatgtagtctcttttgtcatatagtggagaaaacagagaagttcaagatttccccaaacgttcttagttactggcaaacaggagctaaatgtcattcttcctggattttagtcagtatttgcttggtcacttttcttagtagagctttttcttctccttgcattcataaacacttaataaaagtgaattgataatgatcatatatattatataattaggtaatattagccgggcatggtggttcatgactgtcataccagtttcatatattagaagaaaagtacaaattgtgtagctactcaagtgcaaaatgtagagagaaaacctagagaagacatgaaactctctccttgactaatatcttcaggctggggatactatgaacaatggtgtgttcagaaagaatgaacaaaattgctgtagtaactcaatttcagaagagtttgaccctgtcagaatcatctactgtatttgcatgagaaatatgaaaggagtccaagggaaagatgatgtgttcagtgttcttttccactgcattggagcacctgaggagctgaagagagaaacttgtgtttcttctttgagtggcaagtgtgttagttaatatcatcaggcagaacatgctttccaagagtttagtttgctccttcacaaactaaaatactctgaagtgcctgattttatgcaaattacttttggttgttgtattgagaaatgaaaggatgccaacatttttttttataaaccaaatactaattagcattaccaaatttatctgttgagatacaccacttatttgtaagagaagctctttgacaaaatgaaagaatatgaataaattcttcacactggctatatgagaccttggaatgtcattttcttttttttctgtagaatttgtgtaataccctccactttgttggactgaatgagatgcatacaaaacaaccttgtaaattacagcattctaggtcagaggctagaaatattttctgtaaaaggcaagagagaaatattttatgcttttgtgaaccataggtctctgttgcatctactcaactctgccattgtagtgtgaaagcatccatagatagtacataaacaaatgagggctgctctgttccaataaaactttatttatagatacagaaatttgaatttcatgtaatcttcacctattgtgaaatgttatttttctcttgatttttgtaaccatttcaaaatataaaaaatgactcttagcccacaggctgtataaaaacatgtagatttggtccaaggtctgcaattcactagcctttctccaggtgactgcctcactatgaaacagttccaagtataaagggattaggatatgatgctgatgttgggattgcatttactgagctatctaggtgattgactccaggctctctctctgatactgagaacatgccttggcatatgttcccagctaacgtttgagaaaactcattttcggaggaataattttctgttgtttgttgctgggagttgggcagaatatctcaggtagtggaaggaggatactgcaccacacaactcatagaactgaattgatacagatagatgtcagcatttctgtgcaaaaacaaatgtttcaaagttttgaggtctcagcacttttccaggcacagcattctggatcttggcacacagatgactctcagtttgaatagaaaatgctcacctttctttttgctagttttattccagagccaatctctttataataaagaaagcaactgaaaatggaaaactcactgagcttaaagcagccaaaggaaaaatatgtgctcattttaagttttttcttttgcaactcttggccaaataggtttatttttaaatacttttcacaatttacaaatgtttgccttaggactttgtgtaatggcattggttttatacagctattacagttagggtgaagagattttcttcacagagatggttttggaaaatgtctcatcacacaagtggtaagtgtagtcgctgtaattgtattgaagaaaagaaatgactaatgggaatcacaaaattgtgaaattgatgatcatttctgtttttattgcctttattttaaacataatagtgacaaagtctgaaacaatatttggagattgctacatatttaaatatttaatgcaacaagcatcccactttattataggagatagaacatcgactgtgcctaacctaaattacttttccagggggttttagtggattattttcctattaaaaaaaggggaaaaaagaaaagaacagtctggtacaaagtataggtgacggcttcagctttgtaattacctattaattgatatctgtatataagtataacaaataaagttttaaatactgaaaatgagatgagagatactaaaggaaacaatttcctgagaagtattaggttagactgtacaaatgtaaaaaacatgtcaacaacctggcagcaagtagtcttgagaccttgaagttcaatgagagcagatgaattgtctgctcttttaatagtaataaaaactatctaaggcaaaattttggcatgtaacttaagaaacttaaaaagtttctcatgctttaagacactttgattttattagatctagaatgaggtctgggaatgtatatttttataaagctccactggtgacctgggtcaagttttgcaatacagaatttgaggcagataatattatgtaggaggtaggagatttattggggagtgctagaagtaccaataccagtgggggagtgaaaaaagcatgtctgtagagcagaagaagctggactgcagagcagttgcagtagaatcccatctgatcctaaggagccctggagctggcattccaggccctggagagttgtcctggaatgaggcaaggaggagggtttgtacccttgcattcatcagtcatgggatacaggatgccccagggagtgggtgaaaacttgagggagatagctctttccaacagagggtagtgtccagagaaggtctggttatgaggtgtcagaagccaacacttgcaatcattggacgaatttcagtcctgaagttgtttctaggcagcacaccagtgtgtccattacaacaggctattcttatgattgaaaaacgattgtctaaggggttgttgggaagaagtacttggactggagggtaggcaaggagtatttatctgtttcttaaacatgtacggagtgcctactatgtataggtactagagacataaacatgaagagataagttccctacatttaaggagcttaccatctagtgggactcagatatgtaaataaataattaaaacataattgtcaaaacaggagggtatgtggtatgtgcatgtttccaggttttaaaaaagctttacttcacaaacaaaaatgttctgttcattctgcttattttgatttgatagattacagctcgcagagctaatattctcttaatgtaagtttcttccccttcacagatgtttttccatctcctctaatttctcatcgttctgtgatgagacaaccagagtctttaaaaaataaatactttgcttttctatgattaaatggtttgatgaaaattaagccataagcataaagtgctaaatagaataaacccctggcacataaaatgggtaggtcctgatatcctctttcaattcttcaaatgtataggtagatactgataccctgtctcaactgtagtcaattacactatatattttcctctataaaatgtatcactggccacgttcagtagccctccattactgaatggggcaattattcaagaatgccccagtgaatgcctgaaactgcacctggtaccaagtcctacatatattgtcttttttttatatgtacatacctatgataaagtttaatttataaattaggcacagtaggagattaacagcaataacaaatacaatagtaaaacaattgtaacagtataccaacatcactgctcttgtacttcgaggccatcatgaaggaaaataaaggtgatttgtacaagagcactaggatattgtgataacgcagacatctcctagacaggatctactggacaaagggatgattcacgtcccgggtaggagggggcaggacagagcgggacagtgggagacttcatcttgccacatagaatagtggataatttaaaaattaggaattgtttacttctgaaattttccacataatagtttcaaaccaagggtaactgaaaccatgagaagtgaaactgcagatatgggaagactcctatagaaaatatttgggctgggcatggtggctcatgcctgtaatcccagcactttgggaggctgaggtgggtggatcatctgaggtcaggagtttgagaccagcctggccaacatggtgaaaccccgtctctactaaaaatacaaaaattggctgggtgtggtggtgcaaacctgtagtcccagctatttgggaagctgaggcaggataatcgcttgaaccccggaggcagaggttgcagtgagctgagatctcgcaagtaattggttatttactacataaaaatgttacgtagtattcatatttatgtttgattgcatcacttttttttaaacttttggctcaaatattggtagttttcaaggaacttttctgcagcattatatgaatatgatgacaagtagaaaaaccaaaagggtgcatcaatgtatgaaagctggtgtgttaaattgttatcatcattaacaattcactgctgcatgctaaattcatagctcacacaattcaatttatgccttataaaattacaaactattacaagtcatggactttaaggttgctcaccaagttatcaagaaggtcaaaggtaaatgcaactgtactattctatggtaatttttcacaaatcccattgattcttgtttatgatactatttcataaaactcagggtcatataataatgttctgtttcaaaacatgttggtgtatttcaaggtctcagaaaaggtattgaaattttttggtgagccaaagagaacaggaaagatgatgttttgtctgtaaattccatgttgactctgagttagaagagactctaagggtcatctggttctgggctgttagttttgaggtaataacgttttcatttacaaaaagaacattggtaaagtaataaaagcttatttttgtatatatacttatttacgcacagattatacatgggaaaaatggtgcccaggcagtttgctttcagtgatatatgttaggtgaaggtcaggaataatattgacataagtaaatattggaatagaaggcaagacttggaggtgggatttaaacaaataaacaaagttttttttttttttcctttttatgctactttgcaggaaggtcatgtcaaaattaaaatagattctgctttctaccttggcaagtaacatgtattatgcccactcacatgtaggtcttatctgctttggcaaatacttacagaagaaagtgtaatttggaaagagaagaacataatgatattagacaaaatagggtcacaaaaatttacaattggaaaatgatttgtaagttaataaaattacctagagccagattctactgtctaaatataccactgaatgtaaacaagcttttgctgagctagtatagacaggtttgaaaaacttggttttctccagtactcactcttatcaaggaggaaaaaggcccagaaaaaaaattctgaagagtatttttgtatcatttacttatgccccatctttttctcaaatatatttaagacagtttatcagaatacatactatgtaagaaaataacataaataaggaaatcagggcaaacagaatgtaaggttttgaaaatgaaaaaggatctggggaatctgaggataaagttaacacaaaaaatgcttgaggatctgttcatctgctgaatgacggttacaaatctgtaaatattctgatagccaactctaagagaaaaacacagttatttcaatgtttatagttatcctggaggagcccaattctttctctaagtgggaccagagaaaaatttcccctttgtcctaagaaagaattcctacggagtatagggtaatcaagaactcatgaagctgtgtgtcctgtaatgccccttaagtagttagatgattgcaggccaagagcaatacagtcaaactgattttaccaggaagaaaaagcagtcagtccaaaaacaacattcttgtggtttgattaatccaaaattggttagattcaggaatggaaatctgcatagactttaggcaaacctcaataattatttctgtaaccaagattctgataattgttgaggaagtagtgaattcaagcttatgctctctgtacttcctgacaaatccttggagtgcatcactgctatgttgttagtgcgtgtggacccatatgcctttgatatttgccaggctggggatataaatgacatataaagatgttctaatgagggctactcactctcttttctctctcacagacacattcactcatgcccatgtatatacagataatcatatagacatatatacacacacataactattgaataatttgttgtttaaaaaatatgtttcaaattaatggggaaagatagattggggaacagatgggcgtcagacaatttgctatcaatttggctagaaatcaagttagattcctatcttacaagatatgcaaaacatagaaggattataaagtcaaattaaaaaacaaagtattagaagaatatatggagcatttttatactcttgcagtagggaaagatgctcagagcaaacatgaaatccagatcccataaaataaaaatacgaagtacttaggcaaaaaccaagaagaaataacaaactttggtaagacacaaatgatagtaaatgtataaaagtcaatataagtaaaattaaaagagaagtgataaacttggaacatgtattctaaacatacaacatgaagaagcttagtatctatgatttttaaagaatgtcaagatattaatatacaggaaaaacagcagaatagaaaaatgagtaaagaacatagtttttttctttttgaattaattgaatttgaaacagcggtttttctccttcgaggagtaggacttttcacaaagcttcagtggattgttctaaatactggaaatgatatggagaagcacgtctcatctttctggaaagcgatttggcaatgtatatcaaaccttaacattacaaatgagcagacccaacaaatgttcatataaaactcacacctaaaaatataccagacatgaaggcaaagctatatatacaaagggtgtttacagaaatattattcttatgtcaagtgtggaaaatactaaccgaagtccacatgtccaactgaagaggaattagggtttaatgatttaagaagatatcatgaaactattaaaattatgtttaatgttaattatataggaaaatccttgaggtaaagttttaaaagtaggatacaaaattatgtcatacacacacacacacacacacacacacacattttacaaaaaccaaaatatatgtatgatatgtattgttttacacatggagagatataagtatacacattataaatacaaattaatacttttggtcatacaggatgtctctgttttttgaaatacatttttcaatagttttgacatttttagccataagtatatatcaatagtgttatttgaaaaatatttaaacagaacataactcagttaatatatatgtactaaataaatttataatttttaagggcagaaaagcataaatatttcaggaaattctgaactaaaacacagttgaaaacttctaagactctatatcaatatgcaattgcaatgttaaataaaataaagatgttagcaaatagcacaatagtagttggcatattggaactagaatttcatcacgttatttgcaagacatctaatatgagtcatttgacccaatattttccttgtcttactctgggatgatgatacctctgtcatggggttgctgtgaagagtcagtaagatgtaatcaaccagcgaatgttaggtgctcagtacattttaattcttcatcctctttctctttttcctctcagcacagataccagatgtaaaaatgttatttatttttttcctagcactagtaaggagttgaaagtttttttccataaaaacagtgcccagttcttggtgatgacagcagggagacctttctcactcctcttcagggtgaaggtcagtgggttcgttccagttcattgactggttgttcacagctgacgttatcacgattagacaatgctttgccttaccaattatttaacgtaactgtgcttctgtctttgctcataaaaactctggtttggatacttcactcattgaaagcagcagaggcaaatcatcaggtatatatacagcttcaatgcctaagatattgggctacttttgctagttagcctgtggtccagtagccgcccccacaccccaccatctatttttggaacgtatacaaatggagaaagatacattaggttcctccattttaatctagttatttttttaaaaaaattataagtatgaattttaggctgtaagtgtaattttgttagatggatagattgtgtagcattaaagtcaggacttttagggtagttaccatccaaataacatatattggccagagacagtgtctcctgcctagaatcccagcactttgggaagttgaggcaggtagattacttgaggtcaggagttcaaaaccagcctggctggtcaacatggtgaaactccatctctactaaaaatacaaaaattagccgggcatggtgatgcgcccctgtaatctcagctactcaggaggctgaggcaggagaattgcttgaacccaggaggcagaggttgcagtgagccgtgattgcaccaggccactgcactcaagcctgggtgtaagagtgagactctgtctcaaaaaacaaaaaacaagtatattgtgcccattaaataatttctcattatttattcctctcctatgtccccacccttctgagtttctattgtctatctttttatactctgtgtccatgtgtatgcattatttagctcccacttgtaaatgagaacatgcagcatttatgtttctgtgactgacttgtttcaattaagacaatggcctccagtttcatccatgttgctgcaaaagacatgactttattctgtttttttttttttatggctgaatagcattccattgtgtacctattacatttttttttcccagtcatgcactgatggacacttaggttgattccatattctttgctgttgtgagtagtgctgtgttaagtatacaggtgcaggtatctttttgatataaagatttctcttcctttgggaaaacacccagtagtgagagtgcaggatcaaatggtagttctttaaactctctaagaatctttacaaaatcctgccactgtaggtataaaacaatatgtggtctcacttagaataaaatggagacattttaagaatgtgttgtttgaatcctggccatgttctttcccagaggctacagtttggtgtagttcactggatgtgcctgtggacactgaacttgactggctattggatttctgactcctggaagattttgaggagttgcagctcttgttctctttcatctcccacccatctccagaaaagtccaggttacacctgtggaagggttaccagccagaggacagagtgtgaaggcttgcctggtaatggcaaacccagttgccatccacatgtcatactttgcaccatgtccctgatttgtatgggttctgtacatgtcacagtttctaagagtgaacctctctgcccccccgcccacatgactctgctgtcagctttccaaacaatgagaggacagctcctttgaaagatgtaagttttccattccgaaagatataaatttcctggtcctgcagaggctagaaatacctcttgtttgggtcactggactcgggctaggtgatctgcaagatcttacacaatgctactctaatatttcctctgtctccagctgtttcatgactccatccctgccatgtgtgtgccttaccatctttttaagcagagcacaggcctgggcagtggctcatgcatgtaatcccaggctttgagaggattgcatgaggtcaggagttcaagactaacctgggcaacatagcaagaccccatgtctacaaaaaattaaaaaaaagccaggcatggtggcgcgtacctatagccctagctgcctggaaggctgaggcaggaagatcgcttgagcccaggagttcaaggctgtagtggaccatgatcatgccactgcactccagcctgggtgacagagtaagaccttttcttacaaaaataaagaaatagagtacagattgtaactggcaacagtgagtctgtctcctccctttcctcgggcatcagagtcaaaagaatgacaataacatttgctataattattttaagtttttttaaatgatatggcccacatatagaaaataattatcatgttgtcttctaaaggatttgattactagaattagataactgatttctttctttcaaaaagtggaagcttttttttgtttgtttgtttttggttaactgcattttaaattttaggaacaagtagattcttcttcagtcttaaacttcagcacctgctaaaaataaggattacgtattaaacattatattttcccccagttttctctggatgttactgcaaaaatttactcactctcatttggatcacaggggctgataaatgtgtgtgtttccagatgctgcaccaggactgaacctgtggagtaggaaatgattctaccttagatacacataccctcctctcctgtttttttattctaagtctccctagcctcttaggtttttgtttgtattaccctccctctttcctgcttccagccatccctattatgactctaagggtcccatgaaagattaggtcatctgtgatgctgtcagaggcctggagaagtcctccacctatgtgtgcgtcatggacacctggacacaggctaaaagcttcttgagcaacttggtaatggccttctgaaaaaaaatgcgctcagccaatgtattactaattctactgggggaatttccaagtcaatttctggggactgagagtggtacagaaggatgagggtgtttaggtacactttaaattcacagtgtatgatgtgccctgaccacccccatcctccacacacccactacttactcctaaaacaattttttctaagccaaaagtggtttatgacaaattgtatgtttgcagatttggagtctaaagaggagtagatttatttaagggccatatttagtgttagtaaaagctacacttactatgctaattgcaacttaaattagagctttacctttatcaccaaaaaaaaccccactgtcttcccttgatgttaaattgtaggaatttaaagtaatttaaatttctattttttctacatttccgctttttgtatctgtacaatatgattatacatgtgaatggttaacaaaaactgtatactttagtctttaagtggaacctcagtgcaatattttgtaggcattaaaaatgataagcactttcatcagactattagttttcattttgttgactttgtttgtttagttctttgtggtataccctgtagttataatgaaatgatgtaaatctatatatttgccaacacatagatgtatttctttttaacttaactttttagcattatgcaggaactgctgctcactcgctaattatcccacagcctcgcaagatggcatctcctgttttctagcagatcaggatcaaaactttggaatcatttctctttctcttacacctcatatcccatccataagaaattctctgcatgtatctagaacttggcacttcttaccactttaactgctaccatccgtcatcttttgcctggattattaaaataacctcacatctgtccttttcttgccattttatcctttattcattagccagaatgagccttctaagactgtagtcaaaagtcatacagctcctttactcaaaccctccatgaacttctgacctcattcagtgtaaattcccaaggtccttaccatgaccttcaatgccctttatcatctggtctattaatgccacctgacctctttttctaccaccgccctcaggtcactctgcttcagacataggggcatcactgatgtttcagaagcactgcagaacccttgcactaactgcttccagtgctaagaatgagcttactttgtataagcatggcttaattccttactttctttggtttctgtccacatgccactttctcagtgaggccttcgctgacttccctgcatgagctagaatccactctgcacctggcagtctggacattcttaccttggcttatcctctattatcctagagatgtctgtcttcatccccaacacctagaacagtgacggacacatgatagctacctcatgattatatttgaatgaataaatctttaattatccataattgggtagtagacccaatcttgcacaggcagccaagaaacaaaaccaagaaaaaaaaacttagtttctatgtagacctgccactaactagacatacttccttttgcaggtgtttaacatctctgagtctcaaatgtctcaagtattaaaatacaatagattgaactagacaatttcaaaagttctgcttgctctaataaaatactttacacgaagtaaacacaattccactgatgtttgttcaatattttctatggcaaggccattcctcattatatataactcaagtagataagtagcagttgttatttgtcatatgtatgtatgtacgtacacacacatgcacacacaattcaccctctcccacaatatcactgtgttacacaatcctcagtcctattacctctgagacccattgtaaataaaatgtaaaatctttagagcatgttggacaaatacatggttttggttctgcctctttccagtcgcagacatcactgtgagattatagaactctttccatctaggccaagactgggtctaagaattcttctcagacttctaggaaagatatcaaacttattagagttgaaactagagatgtaacatagattttattccaggttttgggtatctgagagcctagaagtggtgtgagataaagaatttgatacaccttctccagtctttttgcttggttttccttcaattcatccttccaaactcattgtagataccacttctcctaggatttttccccaaatccaagactgtgttatgtggcccttgttatctgattacctagggccctggtctcaattacagaattattatgttgtaatttctttttaattttaacttgactgcatcatctacctgactgtgttctctagaggttcagaccaagaattgcgttttgaagactgagagctgggcctgacacttactagggacacaataaatgttgacttattgaacagataaatgaatgaatgaatgatgcccaggatagaatatttggtactgctgtcctgtctagcacatttctccaaggtaaaattatctcccacatatgacaaaaatctacctttctcttggttaaatcccttagtaagctgcctatcagagaatttgagggttaactcattcttttagaataatgtaaataacttggatgggagcaggctgtatgctttaggtcaattagaccaccttctcatgcctgagggaaattgtcccttaaggtctgttctatggcacctagtcccctaagatttgacaagaaagcgttccacagttcaatatatttggaaaacattgctcgctggcctttccccttgaaatctggccatggacattagcttattagagattctgagtcatctagtaaagaattctgtttaatttttttatagctagaatttttcatttcttttgaacttaaggataatattcaacattatatatattaacattctactggactaatgctttaggaaacagagttttacacacatagaggccatttaatagctttaaataacagtgtagcagccatatggcagtgagcagattggatttggaaaggggtaaaaccagtagggaggatgttgcagaaatctagatggaagaggatgaggcctataaccaaagtcctcatagcggccacggagaaatgaaaacgtttatgcaagaaactgatctcgttactgaaaagtcttttgcaagagtaactaaggtggttagagaacaggaggttggtactgtagtgctttccctcttctgcctttcaaaggtaagagcttgacttcgtttttaagccagcaggggttcttacatagctgagtgtctatcactacttaatgcatgtataatgccctgctgtactgatattcatgataaaaatcaaggtatttacagtcaattataatttcttattctcaaagcatacattgattttcttaaactaggcttttctgaactgggtatgataatacacattattatcataccattattaggcctctctttccaggtctttcagtgaaatctgtgtgtgtgtatgtatgcatttcctaaggctgttggtgcaaagaaacacaaactgggtggcttaaaaacaacagaaaccaaaatcaaggtgttggcagggccatgctccctgtggggttctggcagatccttccttgcctctccctgttttctggccatgtctgtcaatccttggtgtttgctggcttgtagctgcaatgcttcagtctccacctctgtcattcgatggtgtctccctgtatgtctctgtctctctctgtgtacacattttcatctttttgtaagtacaccagccaaattggattaagggtctaacctactccattatgaattcatcttaactaattacatctgccacaaatttatttccaaataaggtcacattctgaggcaccgggggttaggactttaacacacctcctttgggggcccaattcaaccaataactacatctgtgtgtgtgtggtgtgcacgtatgtgtatgtgtttgtaagtgcacacgtaagatgcaccaacatagatgcaaagacgtttgtcttcccaaatttactagtagtatttctggctctactcccatgaaattacctttaccctttctctttgaaggatggacaaagccaggtctgataaagcgttagaatttgtcatggctggtcttcacgcggcaaaccaattatgtgaccacccaggccttttcatcatgcttggtacattcatggaatgttatctcacactggggttggtaatgcaatactaattctaaaaggctattctgattaatgtattcatcttggtttagcattttttatattgtttatttcagctctcctttcccttttgtgatctaaatatattttctttcaggttattttgctaagtggttccgagctaattttattacttttttgatggtaagggtctaggcagagtagcctttctgaaaggcaagctttaccgacttctccaggttcataaatattaataatgtgtaactacgactctgtgtgctaaaacattgttgtggagattgtacaaggaaggcattttatgatttcatggagacatggagtagcaagaaaatggagcaatgacatttggggggagcatgacatctaaatgttaatattgtgtactgcttactgagaatgagaatttctcttcttttgatgctcgtgttgtcagttgcacgagagtgttcttcaatttgtactttacttcttctagctattttttttctttataaaactgctagaaaagaagccagctagtattttgaataaaagagttgggattgtataaggcaatgtttttactcagctttcctcgaccttttgatgaaaattccagttcaaaataaaaagacacaggcactaccctctgagagagtctgtgtgaccaggctatcattcttaagaaacggattgaaacttcttagtacatctcataaaaaatttagttagctataaatgttttaggctgttgcagctgatatcatttgccttgtgggaaaaaaaaatgaggctgttttatgttaagtgttttgttttctcttctctctattctttttttatatgtattaggcaatgcaaagacttttactaccattgttatgatagtatttaaataagcagaccaaacccatgcatgggactgaagagtaaagtcaagaaatatttgagatgcctcttttaaattaaaggtatattcttcattgctaattttgagttcaattttttactgtatattaaaatgttaatttcaatttcatctatagcagatggtatcctgcttttattttctaaagggattcttcaagtaagccctcagttgtcttgcattatgagtaattagagaaataccttggttggtcctcagggcagagctaaaaatagagttcagtgatttttttctgtaattcttactatttttaaatagaagaaaatgataggcaagaaagaaaaggccatacttaaccaaaatgtccatgacttctttcattactaacaaaaaattgccaagcttgacagtttgcaaataactctcccttctccatgaaggtaacttggaattcgatgtgtgtgtatgtacctgtgtgagtgcatgtgtgtgtgtgtgagagagagagagagagagagggaccacaaagtctctgatgttaacaaatacaagaggaagagcagtagatgagggcagaggtgtggtaagcaattgatctggcaaaatcttgaaagttaagacaagaactctgggtgttactctgagatgggaagtgtttcgactcagcaatcccataatgggtatatattcaaaagaaaacaaatcgttttaccaaaaagatacatgcacttgcatgttcatcacagcactattcacagtagcaaagacatggaaatcagcctagggcccaccaacagtagactggataaagaaaatgtggtacatatgcaccatggaatactacatagccatacaaagaatgaaataatgccctttgcagcaacatggatgtagctggaggccattattctaagcaaattaacacaagaacagaaaaccaaatatcgcatgttctcacttacaagtgggagccaaacactggctattcatggacatatagatggcaacaagagactctggggacccttaggggcaggagggaacagggggagggttgaaaacctacctatgaagtatatgttcagtaccttggtgccaggatcatttgtaccccaaagctcagtatagtgcaatatacccaggtaccaaatctgcacatgtaccccctgaatctaaaataaaagttgaaagtaaataaatagataaataaatgcattaacttttttcatgaaaactaacaacaaaaaacctgagaagacaggccgcaaaaaaagaaatatggaatacatttaacctacaaagaaacaatatccagaatacataaggaacatctaaaagtcaatcgtagtaaataacataaaagcaaactgaaaaatacttcaaacgacattattcagaaaatgtatcctaatggccgataaacattaaaaggtgctgaacattcttaatcatgaaaatgaaaaatagaccatactgagatgatcatttatcatccagtattaacaaaaatctagaaattatgacaataagttttgggtaggatgagaagcaatactgctttggggtatacaattgctttggaaataatttggcattagctgtaaagtttgaagatagacctatttacaggttagtagtaccaatcctatatatgctgtctagaaacttctgtacatgtttaccaggaagcacatataagaatattcctagaattactgaaatggcaaaaaactgaaaaaaactgcaactatccaccaaaagtaggatatatagataaatcaatagactgatagattggcagatagataggagtgctatacagctgttaaaaataactgtaatgcagtgttactcatcaatctggatgaatttcaaaaccaaaatgctaagaggaaagtgcaagaagcagaaaagaccatagaaattattccatttctgtaaggtcaaaacaagcaaaattcagcaacatagtgttttgaaatgcattcatatatggtagaactatagagaattttaggagaatgattaaaagagattcagaataatggtcacctgtggagggaaggagggggctatgattggagaaggtcatgctatctacaaatgtgttgttccatttctcagtctgatagtagaaagatatttgaacatattattgttcttcaaattgtatatacattttaatattttataaatatattctgcattaaaataaaaagaaaataggaatgatatggaaccagcaacgacagacaacttttttaagaattttttttttttttttttttttttttaacgaaagctattgtcttctatggaaaatgttgtttgacctattagcacttgattaggttcccctccttttcctgaaacactataacttttccctatcatgtcttgtactaaatttatgctagctgcaatgctagataacactcctccagacaggtcttagtagattaataataaatgtttatttcttgctcaagtaagaggaaaaatgagattacctataagtagcagctcattttcaaaaggtaattcaggtaccttgtatctttaaatctggtggctctgctattttcaacatgtggcttctaaggtctctgtgagaggagaaagaatgggggcttgcacatgtgggacattttcatgagcaaggcctgcattttcctccatatgctgttgacagaactcaatggcataggcccgctaactggtaatgagctggcaagtgttgcctagctgtgtgtgcaaaagaaaaagagacagatttttttttcaatagctagccattttatccatctactttccaaatatccacttaaatctttcttctttgcttaggacccatttaccaagggtgacagtccagtcccatcaccgttttgagctcaaataacaatatctccaggcagtatgcagtcttctccatccattgtaaatgtgccttcttgcggtcttgcaatctctgaattaaaaagacaagttgtctccctttcacatcttcccctctctccagagtgggagacacataacattcactggtacatggaaagaataatattctgcaggagggtggaaggggtcttttcctagcagttctccttggctcttatcactgtaggctagtgcatagccccatgcctattgtatgactgcactgtgtcagagttcaatgagttcaagtttgtactattccctgttcatgataagaactatataatagttaattgctgatagtattattatattacaacaagctcaagtaccaagtgtctttgactttggctgaaattatgtgcacactaagactagttaccatggtcatcataagctataaatggtaattttttctatatattgtttaatatgtgtgtgtgtgtgggtgtgtgtgtgtgggtgtgtgtgtgcacatgcacacatccaggaaaaattattacttgacacctactttttcttgtaaacaacaatttatagtaaatatggaaggaaatttaaagggtctgtggcttgaacatgttggaaagtcttgctttaaagctccagcagatcctttctgtactaaggcacaaaagctatgatttttcatctgcccagaataataaaattatttacaaaagcactgagaattattctttatatgatttccaaccttcaagcttctgtagaaacattgtagctttgtaaaatgtggtgccttaccttggaaaaaaaagctttgttttgaagccgaggaatagtaaagaaaactgctatgtccctagcattaaaatcttatatcctcacaatgtgaacatgcaaattaactagaagaaactacattttaaaaattgaaagatttttttctgagatgcctttgcattttggttatctcttattggtcaaccccaggtcagagttaacacacctggctctagagtaatacacatgtacaggtgttgttaaaggctgcatgatggtattctgagcctctgctctgagctctgtcctagatataaagaatgtgcagccagctgtttgtctacttgtcctgaccctgttcaaggattaatgaagagatcctctatctgtagtccaatgtctattgggtagggaccagaaatgattgaacgtctttgcttcatgatacgctgtgccagtatacatgaaaatgggaacctaaaagtactttcataagcactttgtggaacttatttcttcctttaaaatgtcctagacaccttattgtcacctcttggctccctctggtttctgtattttcactggtacattggatcaccatggcagagccctaccctgcacccaacccaatagcaggaaggtttaccttcagcttgttccctgtatgctcagtttccggtggatttattactgtttttggttgtccccagaggctggcttatcatgaagttaaggatcttgatgcctcagggcttttcacttacatagaaccttccaagcccatgggtcttgaatctttgctaaatcggtccttgctctgtatggtactgctttaactgaaacacacacaggaagctgtgtccttactttgcacagatgtattattcaacactgtgaatactgtagtaataatttttggtattttccttgtaaaacaaagagaaaagaaaacaaaatacagaattgtgctgcttttattcactgagtagtgtttcaaatcaagctagctttctggcagtgtgacatcatggcttagcaaagagtccttagaattttctaacttttaacaaaatggggaccttaaacaatctattctctgaaaaataatgttgaggtttcacagtaggaatgaaaagggtgggacgattatgatataactaactcaatttttaatgaataatgaattgcagagttaatgcttgtcagaattttccaggaattagggagaaaatgaggaagaaaattttacaagtagagttaagaggaagaggtagatgaatgcacgatcctgcttttattttatgactattaggatagagatgtttgaaacctgctgagtagctggtggaaggggaaggcttcaaggataaatagtagatggccatgcttgtcccccgacacagggaacggcctgcgcaaacacacttggtttgaggatatctgatgagttcaaagtgctttaactactaagcaggtggaatggcaggatataggagtcgtggcggccactgtaaaactcggtggttcagatgtgggtgacatgatttgcaaatataattacaaagtgatacgaactgttaaattggacaagtttagatttaggtgacagtaggacttagaagagacatctctatatttcctatgctaagctggaggtaataggagaacaaactactttatccacccctgaaaatgagactgttttactgatggaaacatcatcgtcttgaccatgagaaaaatccaagctagaatcctggccctgtggtttactagccaagattctttgaggggcattaatatttctttatgtatacattgagactctgtgatgatacctaccgcttatgcttgctgtgagcatgaatgagccaagatgtactgaagagccatgttaaatacctgtagatagttaataaatagtatctttattgttatcaagtaaatggaaagaattcaaaagaagggagaaagagagaggaatagtaaaatgtcatgagagctggaggttatttgaaaaatacatgttaatcaattgacgttatcaatcaagtaatcacgagattaccacagatacccagcttggggacaggaccacagaagaataatttgtgctgcctctcttgacgataactactttggttgaaattctgtatccctcttactttgacaaatcagaatcaagcgtggttgaatcttaaagactttttttttttctgaactaactcttactagttggcacaatagttaaatgtgtaggaggaaaagaggatgacggagaatgcatattttggtttggagagaacaaaaactgccctaggataatgtttgaatacatggccaccaacaagcccaagcttttgtggaaaaacactaaaatggctaaagcctctcagcataactgctttgctaatttaagtgtttgctttgagagtatgtgaacaaccgaattttcttagttaaatttattaaaaatgactgtacaggatggaattggccaatcagacaaaaacagttcaaaattagacgacgtttttcatcacttcacacttttgcagtgtttgctacaatcaagacactgtgcttagatgctgaacgtgatgcaaaggagttaaagatgtagtccttaccattgatttattggaagcaatagcatattacaaatactttatcttgctctacaggtaggcccgatacaagaagtgttggctatgagtaataatttggaggttcttcaaaaaactaaaaatagagctaccgtatgatccagcaatctcactgctgggtataacccaaaagaaaataaatcagtatatcaaagaggtatctacgctctcatgcgtgttgcagcactgttgacagtagctaagatttgggatcaacctaagtgtccatcagcagttgaatggataaagaaaatgtggtgcttatatacaattgagtactctttagccataacacagaaggaggtcttgttatttgcaacaacatggatggaactggaggccattattttaagtgaaataaaccaggcacagaaagacaaatgtcacatgttcttacttatttgtggaatcttaaaatcaaaacaattgaactaatggacctagagagtagaaggatggttaccagaggctgggaagggtagtgggggctggtggttggggaggtaggggtggttaataggtacaaaaaggtagttagaaagaatgcataagacctactatttgatagcacagcagggagactatagtcaataataatttaattgtacattttaaaataacctgaagagtgcagttggattctttgtaacccacaggataaatgcttgaggggatggataccccattctccatgatgtgattatttcacattgcatgcctgtatcaaagcatcccatgtaccccgtgaatatatacacctactgtgtatccacaaaaaaagtgttggaagagtgttgtgggatttcacacaaggcactgcctgggtttgtgtcactgctctgctctcctataccactcttgtcacataagcaagagacacacagtctcatatggagtgacaaattcggaaatggaaattcttttacagttaattaattcaattcagagtgtctcctcatcatcatccagcatttcctgagggtacctgttttgtgtaatgtggtaagcatagtctcttctcttatattcttccaattaattactttttctagagtttaggcccttctgccggagggagatgcctgtgtggtcacaagaatatttttctccctgcctccactttgttttggtgaccttggccatgttagttggctttattaggcttccacttcacaatctgtcaactcgattaacacaggcctccctggaatacctggctgttttgtttaagatgaatctaggaatatgacttgtttcaaatccacatgtcatcttgaaatgagcttgtctgggtctttagggttgaaatatatcccaggcttcttggctgctgatgtatatttactattttaacttcagttatctttttagtctgaaggctgaatgacttcttacagtgatcaacacaaagattatccagtagtctttggttgaatttattgtcttgacttcaatactatctatcagcaatactttgcaaggtcaacttttaaccatttttgttgttctttgccaaacattgcataaaataaaatataacctttcttctaccatattgtaatactgttgtaaaaaattaaatgatttcctactattccagtttattctctgtcaacattcttttcatactaaaaaggttggttttagcttatagatgaaatgtttttctccaaacttatttatgataataacaacaaatacttttatagtgcttagtatattccaggcactattataaacattctaaacaccttctgccattaactcattgagtcctcacaataatcttatgggtactgctaattgtgcccatttcacagatgagaagattgagggcaaagaagttaagtattttgcttatggtcacaagtgattgggccaatgtttgaaccaatcacttgtctgaaattttgcctttaactatttcacattttgcctcactgttagattttagttctttgttctgaatttggaatgcgtataaccatacaagcaaacacaaatttttattttttaacttgtaatattatggctgacctagagcagtgacatttttagtccaagacctagatacagacaacaggagatcatgtgtaaagaaaatagaataaaggtccttttttcttatgcagggccagcccaagataaaattttgtaataggttgaagtatatctttggcatcttttcacctttctctccctctctcaatttttggcactcctcctttcactttcatctattttttgctccactttgattagcagtagcctgtctaatccctgagagtaacccatacatcagacagaaactccaagtacagtgatacgggaatcaatgtaccctacctctgaccctcaaatttctcctctcagattctagcctgagaaaatatactgaaatgcaaaggtttttgcataaagatgttaatcacagcgactttcttttcagtaataaaaatttgaaaactgcctaaatgtacaacattggaagaatggttaagtaaattgtgcattatacaatacaatgcagcattatgcagccattaaaaactatgtttatgaaaacttctccatgacagaggatagtacataagtttaaatgctaagaaaattcaagttgaaagtagtataatatcaactctagaaaaatacatataaaacaaggaaagaaaaagctccaaatattaaatgtatacagattggatataaagtgattatttatagtttattccgttttctaatgtattagttttacaatctagaaaaaataaatgatcagtttttataaaaaccttcattcacaataaattgcaattttttcttaatcctcctagatatattgtcattttcaaaaatgatacttgccaatcccagtgtctttaattagtaggattctaagcagcacaagaaaatatagaaaaagattgaagaagtgtagagggaatatattcaaagtatgtagtatgtaagctgaaatagagcaaccgcaattgaattctcagatcactaaacttttcttgctttacacaaattttatctttcttaattcaattttttctttttcttttgtgctttctatttaaaagttaatgttttgttttgcattatattttttttcctctctgtgttggaagcaaagacagtaatgggaaaaggggacaagaaacggggcaaggatacactgaaggtgatatatatgatatatatatatatatatatcttcatagatggtggaattataaatggattacatatatcagatagaattaagtgtttgcaaattaaggcttgtttatactcttttgcaagcaatattttaaaatctgtttgtttattttttttatttttggaagccaagccagcagttgtttaaaattcatgcctctgcataatatatgaagactacatagatgagttttctggagatttctccttgacacatttagtttctccacgttgcttgtagaaaggatgattccattctctcaataccaccttccaccaggagaagccattttctttcctgaaggtcaacctacagccacagtagaagaggaaaccagttactgtgattccaaatataatttcccaggaggtgaaattccctctcctaaacatgaattggttacaggaaaagaaaaaagaatgtaattcgtaagactgtggagccattttcctaatccaatttctcctgtcccctagatcgatatcatgtgaattgcttccacaggggactgtgctagcagagaggggtctgtggaaagaaagaagcaccgtgctccaatggaccattattattgtttccatatcacagggtccacatatgcatgtaaatgtttttatagtacacatacacaaatgcaaaactgaatgtctaactaatgtcaagcacggtcacatacacccacactctctaatttcctgtccaaggtggtgatctgtaaaagagaggtgaactgtaagagctgaatgattagaaaataaattctaaaactcaagtgcacttaacagtggacgtaatcagtagagagaactaagacctttaggattctgatgcatctgtcacctgtaagtaaactgacagttctgtttttttaattattattaagcatgagttgctatataaatcacatctcattacaacaagccacaagtgactatctacatttttatgcaaaatgaatgctatcctactaaatgagcattgcctaatattgggagtcttttcttggtcatgcagtgatatttgctgataggggatttgacctgtcatagctttcttctagttttgtagacatttcttgttctctacctccctggttcccagcgtgcttatataatttgacaatatcttttggagcaatttgaaaatatgaatctcaggtcattggaatttgtgtattctaataaaaactggcataataattcagaagtggaattcattgaagaattatgggctcccaaatgctagtcaaattattttttatagaggtggaaagaaagggtcattctgtttttatttcaatccccaaagtatagattaaggcagcagtattctaggtcttacacaatcataggaggtgggtaacattgcaggagaggaggaaataatattcgttgactgtttactattggcaagacatcttaccaacagtttaatactctttgcaactctgagccagttggctctctctgtatatcacttttggaaaagctgaaatttgtaaattagtcccaaactctaggtcagagggtaggggagtgaaggaaggtttcattaaataaatggcccttgggctagtaattaaagatgactatgagttacctgagtaacaaggggagggaacagtgttcttagtagagggaacaacatttgcaaagaatcttcagtgggatggagcttaaaaataaggcaaacatggctgaaggacagagagtgtgggagagtactatataagctaagagggaggatataggcaggagctagatcaggcagtgctttgatggccattttaaggaattttaagcaatgggaagcttgaatcaaagactgtaacatgagcagatgtgctttttcaatacattattatagttgtggtgtggagaactgactgtgtggacacagacagactttcacttcaatcatctggatgaaacagtggtagcttagatggatgtttgtggtagagatggagagagatagagagtttggggacgatgggcagaattaatagaattcattgatatgaagatgtgaggaggtgaggaagagaaagatgtttaaggtgacatagaactctgcatcatataataaaatggatgggggtgccgtttatggagatacggaatgctcaaagacctgagttttatgaatttgatcatttttctaaataagtgcttgattaggagcatggatcacctatttggttttgaacatgtatttgccattcctgtgactcatgtaaaagaaatgtgaaaaggcagttggatctggactctagaagagaaatctagattcacaaactcgggaatgagcattgatgagaggtggagaactacaacagttattagccacatccaggagaatgagcctacaaggagaaacagaataatccaatagttaggaggaaatcaggaagatgactgttttgtggaaggcaaggtaattgatgtttcaaaacaattttgttggtttttgataatgtggaagttatgggcaagagaatgcttgggatgctcaaagaccagcaagaagaacagagtgactggagctaagtgggcaagatgattagatttaaaggttgattttaggtgtgatgagaatgcattaagaggttttgagtgaagaggggatatgacctgctttacattgtcactggactacagtgatagacagtgaaggaagcagggatggaagggcttggggggagaccaattaggagactgtgcattcaacattcagctagtatttatttaacatccagtatatgccagatatctgtaatctaggcttgtcatttggacttggacaaggaagaagtaatcaaatttgagatatattttgaagtcacagccgttgggatttgccaatggattgaaaatcgggatgtgaggaggagatgaatcaaggataatttcatggttttttggcttgggcaatagagagaattgcagtggggctgagactggtagccatagacaaggaacagaggtgaatagggagaggagcacgagttcagttctggatttgataaggaaatggtaatttttgtttataagattcttatgaggataaatgaagtaatgtctgtaaaggactttataaagagcataaacacttatcataagattattgttgttactattattagagtgggccatagtgaaaaccagtattctgatttgttgggccacctactgtgttttattcttggctttgtcactaacttgctgtgtcactttgagcaatttattggttctttctcaatctcaatctcttcctctctgaaagtttccaaagtgaacattagagatggaattgactagaagatcaggaagatcccaatcagctgtaacacccctatgatataaggctgattagtattatctcagtattattttttacattattgatattgatattttacttttatacagaagccaccttccaaagtagatttatcatattctaatgagcattgtgaatgatctcatttcagagataaaaatgttgaagggctttaattatatttaaagaaaaacagcaaaaatgaactcttatgatgaaaatcagtcatcaaaaaaaaaacctgagagatgagaaactacaacaattatccaccctcccaacatgtatgcagctattttgaaagaaaacatttggtacctgttgttagattttggaaggttacacacaaacttggaaaactgtctaaagaaaagccaagggatttttgagttttaattacttcttttaaaaagtaaacagtagtcaattaaggagccataacttgtcttctattattaaattaatggaatcatgcagtaaaatatcagtggagactgcggcattcacctggacagacactgctgttttaattatctatagagtcaaatctatccaaacaatcactctcataatgtaagagaaggaaagaaaaactaaaaactagtccatctctaatttttctcatatatcagggtttttttaagtttacttgctcttcttgcctccctgactcaatttcatccctagattattgcagcaatatcagcaactattagttattattttagttcataactatttgttattctttggatctaagttactagtatctagagtggttctgaatgaccaggtatgagcagtgtggaggattggaaagcacatattctgaagaggtgttgaactgaaacacatccttctaggtacttagctgttttgtttctaacaacttaaagatgttaaagtatgttgttcacatctgcctcaatataagtggcagaagcaacattcctggtatgaaaatatgcacccagagaacttaaaatttccttgatcaatgttaacctgctgttgcagccaatgacatatcttttacctagagctagaaggtactaaggatgaaatcttgtgggattcccatgtaatatagtctgaatgtgtgtctctgcccaaatctcatgttgaattctaattcccaatgttggaggtggggccttgtggcaggtaactaaattatagggatgagtttctcatgaagagtttagtactatccccttggtactgtcctcatgatagcgagtgagttctcctgagatctagtctttaaaagcgtgtgatgcttcgcccctctctctcactcttgctttggccgtgtgacgtggctacaccctctttgccttccaccatgattgtaagtttcctgaggcctccccagaagctgagcagatgccagcatcatgcttcctctacagcctgcagaaccatgagtcaattaaatccccttccttcaaaaattaaccattctcgggtatttctttatagcaacgcaacaatgaatgaatacaccatgggatgctgctgatgtttggatatcctctcacttctaatccctggaaagaaaaccttgcattccagagcattccatctaagcagctggaaccactccttaggtaggatctcagtggcccctgtaacaagtactatgattatagtggacaagtacaactgctcctatctattcaaatggaagaatgaagggacaatgttatagttacaaaaagtgcaaaattttattgcaaaacttcctagtaatgattctaattatctttattgaatgtctgccattttctaggcactggagtgggggttgatttggtttcccttatctacctattcaggtagataagggaaatttacgtggaagctgaagttccttactagagagagcattatcacctctaactctgaacccagtgggcactgctagttttgtagttcctggagttgcactctgcctttttttcctcacacttataactacttctccagctcctgccctggacaggcctgcactgctctgggcattctgcccactaatgactagtttttggctcatttcctccagaggctgcacagggaagagtgacctgtgtggccttatctgtaccatagattttctttcttgtgtccagctgtaatcccaatttatataaacatgtctatacctgagaccccagtcttgataccccaacatataacgtcttgctaatcaccctcacatagccctttaagaaggtattttataattaagagacttgaaactgagaggcttacttgcccaaggtgcttgggaatgcattcagatccacactgtgtttactgtactgtgctgtctccatcccattgtacattactcatttgtaattccagctgcttttgtttgagtgactagcaagtgttcaagtttcactcacatgccatactcttagaggaagtaaataacgtgtttcttgaacctcactgtgttcaggaagtactttatttaaccttgcctgcgggttaatgaatccttgctctgcttcctagggctttatgtatgattaaccaatatacctgactatatatttgaaaagttggccaaatactatatctggggcatggggttccactgcactgcagcagcgcgtatttacttgctcccagggctgtccactgttatgagagagagagaattcctactctgcattctaccccatcaccaactgcaatgtgagaagcgaatcacaattattttctcagtccctgaagtatttgctccagaaggctttatttgatgctagaaaaagattttcccataggatcaagcttgtttatggtggttaagaagaccaagaggggaagaaaatctgttagggcaatgtcagcttaagagagaagctgaaattatttattttagcaccttatttctacatacccctctgtttgattagctagacatctaaatccatgcaaagcattgtttatataacacaatctgcaagatccttacagtcatagcatcttcatcctccctcccctatgtaggcttacacaattgagaggagacaactgaagtctcaattcacgtctcacatttcacacaaagaacatcagctttttgtatcatttactctttacaaacatactattgattgccataaaaaattatctctgataacacactcataacatcctatctgttatttacccatctctgtgaaactgattatgagatttttcccaggtgactagcaggaagcaggtctgttaagggcaaaggaggaaggggtacagcttgttttgtgctgaaagaagaccagagaagtcagtgaagtcaacctcctggacacagctttttcccaagctgaccctgttgactgaggaatgccgagttacattaatgatggacactgtctgcccatcatggaaagcggagagctacatgtgtgggaaagggtagtaaactcctcctccacaactgtgcctccttccaagcttagatgacagaatattagtgtctgttatccttacgacatctctccatctggtcctctcaggatttactttatggtctgttttatttcccttttactactattagaaacaaacagctgaaaggattaatcaaaaatgttactgcttcaaagagtaaaaaacatgttacctgtttgactggtgcccatatatagttaagagtttctgaaggaagaagggtcacgcttaatagatttgatgagtccattaagcctggcttccatcttgttgctttgtttgtgcatttatttccattttggtatcttagcagtcatcttcttttagcaaacattgaggtttcagtctattgggtcagggtattagcaatacattaaccaaaccgttgaagacaaggggccagacatattcaaagtgtgatccgcattcaatatcaccattctcttgcaattgcaaagttataggcatcctttggatttttgcagcacttattttataagaaaaggagtaaataaagccacatctctgggatatgctttgagatgtttaagattgggaacattttcaggctgtctcaatactggaaatttgttgtccttttttttcacacattttctccctcttatactactctttaccaaaaggtgggtaaagataaggagatgaaaaaaatgttgcttaagtttttggttgccagctctgttttaagcctgacatagaagggggttgaaatttattttcatcattcagttaagagctattcttggctttcacaaatctcagtcctaattctgttattgtttcagataatgtagaatttgtcacattggctaaaaaaacaactccactaaatcaggacattagttttacatttcactgtgctacattctaaaataaaatgaccatttgtgctggggatgattttagaaaagcgaataagtaatataaagttttcctggttttctcatgggcagcctagaaaaatgccacaccaagactcaagaaattacattctgaattttgcatgaagataagacttgaagaaatcttatttcaacttatactttcctcagtttatgtcctgtaggaggaccctgtagagggggaatgcagaagaccagagggaagaaaatagatggtgtcaattgttatcaacacacgatagtatcacatttttattgagatataatttatatataataaaatatgagagttaaagtattaagttcaataaattttgacaggtgtatatacttgtgaacaaaacttcattaagatacagatgaattctgtcattctagaaatttctttatgcaccttcccatcctttcagaaaattcctcatgcccctcactcctccttctcctctatcactcatagaggcaaccactgatttctgtcactatagtttagtgttagctgttctcgaacttcatataaatggaaacatacagtgggtactctgttgtgcctggatttatttatttatttatttattacacctttaagttgtgggatacatgtgcagaacgtgcaggtttgttacataggtatacacgtgccatggtggtttgctacacccatcaacctgtcaactacattaggtgtttctcctaatgttatccttcccctagactcccaccccacaaaaggccccggtgtgtgatgttccccgctctgtgtccatgtgttctcattgttcaactcccacttatgagtgagaatgtgcagtgtttggttttctgttcctgtgttagtttgctgagaatgatgcaatcccattactgggtatatacccaaaggattataaatcattctcctataaagacacatgcacatgtatgtctactgcagcactcttcacgatagcaaagacttggaaccaactcaaatgcccatcaatgatacactgaataaagaaactgtggcacatacacaccatggaatactgtgcagccataaaaaaggatgagttcatgtccttttcaaggacatggatgaagtgcctggattatttagcttggtgtaatggttttgagatttatctgggttgttacatgtactagtagtttatatcttccattgtgtgagtatgccacacaatggatatttgggttgtttccagtttgggaatattatgaaggtgccatgaacattcatgtacaattttttatgccaattggctttaatgtctcttgagtgagtacttagaaatgggacggctagagcataagctaggtgcatatttagatttatgagaagtggttagttttccaaattggttataccattcttcactacctgttacccactgaatgacatactctgtgttctagccaatgctttaatgtcatttacctttttaatatgttaaagggtgtgtagtagtaactcactgtggttttaaatggcatttctctgatgaataatgatgttggataacttttcttctgcttattggctacttacacatcttcctttgtaaaatatctatgtcttttcactcattttaaaagtgaatttgtcttcttatagatttcatacatgttccttacgtattgtggatatgattctaatatgggaattgtgaatattctctcccagaatgtagcttgccttttcaatttcttaaaggatgtcttttgaagagaataattttaaaatattgataaaccctattttatcagtgttttctgttatcattagttttagcatactgtctaagaactatttgcctatcaagtttatgatataatctctttttttttcttctaggatcttcagacttttagcttatacatttatggcttatataatccatctcaagtaaatcttcatgtatagtataaggtcaagattaatttccttttcatatacatatccacttattctagtacattcatcaaaaagatgtttctctccacatttaattgcactggtgccttttacaaaagccataagtcacttatataagtgtgagtttattgatggactccatattttgttgtctatttgtctactgtatgccagtaccatactcttagttaaattttaaagttagttagcatacgttctctaactttgtttttctcttttaagatgttttagcaatttgaaatcctttaaaactacatatgaattttaacatcagcttatcaatttcttaaaaagctggctcagagtttgattggtattgctttgagtctataggttaatttagggagaattaatatgtttacaacatttagttttgcaacccgtgagtctattatctctctcaatttatttagatcatcactaatttatctcaccaatgttttgtagtttcagtgaagatagcctaagtcttttattaaatgtattcacaagcgttttctagtctttgatattgtaaattgtatagaattttaaatttaactttcaacttgtttttaatggttagtagcagttacttcctcctctgatatcctgaacccctcaaagttacccatgcggattggaatcaactttgtccaaactcttgtaaatgttaatattttgatttaaagtgaaagttgtcctgaatggtaacgcctaggttttcttctagggtttttatggttttaggtctaaggtttaagtctttaatccatcttgaattaatttttgtataaggtgtaaggaagggatccagtttcagctttctacatatggctagccagttttcccagcaccatttgttaaatagggaatcctttccccattgcttgtttttctcaggtttgtcgaagatcagatagttgtagatatgctaccattcaggacataggcatgggcaaggacttcatgtctaaaacatcaaaagcaatggcaacaaaagccaaaattgacaaatgggatctaattaaactaaagagcttctgcacagcaaaagaaactatcatcagaatgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggatatgaacaggcacttctcaaaagaagacatttatgcagccaaaagacgcatgaaaaaatgctcatcatcactggccatcagagaaatgcaaatcaaaaccacaatgagataccatctcacaccagttagaatggcaatcattaaaaagtcaggaaagaacaggtgctggagaggatgtggagaaataggaacacttttacactgttggtgggactgtaaactagttcaaccattgtggaagtcactgtggcgattcctcagggatctagaactagaaataccatttgacccagccatcccattactgggtatatacccaaaggactgtaaatcatgctgctataaagacacatgcacacgtatgtttattgcggcactattcacaatagcaaagacttggaaccaacccaaatgtccaacagtgatagaccggattaagaaaatgtggcagatatacaccatggaatactatgcagccataaaaaatgatgagttcatgtcctttgtagggacatggatgaaattggaaatcattattctcagtaaactatcccaaggacaaaaaaccaaacacctcttgttctcactcatagatgggaattgaacaatgagaacacatggacacaggaaggggaacatcacactctggggactgttgtggggtgaggggagtggggagggatagcattaggagatatacctaatgctaaatgacgagttaatgggtgcagcacaccaacatggcacatgtatacatacgtaactaacctgcacattgtgcacatgtaccctaaaacttaaagtataataataaaaaataaataaataaaaataaaaataaagtgaaagttgtgtgactcttcctttcacttgaaaacttagaggttcctggagggttattaattgttttaatttcactattgttttgtctcagggaatagggaggccagaggagagggagtgagataaggaacagacagtttgtggagcagttagaacacacataacatttgttaagttgaccatcttgcgtgggagtgatttgtggtgccccaaagccattatggtagtaacatgaaagatcattgatcgcagattaccataacaaatataatgataaaaataatgtttgaaatattgttagaattgccaaaatgtgacacggagagatgaaggaagcacatgctgttggaaaaatgatgctgatagacttgctgaatgcagggttgccacaaagatttaataggtaaaaaatacagtatctttcaagtacaataaaatgaggtagcttctatgtccttgtatgtttcatgggactttctatgtgcaccattatgtcttctgtgaataaaggcagtttaacgtctttgacaatttttttgtatagcattgaaaaagtttattttgagttaaaaatgtgtccttgtaaatttcttttctttttttaaaaatttcttctaaaaaaacagggtacatgtgcagaacatgcaagttggttacataggtatacatgtgacatggtggtttgctgcacctattgaccagtcctctaagttcccttccctcaacaggccctgatgtgtgtcattcccctctctgtgtccatgtattctcattgttcaactcccacttacgtgtgagaacatgtggtgtctggttttctgttcctgttttagtttgctgaggatgatagcttccagcttcatccatgtacctgcagaagacattatctcattcctttttatggctgcaaagtattccatggtgtatgtgtgtcacatttcctttatccagtctgtcactgatgggcatatggactggttccatgtctttgctattgtaaatagtgctgcaataaacatatgtgtgcatgtgtctttatagtagaatgatttatatgcctatgtatatatacccagtaatgggattgctgagtcaaatggtatttctggttctagatcctagttatgccttaaacttttattttctgtctaattgctctagctagggcctctagttacaatgctggatagcagtgatgaggtcagataatatagtaattattaaaacttcccatataaagaattcttgatccagatagcttcattaattctctaaatatttaagaaaaaaagatactaatcttatgcaatttatttaagaaaataatggagaaaagaacacttcccagcttgttttatgaggctagcattacttgacatgaaaacctgacaaggacattattagaaaagaaatcatggaccaataatgttatgagcatagacataaaaattcgtaataaaacattagaaaattaaacccagtgatatgcataaagacaaatttaccagggaatgcaaggttagtttcatatttgaaaatcagtagtgcaagtcatcatatttaacagaataaaggagaaaaatcatataatcatctcaatagatgctgaaaagcgtttgaaaaaaaggtaactcctgttcatgattaaatctctcagcaaacttggaatagaagagatatttctcatttgataaaggaaatctataataaacctacagcaaacaacacatataatgatgaaacattaaaacatttctctgtggaatttgatcttacttgcttatactttcattaaatgcatatatgacattttgtaaaatctcagttgctattattgtattattatgacctacatttagttagatgaaaaacacttttctggtacccaacaatttgtcattgccgtttagataccatttaacagtttttctgttgcatctacaagctgggtccacaccagattgggagcacactccaaagcaggacttctctgtttagcttccccctttccatgtttaaaaactttcaactgtcagaaaaatacagggaaaaatgttgtatcatgaaaccaagtaatggttcttctattaactcaaatactaaagtatgactatttgattagggatgctagatgtgagaatggaaataaagggatacaagaggcatttaaaaatagatagttggccggacacagtggctcacgcctgtgatcccagcaccttgggaggccgaggcgggcagatcacgaggtcaggagatcgagaccatcctggctaacacggtgaaaccccgtctctactaaaaatacaaaaaattagcctggcatggtggcgggtggctgtagtcccagctacttgggaggctgaggcaggagaatggcgtgaacctgggaggcagagcttgcagtgagccaagatcgcgccaccacactccagcctgggtgacagagcaagagcttgcagtgagccaagatcgcgccaccacactccagcctgggtgacagagcaagactccatctcaaaaaaaaaaaaaaaaaagatagttctggaattctgagtgtacacagaagataaaggatggagataggatgaataaagaataggagattttgtacatgttattttcttttctgagattagtcttgcctcttgtctttgactagtcaattcctcctcatcttgtttttaatcaacttttttgagataatggtagattgacatgcagttgcaagaaataatacagagagatactctgtatcttttactcagtttgccccaacggtgatatcttgcaaaactataatacaatatcacaatcagaatattgacattgatacagtcatgataaatagcattttcatcactacaagaatccttcattttgtgcttttacagccatgatgacttccctcctgaccccattccctgcttagcccctggcaactactattcctataattatgtgatttcaagattgttatataaatgaaatgatgtagtataatatgtattgaaggtagatagagtgattcctcccacttcataattaattttttcaaatatatttagcaattctaatttttctcctcatatgaattttagaataatctatatatacaaaatattttgctgagatattttataggaattttgttaaacttgtaatgtcaattatgggagaatttacatgttttttatgtagtatcttcgaatccatgaacacaatatgtatcctcatttacttacatcttctttgatttttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccacaagggtccccagagtgtgatattccccttcctgtgtccatgtgatctcattgttcaattcccacctatgagtgagaatatgcggtgtttgatcttctttgatttatttcatcagtgttttatagttttcagtatacaagttagaactattgttatatttattatacctaaatatttttattttttgagtgattataagtgttactgttttcaattttggtgttcacatatatattgctagtatatagaaacacaatttattttgtatgtttatcttgtatcttgcaaccttactgaactcacttattagttctatgcactttttttatagattctttgggcttttctaaacagaaaaacctgtcatctggaagtagggactgttttctttctttctttgcagtcagtctaccatttatttcgttttcttgtcttcttggactggctagaacttccagtactatattgaataaaagcagtgagagcagaaatgcttgccttgtttctgagaatagtgaggaagcattcagtcttttatcatcatgtgtaatgttagctgtaggttttttgtagatactcttcatcaaactgaagttctcctctatgcctgtgtttctgagagtttttatcaggggtaagtattgaattttggcaaatactttttctatatcctgtgtagttttccaaacttggaaactcttctgcactctagctgccttcacatgggcaagtgttttcatatcattctgtgttcctctgtatgctttgccagaaaggagttcaccttaaattttaagacaatgttgtggatagagaaaagaaaaactttctgtgtcatggaaaagaggtcagaatttgggccaagattttactcctggctcttttatcaggccaggattttactcctggctccttctatcctttgcatagtgagatcatattctctttgagtctgtttcttcatttacaaatagaagaaaaatagctgcagtgatgatcaggtgacttgatagaggaaatgcttagtcaatgtaattggtttatagatagtaattaatgtgagagttttccccagatttttatagtcttcctttatcatttattgctttaccacaataagtcatttgtcaaggaggaacacgtatatttccctagagaacacaccgatatgagaacatacgaagcctacactcctcattcaggaacaggcaagagacaagtgtacatctagttccaccaagaaaacacacacacacattaacataccagtaatagtaagaaagcttttatggagattctgaaacatctattagaccttgaaagataacttagtatttacatgggaggagacacacttcaacctaccacgttaaaaaagatcccctgagttgtatcctgagctgtcgtagataagtgtcttcacccctctgttactagcctgtgttcagtctagtaaaaagcctgcaatgagaaaggaacaatgacttctttggaaagagaaaagtgtatatgttttggggtgggattaagagaaacagagaaaccaaatgttcctatgggaagctggaacttactcagcattcacttgagaggaaggacaacaagcccctgtgcaaacccctaggaaatgtcagtagagtcaatttctgaaaaatagataaacagcttggtaaagtaagctaaagaataatagtgatacatcccagattttccaggatatttctgattgaaattgtccaattcatttttggtgatgttttaatttttgatttgggaaacacgaacactatacttctatgtttagctttagtgatttttctgccacaagcaatactctagactttagttgagtttttccctcttaattaaataattcttatttgaatatatttatgtttattttaaaaaaggctactgagtacgagattaccacttgttacgatcttgctccttggagcagaacgtgacatctcatatgtatatatacttagctctcttgggcaaaagcttctccctttgttccacatggtcatctgaacattccgtgaagcatttctatcctcccaggatgttttatttcttgttttcatgggtgaagagagactgttttataaaagttttcaaatacttactggatttgtatcctaaagggagaaagcagcaggtcattttttttttctttcaagggcttgctgtaagttggtcttcctcttaacacgaagaaaagaatgacattcttcatgaccgccattgtgagtaggctgtattacattaaagccccattattagcaggctgtgccttggctgattttatagagagctcaggaacagaagtgtagaacaaaaacactgatatttttcactggcacaaactgcagatactttacttgttgattaatttgttaaaatgtgtggcagaacatttagttatcaggtagtcattctgagtaaactagagtcctatgctcctttaacaatggaaaaattatattttcctttttctaatatcccagtgttgtatgtatgctcatttatgttcttggtttaacaggaacattgaacattccctcactttgaatctactctaactcctgtgtttgtgtattttcaccacagtaagccataatatataaaatagtacaattaagaaaaccttagccagcacggtggctcttgcctataatcccagtactttgggaggctgaggcaggtggatcacttgaggtcaggagttccagaccagctttcccaacatgcggaaaccccgtctctactaaaaatacaaaaatgagctgggcgtggtggcagttacctgtaatcccagctactcaggaggctaaggctggagaattgattgaacctggaggcggaggttgcagtgagccgagattgtgccattgtgccattacactccagcctgggtgacaagagcaaaactctttctcaaaaaaaaaaaaaaaaaaacttaagtaatcttcataagtaaatgatatatacttaaatacaaattatcacatttataaaagaaattttctgtatttgtccaacatcggtcaaattccttaatcttataacaattgacacaagaacaagaactgccacccagtccacatttatcttctctatcatatttaagatattgcagggctggagtatcttcttaggatatactttcatcacaacagataacctattacatcagagattcaaagaagtagaatgggagagagaaggagttatattttttttaccctaaatgatgtcatcaagtcactatgctaatggagattgctgcacttgagattatgtgccttacaaaataatttaataatgactttagacagctgatatttcccatatagaaaataagaattcagcttatttatattctggaaagaaccatatctgctgcttagagtgaagcagacctgcagtttacacaacagttgagaataatcttgtttaccaagctctttggataaatagaaaaatatccaccttatcttgagttgctgtggtaatcagctgaattagtttactacttaagctctctggaagatgattggtgcatcatctgtgaagatgactggaatgttagcccactgaagttataacttgtggaacactgttcaaattaccgaaaagagtaaatcaactatctgctggtactcagttctcagggagcagtttacaccttgaaaaatcagatccaacacatactaaccatagtttctcatgttatgatttctggtggaattcctttagactcagccttattcttcaagatactgaatttttgggaaccctaagtacagtttctccttcttacatagagacttgatgttcctaactggtcgcaaacttgggttcatcagaagaatctgctccccttgtgagcacaaataatatctcagtgaagagaaagacactgtcatagaagagtcaacatttatggaatttcctggaatccacagttatcttaaactctgttccactttctctggacaccagctaccttcaatagtgccaggttcagtgtctaaccatggagtatctcatagttggactgggtgagtgcagatgcagttgcatgagattttgaaacatcacattataaaaaaaaattttcaggtatgcaaaaggcaggagagaacatgtactccttaccctgctttaaaaatttctcaacattttgccaattttgtgtcatctattccccccaatcataacattttttgctgaaatattgtaaagcaaatccaaaacattatttcattttacctataaatacttcaataatttacatgggtttttaatggcttgctatttattttcagggtttcttttagtatctttgacctctgtcacagctcatcttgcaaggttgcctatctcattgtcagagagctctagctaaagctcattcatcgttttgtgaactatgaggccacatattctgtgttgacccaagttgggccagaaagacagttttcaagagggcatggcttctaggtctctgccgcagcttgtccactttctttcattgtcagctactagaactatggcagcccatgctgggatataatttttcattgggcacagaaaaagagggtggcgttaggcagaatcaaaagtaggagctaagaaaatgaaaaagacaaggcagaaaatatgccaaaggtgcatatttaagggataaggggaggaatctgtgatgttgaggatgagtccccttgaagtaggggtgcacacaagagtctcccaacttgtgaattactaaggacaccaatggtgaactaatttataatagttgtctcctgtgactgagaaggctgagagtggggattatcagtaagaaaatagctcagaggcaaccaagttgtatggatctttagaaagggaagcaaggaaatagacaaaggacaacttcactgaaaacatttatgaagtattcagtaatgttttaacttctttttaatgagaaacagcaaaccctaaggggaaacactctggggtgtttatgtccagggtcagcaaggctccagggttatgtcttattcagacatattcaggagtaccggggagagagaatactccaggaaataggtgttggcatctgtggaaaggagagaaagtcagactgtatcctagagtcttagggataaatatagagtggaaaacatgaaatcatcttgtgaacacagggcagctattgaggcttggcaggtaggttggggttattgtgaaaaagttcccagcaatccaaagagatgttttatctttgacattgtgccgcctgtgccttgagttagaaaggtacacacacgtgtgagttaagaaaaacttctgatactaaattatttatagttaaacctctagtaaaaccctgaattcaaaaatatttgtagcagaatacaaatattctttttgttttgtcatttatcctggtaaaagtcaagttgctgcagcgtgatggttctggtactgaaatggtcttaggaaagtggaggaggagtggagttacatgtttttaaaaacttgttttgtggctgcatagtattccatggtgtaggatgaagctggaaaccatcattctcagcaaactatcgcaaggacaaaaaaccaaacaccgcatgttctcactcataggtgggaattgaacaatgagaacacttggacacaggaaggggaacatcacacaccggggcctgttgtggggtgggggtaggggggagggatagcattaggagatatacctaatgtaaatgacgagttaatgggtgcagcacaccaacatggtgcatgtatacatatgtaacaaacctacacgttgtgcacatgtaccctagaacttaaagtataataaacatatatatatatatatatatatatatacatatataaacttgttttgtgaattttgaaatagttttacacatacataggcattgcgataatgctacggacagttcccacagtccctgttacctagtgtccatcatggaaagcatataacgtaatcatagcacaattatcaaaaccaggaaatcaacattggtaaatgctattaactaaaccatagatcttttccagatttcagtagttcttacatgcaatcattttcctttatagcatatggttcactgaaactttatcacatgtatagatttgtgtaaccaccactacaatcagaatggagatctcttcaatcatcccaaaggaactctttggtgcagtccctttgtaatcttgtcctttccccaacctaatgcctggcagccactaatctccatcattaaaaatttgtcatttcaagaatgttatatgaatagaataataactatgcaaccttttgagattgactttttttcccattcagcgtaacacctgagatttatctaagttgtgtgtttcagttgctgagtaagattctattttatggatgtaacacagattgtgtatccattcatgtgtgttgaagggcatttgggtttttttcccccaatttggggctattactgaaattatattttactgttttttcctaaatatatgaatctgaaagtgtatctgtatcatttaagacttaactccatgtggaattaatttctagaagcgtgaagaacaggttaccagttctcccaggattgctatgatgactaatttttagctgaataaaatatgaatatatctattcatttttatatgtgtcaagaatgtgctgagagttataggaaaacagaaaggtaataattgttaccaaatcatgaggagtgcccaagttctaaaaaacccacaaagtcaaagaatggtgcatggctatagtttcagaattattttctcagagagtgccagagccaatcttcttggtacctgagggtaaacacccaacctcttgttcctcacttagactttcttctatacttggcttttctccatgaagggtactgtttcagcacattggacagaaaaatacaagcacagtgcaaaaataggtgtgaatgttgtactgattcaggtaccagtatgtgttttgaaagttaactctgcttttctagtgatacttactttggataaaacctaggtcaagcctgttcaaaactgttacccgaaggcaattattcaacattataagcacatggtttccagatcattcatcattttatttaacttcttgagtacataaagtttttatcccatttgtgagtcttgatgcacacaattgactaactgtgtttgggttattttctcttccacattgggaaaaactatctttcatgatctatctcccttttcaaagctgttaaacttttgtcttctttaaatgattttctgtgatgatccagtgtttcttgtcacgtttctgtacctatatgtgctactgttgtgtatttgtttgttcatcctgcctctcccacggaaagacctgtcttctgttcttcgtcaccaagactctctacacagtaagggctccatctgttttgactgttgacctactgaagggacatgcctttgcggacagattcaacacaaggttgaggattaaacccaggcttattttccttcggattttctcaacaatccttccatctcctagtagtatctattctcttctagcaactttttttttaaataataaaattgccttggtcttctaggaccctctgggaaggtaggtgtcaggatggaaagtaggttggtctgatcaagggagtcctgtcatgggaggtgagaagacctgggatctggtactggatttgcttctcactcctaacatgatcatgaaaatattttctgcttccttccttattagcaaaatcaggtagatataaaaggctctgaagcagactgggttgttgtaatggcaaagggggaacctaaaaaattctggactgagatgtgggagtcacaccattgtccactgcagacataccaaacaagccaccttaatttagagcacaggcttgtgagtctagtgatgctgttcaatcatacattttaatctctataaaatgtaatctcctatgcacaaaggtagtaccaatagcacttgagtgcctcgaagagagttttgcccaaaaagcagcagacttactgtatgatatgtccatctgtgaaggtcctggctcagactgagctgacagtatggaagtctactctaatgcagaaaggttggaaacctgtaattattgttaaaagtttagggttgtggaacctatttttatagcaagacaaacttgctctggtattggcccatggatgggtaaaagaaagtaaatgctttcaccttttaaaaaggggaaagtgtggcactgtcagcatggctcagtgctcactgtcatcctgctgctacatcatgtgcttgatgcactgtcatttgggtgataacatcacatttaagtcatgatcatttattcccagtgtcagagtgaaggagtcctgttcatttgagtttcagtattcctcaaactggatttcaaaaagaatttcttccaaaagaattcatcaaggactaccgtaatttcataccaggaagaaaactgtcaaaatatgtcatgagtccaactaaaaacctagctcaaaccatcatagtctctcatccaaactactaaattgacttcctaactaggttcctgcattgactcttgctcctccatagtcggtgctccacacaacagccagagggatcttttaaaattaaaattctgttgaaaatataatacccatcacaaagcctttggcagttttctcttagaagtgcatgcttttacttagcttcaagcaatagtatcttctacctgtaggtcttctctctccatatataagtccttcctatcttttcaaatccagattttacattcgaatatccttcaggagatgtttaatgatccccccagctgataaaagttaccttctctgagttttttatgacacagtatttgtatattttatgccatgtatcagttttctaccttgtatcatagtaatttacgtaccttcatcctttctctactttgaatttattgaggacagattctgtgttttacaaatctgcattgggtactcaataaatatttgtgaaataactaaataaatgagctgtgttaaaattaaaaaaaaaaagaaaaagaagtgcatgcaataaaaatggcttgctatggctcacaggaaccaagtgtgatctggcctgagtcagtcttttcaacttcccctcctgccactctcccctttgctggctttcctccaagtacactggggtttttacttttctttggatcttcctcagggcctttgcacttgtggttgcctctactgggcacttcatattcccccagatttttgcctgactcccctacttcatttatgatcaacatgtaatcactccctcattctttccttattctctatcccttaccatgctttatttttcttcatgacccttatatatcttagatcataatatatatttatttgttggcttatttcctgccttcctgtctagagtgtaaccttcttgagagcagtgacattgtctttttcatactgcatcccatgcctgtagtgtctggcacagaacaggtttttgattaatagtctttgaatgggtgaaagagaatagaggtatctggcatagtcgggggtcaagtcagcctgaggtcaaatccaaatcttgtagattcgggatattaatcatttgttagatacatagtttgcaaatattttctccaattctgtaggttgtctcctcactctattgattatttctgttgctttgcagaagctttttatttaaattaagtcccagttgtctgcaaggaacttagacaagaacaacaacaaaaaacaatcccattaaaagggggctttaaagtacacgaacagacatttctcaaaagaagatatgcaagttgtcaacaaacatgaaaaaatgcacaccatcagtaatcagagacatgcaaattaaaaccacaatgcaataccattttataccagtcagaatagttattattaaaaagtcacacacacaaaaaaacccaacagatgttgatgaggatgcagaaaaaacagaaccattatacattgttggtgggaaggtaaattagtacaacccctatggaaaacagtgtggagatttctcaaagagccaaaaatagaactactattcaatccagtaatcccaccaccagatatctacacaaaagaaaacaaatcattttattaaaaaagagatacctgtactcatatatttatcacagtactattcacaatagcaaagtcatggcatcagcacctaagtgtccatcatggaggactggataaggaaagtgtggcatatataccacagaatacaactcaaccgcaaaacagaatgaaatcatgtcttttgcatcaacaggtatgaacctggaggccattatcctaagtgaaagaactcagaaacagaaagtcaagtatcacgttctcacttatgagtgagagataaacaatgggtgtacatagacaagatggaaataatgcactctgaggaccccaaaagcacagaggatgggaggggtttgaggtttgaaaaattacatagtatgtacagtgttcgctattcaggcaatggtcacactaaaagcccagactcaccactacacagtatatcaatggaacaaaactgtacttgtacctcttaaatatattttaaaaatccatactttggccgggtgcggtggctcacgcctgtaatcccagcacggaggccaaggcaggcggatcatgatgtcaggagatcgacaccatcctggctaacatggtgaaaccccgtctctactaaaaatacaaaaaattagctgggcatgatggtgggtgcctgtagtcccagctactcgggaggctgaggcaggagaatggtgtgaacccaggaggtggagcttgcagtgagccgagatcatgccaccacactccagcctgggcgacagagcaagactccgtctcaaaaaaaaaaaaaaaaaaaaaaaaaaaattcatactttactagtgggcgattattggaatatgaagcatttcagtttaactttgtaagctttagtctttgtgttttaaaatgtgtctgatgctgtcttcttcatagtttgttaggagcactaaatgaatagtagaaagcctgccagaaagtgatttagtctgaatctataaagctgtttctgagcactgactgtaaagtgcactagaagctcaaatttttaggttttgtcattttgtgacaggttgatgtggaactcgaggggttggccaaagccctcagagggttgtaggccatgaaagttcgagaaccactgggccatgtccatgcaaaatgaaaaatagttaaattgaaaaacagatgtccttgtgcctcctaattcccagcaggggctcttgtctgaagcctgagatggctccttgggtttctgtgaatgttgtcaagggcgccaaggatgccggacttgcatttagatgcccaagcctctgtgctggaaatgatgggaaaaaataggaactcttgaacttgagcaagtattagaatatgtgaggtaatggagaagcctcctccctcatgcccatgctcttgtcaggcctgtttgttaaggtccaggccccacttcccactttttttatattattattatactttaagttttagggtacatgtgcacaacgagcaggtttgttacatatgtatacatgtgccatgttggtgtgctgcacccgttaacttgtcatttagcattaggtatatctcctaatgctattcctccccctccccctaccccacaacagtccctggtgtgtgatgttccccttcctgtgtccatgtgctctcattgttcaattcccacctatgagtgggaacatgcggtgtttggttttttgtccttgcgatagtttgctgagaatgatggtttccagcttcatccatgtccctacaaaggacatgaactcatcattttttatggctgcatagtaacagcaggttctggagaggatgtggagaaataggaacacttttacactgttggtggggctgtaaactagttcaaccattgtggaagtcggtgtggcaattcctcagggatctagaactagaaatacacgtatgtttattgtggcactattcacaatagcgaagacttggaacccacttcccacttttgtttcctttaattgcccttatgagaccacatccaaaatcccaagtcctgccaagtgaatgcagtacttaaagatttgactactggatgtctggtcttggagaaaacagtcaagagctggagcaagacagagagcagcatacctgtaatacagcttattaaaataatgcaaacacttctgtaatatgtatgaggtgccaggtagtctgccaagaacttttcatctattaatttgtttagtctttacaactgttcactccacttcctgttagggagatagctgttgttggacccaatgtagagatgaggaaacactgaggaccagagagtaggcatccaaggtcacagagttgggcatgcgtggggcagagccccaggctcaggcattctggatcccaggcccatgtgcctgcatggtagagggggagctggcactagcccttgtgcccccaaatatcctggctgcattgttcccctgttcttagttcatttgtgttactataaaggaatacctgaagctgggtaatttataaagaaaagaggtttatttggcttggaggtctgcaggctatacaagaagcgtggcgccacatcatctgcttctgatgagggccttaggaagcttccacccatggcagaaggaaaaaggaacagatattacatggtgaaacaggaaggaagacagagcgggggagatgccaggctctttttaacagccaggttggcagggggtgtgtggggagactcttgtgggaactaatagagtgaaaactcagtcattaccttgaggatagcaccaagccattcatgagggatccacccctatgacccagatacattccaccaggccccacctctaacattggagattaaatttcaacataaggtatggaggggacaaatatccaaactctattatccccataaatggttaaactccgggagagacaactatgcacctctcaatcccaaggtgagttgggattcacgattggttaaaacttcatcagaaccatccacattggaaatcacatctaaaacttgagtaattttatggtttacaaagcatattgacttccttgatttattcatgttgccagctgccctccgaggcagaggatcttttcacttttctcctattactcaatgccactactgagcctctgcactgaccctacggcttcctgtcgtactctctgcaatgctacatgtcccttctagtctagggcgatcctggtggaagcatgaagccagccagcctctctctggtcaccaccatcacttcattccttatatataccaggcatgggaatgtttcttttgcttgttaatttttgttcttgctcttatctgcatttatcttccttcccccaagtgtactgccagaccctggagaacagggaggggaattgtttttcctttattattctttcctcagttcctgctgtagaactgtacatctagtcaatgcttaataaatgctggtaagttgaattatcaacactgaacgtagaaatgcactgttgcctggcttgttagttttgtaagaatagggataataatagtagcaactaatgtgtacagatttgactatgtgacattatttaagggctttgcacacattaatccatttaatcctctccatgacctaaagcactgctatgctgaagtgcattttgcctatggagaaatgactggtttttgggaagccaatgtgcagaaggccttgtttcactacccctaaaacagtgcatgtgcaggaggactgttattgctgtgctttggaaggtctgtggatgaggaaatgtagaattgcagatttatgggttggaagttgatttagaagacacatgtaacagaagtaacaatcttatcagacttaccagtgtcttccacttatttccttaacttcagatgctcaggaacgacagcacctgcagaatgcatccactgctgaaaaatgagagctgtttcttgttggtactcttcagggacattttagcatagtggtggactccagtgttgacttttcttttcatcatctgtttgatcttggtggattcttaagaatctctggacctgagtttgttcatctgttgattggggttcatggtagccacttctcaaggttatgattgaggtgaaatgagatgctatgtgtgcaaaggacctggtagcaagaatgacatgggaaggagggcttgctcaataaacattgcctgttatagtgtgctggcattaccttaaaatccttaataagctgtaagttttggatgagagtcagaagtgttgggttggtgaagcattttgctacagattgcaggcttttctccggtgtcacaaggcattgaaaacgcttgttcggagacagcccagaagggaaaaaaaaaaaaattctggaaagcctggcattttgtgctatgttgtgagtaagacatttatagttattgagccaaaatttccactgtaatagaaaaagcagttgcttttaaacttctggtccaatttagtaattatgggtgagttaaaatgtaggccatttgaattggatttggaggatcaagtaagattctgtcctacagtggggatgactcatagaggaggtagcttgacatagtggaaatagaagctgataaggagccaggagacccaagttcctgtcctggatttgcacaaataaactgtaatagcctttaggcaaattattaaacatctcagttttctattatataaaatgagagggctgtgtttgtgaatggatctttcaacatgcttaaggttataccaaacagatcactgaaaatgaaatatgttatctacagtcattagggaataaagtattcttgctagtgcaatatacttatttggagaggattacaacataaacaagaaccaacgagaatacatcagtgccagaatgatacagacataagcagacacctgaggctctctgatacccgcaggtcattgctatgtcctaggaaaacatagccatgctagttataagagttttctgatgatgagtctttataaacagaggatttactgggaactagagatggaatttttaaatgatttccatgttatggatgacctgtacttgggcttatgatagctctgccacatcttgagaaataatttattgactaaactcgagttggcaaatgtaaaaactcatttgggttagctagcttgtttacttgttcttggcattctttcttcttcttatttcagttgtaggcatgaagccacattttgggctgatcatctttataataggcttatggttttataacatcagattttgaatgatagcattttctgctctctgtgtttcctatcacctgtagaattaagataggtcaaatatggaacagatggattgaatgattccctagaattattcactgacattataagggtgcctcctgtggcacaaatagaaatatttctgagagttgtaaaaattaaatttttaaaaatcgaatccaatttttctattgacctgcgttagaatttctgagacattctatcttcatttctgattgattttcaattagcaaaggttcctgccattttaactttaaatttcttagttcccctttttcctccaagtggttaatgatctgtgaacaaatattggagcaaatcagagatgcttcagtgtacagtcaccctatagatatttctggtgtgcaagggagtgagctacctgggagatgaggaaccttggttctagtgttttctctgccaccacagaggtatgcatctttgaataaggtctttttgcctgtttcaggcaccattctctcatttgtaaattatgagctccattgatcctatctggcttcaatattctaccgacaattgagtgggaaaaggaaactttctctgaatcataatctctcaacttttcttttcataaattttcttaaagtggattatacctatctgtaagtggataacagcctccatttattatccttatttttatttggctttttttttgacttgcaaattcctttttggatggattagattgaaaatctttgggaggctcaatcagcccagacagatttattcattctttattctggatgaagaagaggaaatagtttaagatagatctgacatggaacattaatttgattgaagcctttctgtgtgaggagtaattgtagcatcttcattgtcataatggagagattagcatggattagattagcttgtgtacaaaggttgtacaaattgattgctgtgatttgtaggctgggctgatctttatagtcactggcatgacttcttaagcattatagtcatgatttctttcatgtggtttacatgtggcaacaagaaaagcacatttccctcgttaccaaaaccttgtgtctcccaatgggaacttgacatagactcaaaaacataagacgtgtacatataatattaaggagatggcactggtcatctggcctgctgtctgggatgacagcacacattggccaaagacagaagagttcccaaaacagatgttcagagaagatggctagaatactgttgaaatgtggtctagaataattatgaacataagcctaaaaaggtagccaagatatggctctgaattatagccagtcatgggattattatttaactccagtttagtatgtttcctgccaagtatgtgccagaccctctgaaacagaatctggtttttgccagcagtgcttagcaactctatattttaagtctaaattccaaaaaaaaaaggaagagtaaagaatactaaactgctttctgatgggagtaagttgtatttcaagtggcctcagaaatctttttctctagaggagactttctgtggctaagaggaagagagtgggcacttctcccctccactgaacccacctggacttggtctctctcccaaggctttcactgcaattgaaaggctttttcactgccctaggtctctctcctaaggctttcactgcaattggtacatgtgttcagtgactattagaacttaaatgatcactctcatcccacctcactgatctcattttccaaatttctccctcttgctctcccattctagggaatctggccttcttcttggtcttcagatgcactgaacatcttcctgcttgaggatgtttgctgccttaccttactctgctggaaagcaattccttccaatggtgcaggtctcacttccttacttccttcagattttcgctcagataccatgttattcatgaggcttccctggccaccccatttaaaagcagcaccccaccagcattgcctatcacccccaccctgctctgtattacctgataacactaatgaccgtctggcagattatatctttatttgcatatttattatctgtattctgtctttagaatgaagacagaggctttattccagtgactgaaacaatgcctgacatgtaatggaactcaataaataattgttgaaataatgaatgaataaatgattagcctttaatttgtattcattcgtacacattacattggggttttctagaagacagtatgaaaatttcacttaatttgtgactcaagtacagaaagaacgatagagatcagaggttcttaaacaactatccatgaacccaacgctgtgctttacaaaatttaacgtgcatgtgaatcgacagaggatctcgttaaaatgtgaactgtgatttagtagtctaaattggggtctcgggttctgtgtgtccgacaggctcacatacgatgcggatgttgctggttctaagattgcactttgaggagaaagactctaaagtacctgtggaagggattcaaggggttcacaaagccagggttatgaatgtccagtatcattgttatagcaaagaactgaagtgctagtttctagaaatttctggtttatgcaataccaatgaacagatcatttattggacattcattgcagagctttcaactgttaactatgcatggttgttctgtatgcagacataaatataggtataggagaatttctttttctgaggaaataatagaaaatattcatcagtttgtcaaaaggatcagtccaaacaatggtgacagccattgttaatggatgatggcattaaacaaaagaaactttaggtatcaaaccaaaacacatcataaccacatcgtaaaagtagtgacaaaaccaacacatatgtttgcaaataccttgggaagattgtgttttatagcaatagtttttttgctaaacaaacaactaacttttaaagttaacatttgctggagatgatattttcccagggaagtatttaaatgcttggaacacacctatccaaagacaaatatttgttttcccccagccactggaaagagaccccaactggaaacattgtctagaaatgaatatttggaaactctgaggccctctataaatgccattgcagtagctcactgtccttctaagctgaggccaaaatgccctcaaaggggccttggtgtagaaaagctgttttcaggcaaaaaaaaaaaaaaacaaaaaacacaacagcccatcaagagctgcatagcttttcagtcaggaaacttacccccaggtggatgtttctcagccaaggagtgtgggcaatttagtttcaaaagtaatttggaacaactgagatgttttatattaaatggtcctactaaatagacatctagcacagggcttagccaaattctagaaggcctcgcatggtatggtatcacgatcctcataattgctaaaaatattactcataatcataatggctaacaattattgagtctaaatatatgctaggcaaggtgctactaaccttccatacattttcttatacaatatttataaaactaattcggatggtactataagtttttttgttttgcagaaaaggaaactaatgcatggatatgtgatttatattgctcaaggtgacaaaattgttgagttgtagaattgggactcaaattcagatatgctgattccggggctcatcctgctaatgactgtgctgtactcataatcataacaaattgatttttggtgaccttgaaaccctgcttaggaaactaaattttaagattttggttgaatttaccctcagggtggagaaaacacaggttttcataaacttactgtcatcaaattaactatcctatattatttttcagaataaacactcactacttgttaaggaaatcatggtgaaacttattcatatgagctaagagcttctgcattcccatttcatggaaacgtggattttccacgtgtggctctgtagcatggcaaaatagcttggtgtgcaaaaataccctagggtaaagataaatgtaattgtttttgaaatcaaccacttgtccctaatgctcaatctgtgcttctgagaatttgccgagtttcaatgctttaatgtgtgtattgaacagggctttctgttgcaaatagcagaatttgcacacgctagttgaatcagaaaacaataacgtaacaacagatactaataaacacgtagaatctcggagagtgccaaagagcagggttctggggctacacagccacaccttaggacttctctctaatcatatgacttctcagcacctgtgatgccaggacttggcctcccaaagctgaggaaccaaatgcctcaccaactgctcctgccagaaaactggttctccctggtttggtgcccatactctttgaattttctggctttaaaaattggactcatggtgtgagaaaattccaaaatgtaggaagatcttcaaagatgttgagcagtcaccacgaggaagcttccaatgttgtgtatttcagatcagtgttgtggagtatctttccctttatcacacttttccttcatttttactccctttgattgctaaatctttacagagagcagggactctgttcattcagtccccagaatggcaatgtgttaagtccacaagaaggcttttcgtggacttttggagtctgatcataaaggagaaatatgtcttaaaaaggcagtggaggtgatgtggtgaattttgtgcttagcatttttaacttgagaaaaatgataagacaggccagtcaacacacaatgggcaaatggagataggtgactgtaattcagaagtgcacacaggactccaggtttgagtatgggagttgtccttcaaggattggcagttgaagcattcaccagagcatggatgtgttttctgagcaagagctgtcaataattaggatagaaaactgaacgtggaaccctgaagacctctcaccctgtgccaaagtccaggtgcagaaaagaaaggtgagcttgtgataaagagcaggcagagttcagaagacagccatattattttggtgtcataggggttaaaggaggcaattcatgagaattgattgcttttttctcactctttattgagatatagcttctcaaatgtaaagcatgatttgaaagagatcagtaacaacagttatgcattacatttgaggtgtgttttgtacttttcaaatttgttttcaaatccccatcacttcatttaacttcattcagacacttaaattgaaaattactttctatgtgtggttaaaaaaatcttgcattatttttgtttttttctttaatctaacttaaacatggaagaaaattcagttgtgtgtagttaatcacaggtttgaagaaattaccttaattctattttgagaaagaaagagtatcatgtggtatacagagtgaaggcttggatacctccgttgcacaagtttcctgcttagctgggacctggtcaggccacttcacctcccatttaaaacatcctttagaactaggtatggagctaatgttttagatatgaaaaataattattcacagcgtgttactataaaacatatgttcatagattcttacatttgtatacaaaacaagaaatcacaaagctttattcatgcagaaaaaattaatttgaaaaagcccactgtatgccaagaaatattcttgatgcttggaggtttggggttgaggtagcaatggggagataaaatgaatatggcttgcttcttgctttctgcaaagaattgagtttcgattctgacttaagagacataaacaaggaaaagtacattctccatgctgcatatgtgtggcttaggccctggcttgatgaagggagatttggtattttgttaatgtaggaaaaactaaaccaaagtgtcttttctattctctcatttaacagtagtcaacacagaagacttctgtgacctctagtcaccaagaagtgtgtggggatttctcactaccaacaaataaaccatcagttctgcagctgacactagctgggtgtcctctaattcaatgctactctgacactgtctacctggagatacagtcagatccctcagcttgagagctcagtccctaagactgtttcctcccctcactgcagatgccagtcacaagctccagtttgttgcgtctgtgcttccagccagctggctataaattggggttccctcaacttcccccttgggtttgattaagttggtagagtgattcacataactcaggaaaacacttacttacatttaccatttaccagtttattatacagaatattgtaaagaatacagatgaagaaatgtgtaaggtaaggcatgggtggtgggggacagagcttctatgcccttcctgggtgggccgtcctccaggaaactctgtatattctgttacccagaagctctctgaacccaatccttttgggtttttacagaggcttcattatataggtgtgattgattaaaccatcggaccctggtaatcaacttaactttcagcctctctccatccccagaggttgtggggtgaggttgaaagttccaaacctctaatcatgatttggtctatccagtgaccagcccccatcctgaagctacccaagactggcagccagcagtcaactcattggcatacaaaatacatagtttggaggctccactgattttcagtgtggtaccccaggaaagtggatgaagaccaaacatgtatttcatgaagccttctatttcagtagtaagaaaaatactaaattataatacgaatttttttataccagcaaagcagttgcatttgcatctttaaaatgcaagtgcaacttctttttagagatctattgcattttaaagatgcatttcatcacttattacagccaaatgacttgcccaggcattagattttctgttgcagtgatagcagggatttaaataatgattatcttctctttgacctggtgaatttcttattaccctgcatatagacatggttggattgtactgactttgcaaataccacacaactgaagttggatttctgttgtccttcaatcaaccatctacctaagcctcaaaccgttttgttttgcttaaaaacagaatgagtttggcaaacctagaaaagtacacaaaggatcatccatggatataggatggaagatgtatgaatatggaccaacaacagtgtttattttaataattctaatattgttataagttgtcataagcttattttcgtaattagagaatagtcttcaatttacactgaatgcatgtttggcaaatatactaatgttatatatgtacttctcttgttcagggcagtcacttgttttaagtaacatgtttatctttattaaaatatgaatttcatgcggttttacagcaaggttattggttaaatcaatattctcaattaatgaaactagtgacatcatcatcaagagcaatagctagcatttgttgaatcctgactatgtgtcaggcattattttaatcacttcatatattttaactcatttaatcttcacaatggctctactatatagaaacatgtattaacccaattttgccagagggttgagacacagagattttagggaacttaggcaaagttacatagctagaaattacagtcagtgattgcaaagcttgtgctcttaacttctattttatcttgtatctgtaaagatatttactaaccaagttaagtgtccttagagcatatttttatagtataaaaattgggaaaaaattaagataaagaaaaaaacccataatcctactgctgaatgagagctctgttaacattttgaggtacacatatttaggctttttccctcctttacatacattcacataatttgtattataaatgctcttttaaattaattttattcaattaatatattttaaaactttccccatggtattatttcattattattttaaatggctacattaagatatggatatttaggcttgaaataagtttaaacaaacctattgtcttcttaaatctccagtcatatttccatgaaggatggcagctcttagaagtcatggaagcaaagaacagtacccctcaggaccattgtaagaaaatgtcttctttgagagttcttaagactattagcacatctgaggacattttcctaaggattcatcttggtgtaaggacacactggggatattttaatttgtagtgatttgttgttgttgagcaataaacagtatatacctcttgaatttgctaaggaatgtgtgagcatacagtgctggtaacactacattagttaactctctttacctttcaaaactgatttaatgaaggtattttaatgccgtttcatagataagaaaatgaagtgcaaagtagttaacttgactaacaacaagtaagtgaaggagacataatttaagctttagcacagacaatctgtctcttatagtgaggcagtataacaataaatatgtggaggagatttctaaaatttccagtgtatgttaagaaaacaatgtattttatgatgttttagagaactgcccattataaccaactgataatgaaattcttcatctttccatgctatcatatttttcccttgtcagcacactgacctaggaatcaagaaattttggttctaatactcgcatttccacctttctgggtctcaagtttttatctttaacataaaaggttagaaaacttgaaaatcttaaagtctcttcttggttcagagagattagctttatggagttgtagagcctgtgtagaagctttataaagtggtttagagtcaattgacctcattggagaaaaaaagtagtcagtaagttcttcacctctgcaaagtgcagactgaatgtggagaacagaattgttgttttcttagctgtggctgtagcaggctgttactgattaccctcataagatgttttgaatttgtcttggaggaggtggctttcagcctgactttcaggctggctttgggtcatcctgagtaagaacaagactggtagtatatgctgccaaatgtaaaattatataactgcccaggagagctgtcacacgtggaggatactagaggctgccatgacaatattagccaaaaaatgataaaccacaacgtgatagaaggaagaatcctcactttatagttgagccccgagtaagtgaggaaagttgtgcaagtttgtaacttcagtgtgatggttgaggatggaattaaagtctcctgactgcttatgaaacctcccacctatatgtttttacgcaaaatgtcatggcccttacatccttttgtttccattgctatgatggttctggattgtaatcctataagaatatgatcacttaatgaatttatgttcattatatttcatatgcagcctgaaatgcctctggtttctttattagcaaatcaacagaaaacacttgataaccagattcaagattagacagcaaagatctacagaaacagattaatatcattttatggcatactatgatctttttttagggaattaactaattactgctcaaggaagcatatccaataatatgcgggtaaaaggatataagcaaaaaggtagcagtaaatagctgtgttttggattccacaaggcttgtgttaggtgaggtcttattcagcatagttatgatgtggtaaagagagtacattgcccactaatacacatttcaggcattataaattgggaaacttgcaaatgcaaataagaaaggatgggtaaaatcaatatgcttagtgaagaagggatcttaagaaatttttttagaaaggatatgggaccctaaaactattgaagtaacaagaaattaggacaagaaactaatatgggaccctaaaactattgaagtaacaagaaattaggacaagaaactaacagtgatagaggaagggtactggcttgttagatttgggctcaccgtttggcaatccatctctaaaccctatcacaacttatttataataataatcttggtgctgatcatcataatctgggtatgcagatttacctacataattttaggcaaattggttaacccctctggacatttaattcctcatctgtgaaggagttacacaagaatacatttattggtttaaataactactgttcaatagagaatttttaaattagcatctgtagctctgttaggagggaaaaatgatgatgttttatgatttcaacacatgacttcatttctttgagctatgtgacagtcatgctttcctccattattcatcaatactccccactgcttaaagttgcaaatatctagggctgggctacacaaagggaactgagagatagcccacccttccgtgcaaattttattgataagagtgatgtggtccagagacatgagacaccttgtccaggggtggttaatggtggagcctgaaggatgagcaggtcatgattctcagcacagaactctttttctcttgtagaaaagatagcaaataggctggatgaggtggctcacacctgtaatcccagcactttgggaggctgaggtgggcggatcacttgaggtcaggagttgagaccagcctggccaacatggtgaaaccctgtccctactataatagaaaaattagccaggcatggtggcatgtgcctgtagtcccagctaccgggaaggctgaggcgcaagaatccattgagcctgggaggtggaggttgcagtgagctgagatcacatcactgcactccagctgggtgggagagtgaaactgtgccaaaaaaaaaaaaaaagaaagaaaaaaagaagagatagtgagatagtaaataggttttcctcctcatgccaactcagatcagttgatagtacctgccagttgagaaaatttgtaaggacgtagtacctaggtactacataaaacactattgctattaataaataattatcactatcagtaattattcattagtactgtctgctatattaacaccatagggaaatagaaaatgtttgccacctcctatcaagaatattctttaaacatattccttcaagataaacgttcaatatttattctgcctttcttgtatctctgtcactcacaatattacctaatgctatctaatgtattctgttcttagagaagtaaaatgtctcagtagaccaaacttagatttgatcattacgaaagatgtcattctcagtggctggatcttcatgaggttttcttgagctgtttttcatttcacctgctgctggatgttttaggctgctgtattcacatctggtggcctgtctcactaggatctcatggctgcccgggcagtgtcacagctctgagttcaggttggctctagtcttgcccttcgctacagaatcgtggaatacagtgggagatgaagaaggcagcactcttgccctttgtgtttctagtaacttaaattcaactcctggcagcctacttcacattctgatttgggcttctgatgttgagtgctgagggaagctttctcccactgcttacatgttctagctccttggttggctccaaggagttgtgatggaatttcttggcatacttcaagccagcagcagccaggttggccttttccctccacatcttatagctttgtaggattttgggagaaaactgacctggaactagttacatgacctttttcatttatttgggtcttagtgctcatccttgtcacctcttattatttagaatgaaaagcacattactctttaaggaactagagtataaattcagaaacctagaacacatatattaatacacagaactttttctcttttcctagctgttcaaatgtaatacagttttatgttcaaactaaatgaatgcctatttattcctggaagtaaattttgttattttctagtccaggctctttgttttacacatgacaaaatagaagcccagtacacaggagggttgaatgacttgtttaatggcacatggccaaagaaacagaacagaaaaaaagaaatcagaatttgtcagttttctgtctagtgcattccaaatcacatgacacaaccattattggttttagaattggaaaagtttggtttattttttaactgactactcagattttaaaaaaattgtttcattaatagattagtaaaaatttaatactgctgttcattgtagggcttagtaagccattactatgatagatctttatttttgttttctttaagtctgtactggacattgaagtctctctatggtctctggacttacgtcttggccttacagactgtcctgtttcacctttgcctcagtctttgcagtaatctccctcactgagaagtctggaacatgccacatgttcacagtgaggctgttaaaacttccagccccatccaaaacctagacttggaaaccattgtcgcattgctttctgagtccacagatagcaaatgtgacaagtcaaaaatgatgcctaatgttgagcaaggagtctttaaaaagccctactcatgtttctaattctcacacccatgtaattcacaggcatctgtccacaggtagtttgagaacctaactatattaaatttcaatattcagcaaatagctcataaccaatcatatctgaattagaaaagcatgtgtaaagaacaatagcaccaactagcactcatagcagattattccagctatgttataataaggcccttggcaataactcaaggtctgttttttcaaaatgtaaggattaggtgttcttgaggcaggaaagaaaaacaagactattctttgcagatggagaaaaaaatgaagtagattcactagcagagtcactttcatggaaatttggagctctgctgcacagttttagtgtttaaacaggattggaagtcctttgggatgacattttcaatgctgaaagagaaacacctgatagaattgagtctcaatgaaacagaaaacctgctgaattgaaaaggggcttcactcagtgactaattttctaaagtgagtaccccaaactgttaataactattttaaagcagttggatgactacattcaagataaaaaattatatgggaataaaaattgtcaatatatctgattttggtaaaactaagcacacaatttaaatttatcttggaaaaccttagtagttattggaattacttgagaatctattgcaagcaatctaaatgaattcttccaaaacatgtcactggagcaggtactcaagaagtaatctgaagtaaacaaacaaaaacaaagctatatttatccttcctcttttctgtgtaatataatccatgggaagacaagaagaaatttattttctacttgtgagatttggggatgatgatgctttttctatccttatcaccatttgtcaagatacaactttcattactttccagtaccacctttgaacagcatcttcttttttagtatattctcccttcctccttccatctctccattctttcttccctcctcttttcttcccatatttccttccttccttctttctttcattttctctctctttggaatctcttctcttaactttatgttttccccaagtgatcagctgtttttatacttctctgctggttcctcctaacagagtctttgcagattttaaagtaaaaccataaagaagaaaacataaatagaatcttcagtgatttcacagcagaaaggcatggtttgtattactttctctcagaggtatttttaatggggtaaatatttatttccagatgacccaaatctctttgttatgtttgctgacagaaacagcagctcctccttctttctctctacagtaatgagattatggacagggatagaccttcttcatactgctctgacaacagacattttataaaccagggacgggctatttcaattcagtttaattcaaaaaaataattattggatacttaccacatctaggatattgttagctgttataaatgatacaaagataattaaaacattgttcttcctctcaaggaatttgtaatctagtatgagggaaactgtgtaaataaatatccaatcctggatgactgccacaacataaaaacacacaaatgtttaggaactcggtagacaagcaaaggaagtagaatagtaaagatgaatgtctcctatttgtcaatattttacttcacctctgtgttgttttgggatatatcaaataatgtcttttaaatttagagttattgttactttataataattattattattgtcataggtagtgttaggttgtgtcatttatgtaaatacttatggagtagtaacatgatatagtagtctacctcagaaagagatttattgagtctatgatgctgaattatagttttgtaatatgtttctaaattctttatgatggagtcccactctatcacccaggctggagtgcagcagcacaatctcagctccctgcaacctctgcctcctggattcaagcgattctcctccctcagcctctcaagtagctgagattacagtcatgcgacaccacaggcagctaatttttgtatttttagtagaggtggagtttcaccatgttggccaggctggtctcaaattcctgacctcaagtgatacgcctgccttagcctcccaaagtgctgggattacaggtatgagccacggtgcccagcctgtaatatatttcattccaacttttagatagcttctttatcaggtgctgcaataaattgtttgccctagatcgaggtggggagagagccctcttaggatgagctgtcacacagtaaaagataagatttcctggatcagttttctaaagtgacaggcgtgtcccctaatcgagacagacagtgctccattttgacaaataggccagacttctacgtgtgcatatttgttttgtgtgtgtcagagtgagggtgaggttgaggagtcattctgttcttattggaagtgaatcaggcataaaagtgatagagcgcttgaatgagatgattgcagttgaaagacacagcaattaagcagatttcagactttagagagcatgtcttccgggagctatccacggtactgaactgcttctccctatattgtcctgtaaccccgcaaaacaaaccttcaaacattttaaaaccacaagacattttaaaaactggctttggttattccttactagacaaattctctaacctgtgtatttctaatacttgttatttgtttaatcttggctaggtcagcccatttttttttgtttgatattacacattcatccatttatttattcaacaaatatgtaggtacaatcttccgtatgttgggcagcctcctagtggttaaggtgcttaggtttcttattatgtaatgctaattattattacttttgatttttctgggatttactctaaggaagcagatttaatgattaaaataattctacttcgtgtgtgttgtttgaagaacttggtttctggcccaaagatgatgctttgtttacagtacctagaacagccctttggcgtatcgtagacactcaagaaattgtattcacagcataaacatgtttattgttgtggagtgattttctatgaaatgttacaaggaaaatatatattttaaaccaacaagtaatctttgcaaaaaaaattttgaataagaaaaatattgttctaagtaatctagatggagcatacacctagccttaaagagtctagaattgacatgttgggacattctcatatgttaagaccacattacaggttgaccagaaaactaggaagaaatagaccagatacttcctgctcaggcttttatgtgcatatagaagctcagtgatctttttattctgttttactcaggctattctgtattcaggtaggatatctatcacccttactcttctctaaccccatcttaaaaaacaaagcggcggggagtttttcttttgatatcagcaacagataaccaaataagatggcgtataatcttttttttttttttttttttttttttttttttttttgagatggagtctcgctctgtcaccgaggctggagtgtggtggcactatctcagctcactgcaagctccgcctcctgggtccacaccattctcccgccttagcctcccaagtagctgggacgacaggctcccgccaccacaccaggctaattttgtttctgtatttttagtagagatgggggtttcaccgtgttagccaggatggtcttgatctcctgaccctgtgatctgcctgcctcagcctcccaaagtactgggattacaggcgtgagccactgcgcccggccagaaggtggagtgctattcttaactgtccttttgtagttctttgttctaagaatttggaaagacaagttagtcctgacttccatggaaatgttttttttccaaccaacatgggtgtaattctgaaggagaattctttcttaccagtgactcagtccctctgcagggcacagaatcaacagtattcctagtgtttgcaagatcagtgattatatagggtcagtataggcaaactctccatttccaatccgttgttaatgaaatgttatttttggtgaagttctgagatagactgaatctgagcagaataaaaaaaagtggaatcagcctgagttctagcttctacccctatttctgtgatatgcttccttattgacatgtgggctttgaaacttggtaacatccaaattgtattatcactctcttgaaaatgtcattgttccatgaaattgtgagacttaaccatttttattgatatctcagagaaaccaaatcttgagaactaagagcattggaggataagctcctttcctagagatacttactctacttttggtcatggaccaaatttggagttattcctgtggatttttttctcttgttccttaaggcagtgatagatgcttgtttagtcaccataagttgtgagaatatgtggtctcaataaagacccagcaataccttgtttttctactcattatccagccccaaagtttaagatctaaatgtttcctggtgagaatacaaagaaaagtgagctcttatagcctgttgatgggaatgtaaattagtgcagccattatggaaaatagtagagaggcttctcaaaaggctaaaaatagaactaccatatgatccaacaattgcactattgggtatttatccaaaggaaacaaattcaggatattgaagagatgtctcctatttattacagcactattatttatttatttattgcagcactgtatatttatttattgcagcactatttatttattgttaacactatttatggcagcactattcacaatagccaagatatagaatccacctaggtgtgcaagcatgaatgaataaagaaaatgtatgtatacagaatggcttactattcagccaccaaaaggaatgaaattctgtcattcacagcaatatggatgagtctggagggtatcatgttaagtgaaataagtagggcatagaaggataaatactgcatgtccttacttatatgtgagagctaacaaaagttgagctcatagtagtagagagtagaattgtggttattagaggctgtgagggggagggggaagaaaggagagggaacggttggttaaggaaaggagaggagaggttaagaggttggtgcagggttatagctgggcaagaagaatactttctagtgttatgtggcactgtagggttaaatacagctggagatgatttatttatattttcaaagatctgggggagaaggttttcaatattcgcaacacagagaaatgatgaatgtttgaggtgatagatacggtgattaccctgatttgatcattatgcattacatacatgtattgaaatatcactctgtatactataagtatgaataattatcatgtgtcaactaaaaataagagggaaaagtttcaaaacaatatctatttgttgattccatctgtatggcttagtgataatgtaatcttttgctgtcttgcattgttcccatactggatttcatgactaatatctttgcctttgactgatttgaataaaaatatgttaaatgaacagagaatcttgacctcctttcagaggctgaaggattccttaatttctttcctccatttgcttaggaatcagtgccattgactgtttgcttttagttaatacggttttgtttgcttaatacagaatatgtgcaatttaagtgtcatatgtacataataagatgtaatcttttaattatatgatatagcataattatttccattttatatatgacaaagttaatgtttaagaaagttaaataactctaattaggagtcaggattgagaatccagacacagatggctctgacatcagaatcactgctttaaaccactcttcttttctgcttgctttaatattcctttacttcctccataaagtgccacatcagaatatagaacaggttattaatggaagaaatatttcaatattttgagttttttgggtgaatgaaaattatagaattaaaagctgaacatcattttatttggcagtttcatcattatgatttaaaataaatgcagtttttgaagtttcctaatttattctcttgaaatatatttggattgccacatgctgtatattctaacacttggccctggtagggtttatttgtatatgtgtgggtgtactttaaatataaagatctcactgattttaacacacattggaaatatgcataggcaaaccccaaacaactttttattcaatagtgtccatgtatctctaaacttttgatagaaatttgttccaataatggggttactacataagttgaagaaagtcaaactgaagcaaaatttgaaggcttctatattaatgatcagttttaggcgatacttgccaaaatctagttcaggattagaataggctgtgttgacattttaagtgagacatatcagttactctttttcagaaagttaaaataaattctcataatgaaaaaataaatgataattttagattcttttagagaatttactacctttacaaattaggaaaataatattcacagtatccatgattccaaccagttaacatgttggtatatttctttcagttatacacatacacataattaacatataattatatgaatttatatataattttgcattctaactttctatttgacataataacagtcttattttgcacttttatgattttccaatgagatatatctattagccatttctattttttgagttgcctgtttttttgtgtatgcatagatatatgtacgcctgtatatatacacgtatgcatacatatatatgttttttgttttataaaaagagataccatatttctattaataccgtcacagctctgatccttctttctattgtagagcttctatgcatgtattaaaatttaatttagaaccaatcaaggaagaggtcaatctgaataagataatatttgtaaagttcttgcctgtattatgtatagcaactagagctactttatccacagcgatttgaagccatgttgaacctatacaggttaattgatgcaattctcttggaaacatcgtcatctgttggcctataatgttttaaaaaccttggaacagtctcattgttttaagtatatctcctagttttttcctttaatttgtttgatgatatttttattttcttaagatcatcttcagctgaatcctgacaaccctactacatgatcataacaaaaaaagcaatgaggagtctctataccctttattttcataggaaaatattctaatatccacaaatgtgattaaaggatagagcaggtggtggggcgaggtaacatctgatgtgagaacgaagaagcaaacagttgttatttttactctggtcaggtgaaaacaagcagtcattacatgtctaaatcttgggtatctttggaatcattttcagccaccgtagtaagttgtacgtgcttgagtgtttttaaagcatgtcttatagtgaccaaatgtttctaccgcatttatctcagtaaagttgacaggattctattaggacgatcttcacctaatgagataaatattctaattgtaatcatcctcttggaatgcatatctcttctgggaattaaaagtgctttaagtggtgttgctaaacaaacatttctaaagagtaatcataaagttaaatgcctcacaatagcacaataggctttttagttgacctggtttttaatacttttttcattgcaaaatttcttattctggaaagtttggaaaaatgaggaaaaaaatagaaagaaaaatgtcgaatttaaacattttgtcactacctagttaaaatcggggataacattgtgatttagatttctccagtctcctttctttttttttttttttttttttgagatggagtctcgctccatctcccaggctggagtgcagtggtgcgatctcggttcactgcaagctccaccttccaggttcacgccattcacctgcctcagcctcccaagtagctgggactacaggcacctgacaccacgcccgccaatttttttgtattttttttttttagtagagacggggtttcaccgtgttagccaggatggtctcgatctcctgacctcgtgatccacctgcctcggcctcccaaagtgctggggttacaagtgtgagccaccgttcccggcctctccagtgtcctatctcaattcttattcaattgtttgttaactagattggaatcatactgtgcatattgttttataatttgctgttttggctgacatttggaaaaattattttagaaaaaacagccagttttgtagatgaaatggtgttttgtttctattgatttttgatttttaagttgctattacttcatgaagttagcgtctttcttgtgtattggctattctcttttcttttgctataaattgtctgctacatcttttagttcataataattattgagtcattttctgtttaaatataaagtatttttctcatttgtcgctgtaacataatccatttttaagaagcagagcattttcttgacagagttttgaaatattgtgtgactttatggctagaacacagaaacattagttagaatttcagaatcatttgatcagctctggctttgagcctctgattctacttgtagtctccaaaccaatctttggtatccttctgtagagatgtaagttgttatcaccaactcaacatgaaattgtaagaatttataacagtgttttctaaaatgatttctttgatttattcaaagaaatattatctctgataatatatttcagtatttttcatattgctcaatatcagacgaaagttcttataaaagtcctgattgtttcagcagtgatttgcatgccattagcaggtcattcatccccttccactttgaggctcaagttctacactagatttgatttgttggagggagtctacaaactctgctttcactagaaagacatgatctgtgtgctttgctgccatagtgggcctatccacatggctcattctctgtaacactaacttccaggaaagctcttgtatcaaaattcatcaccggtattaaacagtgtcaattatttttatcacctgttgaaagcttaaatgccaacagaaatttgtgcttcacagggcattgggtcctccatttatatttttcaaatgtgtagtatactcttgcttttagtcgtctattacccagtgttcttttcggaaaatatttttaaagttaattatatactcacagataatagtgcaagcaagtttcctccatgttctgctttcctttttctgactttacttcatgctacattccttcacaaatagtaataagaatttatttctactcagaatgaatgttcctcacagtggagagaatttgccactacaaaatgccttctactctgtgtttaaattcctcgtacatacaagcaggttttgggtgttacatttgttcatagaggtatgaaattgagagtcatagattgaaatgttttttatagtagagactcccaaaaaaaggcacagaaaaatggttgatatctagtaggagttatttacatgctgctatttctgatgcttcctatttgtttcttctgaaaaagtcgcccttcctatgtctcaaaacagtacacctgtaaaaccacatcctactgggcataattctacaactgcttctattctcaatgcttgtgttgcatgcttttggaccctaagagaaatcagcaagctataaacccaggaccaagaagagcatatatctcttggaaaaatagcatttgagtgattgaataaaacaggctgttttggggatcattccaaatgcagggaacaatatggatctgtgatacttgagttgttggactttgtagaatatcaaagatgttctgcttttcatattcagatttttaaatagaaggaaataaacaatttttaaaatgtttggaattaaatgggggaggtcatctgtaactgtctttgttgatttttgtgggcatcatagcacagaagagttctcctggcttagcattctggtattgctcacatatcacctatatgctaatttgagagcgttcatgagtgccatgaaggatgagtcagaatgatagacagtatgctgactttttctcctcttattgaatttagtctgatctgctagtgagagaaataaaagggaaataaagcagggagtataatagggaaacctattttctccaaatgttgagatatttaaaaagtctttgttcagtgtacctgcagttataatctttccagagattcatgagatgtcagggctaggcaagactttagaattctatgtagtaaactcttgtttggggctgggaaaatggagggtcacagttagaataattgcctaaagccacaccgacagagagctggtagtggaatccctgttttctattcaccttcctactcagttgcactacaagtttatcctaattcaagtaagcttagacatcaccttgggtaactttctgatttaccaaatccactagtggaccatattgaatttgcttccaacatgaatactcttcatttctctccatccacactgctacccaccaaaatcccatgccttgaatgtaaataatcttagagctgatctgtttgcttctgtaacttcctgctactcattccataagcaacagaagaggcaaaatgaccttttaaaaagtataatttgatcattattctcctttacttaaaatcctagaatgacttccattgcacttaaaattccaaatttctttccatggcctaaagggtctacttgatcagtgtatcgcctttctctagaacttaatctacctctgacccttgtgtgctatgctgcagccactttggcctcctttcttttccccaaaattgaagacacatttccatctcagggcctaagtgtttgcagttagctctgtttggtgttctcttctcctagctgtttacagctttcagccttctgcagagatgttccccagctaccctgccgaatatcgcctttccccacccaatcctttcattaccctattttttcatagcagtaactactaattaattatgtctttatctattgtcttttcccagtctccaactagattgcaaagtccctgagggcagaggtcttgatgtcttttccattaacaatatctcgagtaaccaccagcaatctgcacatagtaataacctgaatattcctttaatgaatgaataaactgaaaaccctaaagttcagtaatactggcctctgtgtagagtttcagaaatatgccaaatatgctttcaagcatcccagcctgtctagtgtatcctttgctctcttggccttctgagatcacttttaattggcatcctctgaagttgttactctcagtcatgctggttgataccccgaatggataggaaatggataggcattttttctgtccatctctaaacatctctgattgggcctaatatacctctcaggcctgctcctctggccaggacccctctttttatgggaagtagggagacccaggaacacagaacctataatatattagaacctgttatatatctctctagaaaaaacagttattttaaggaacgtgattgctggggatggcaagtcagaagcctgtagggggaggcctgcaggctggaaactcaggtagcagttgatgctgctgttttgaagctgacttttttcttctatggaaagcctcagttattgctcttaaggcctgccaagcaatcggatgaggcacacccacattgaagattatctcctttacttgtggtcaactgattatagatgctaaccacatctaaaaaatgccttcatagcaacaccttgattagtgtatgattaaataatgggacatgatagcctagccaagttgatagaaaactacccatcccatcatgcatttgtggtattggagaaaggaaatgcttctccattgttactactgggactgttactgctgagacacaccgaagaggagaatttttagtttttagtttgctttttagcagaattcaaacttaaatataaaattaaccaaattgtcagaaaggactgaaggttatcctttcaattctgagttttttatgtaaaattattttattattagcaacaggttttgaaaacatttatcaattatattcttatatattggtgactttaggtaatgaataaatctggatttatctttctttataataaaaatatggtctgatcaaagtatataaaattgaaataaatattgtcttatttgtgctttaaattaattgtagtataatattaataggatattatataatattcagtcattttagaataggagaaacattttagggtaggataaacaagaccgtatcatgaaattggagattttaattgttttgtaatattaaattttacctctcatgaaaatagagtagataattattatggattatgaaacagcataattagttgtaacagttttaccttgaagaaaatatatcttttttataagcagaaaacttcattttgttttctttaaaatgaagtgaataccggccgggcgcggtggctcacgtctgtaatcccagcactttgggaggccgaggtgggcagatcatgaggtcaggagatggagaccatcctggcttacacggtgaaacgccgtgtctactaaaaatacaaaaagttagccaggtgtggtggcgggtgcctgtagtcccagccactcgggagtctgaggcaggagaatggcatgaaccctggaggcggagcttgcagtgagccgagattgcgccagggcactccagcctgggcaaccgagcgggactccgtctcaaaaaaaaaaaaaaaaaaagatgaagcgaataccatctctactctcaatgtatcgtggacgataataactatgctagtatttctgcatagtattcttaaagaattctgactgaaaatatttaaatgaaatacacataatcactttgccacctaatgcccatcaatcattgccaacattgacttttaataaagacacataaccagagatgatttttaaaaattatggataaattacattagaaaatttagctggagcaaattatatttgattattattaacctgccataatttatattcattaaattgccaaatcttgattataatagtcaaaaagaaaaggtacatgataatgatctagaggtagaacacatgctatcaactggaaaactaattgttcagcatcctaagtgtatttgttgcttaattatatatataatttctacaacaagtggaatgatttacatgaatgtcaaataactggtttataaatgaaacctgatattaagctaaataaaatattggcatatagtgttcacttatgagctaatattcttacctctagcttcatttacaaattaattatgctacaaatatattaatgttccacaactctttcacacttccatcaatatcgagtttattccattacaatgtgaaattaaaaaaaactgtagaataattacttctgcttcagaaaatatagattacctatcttccagtaagatgctgcaatttatttagataactgcatttattgcattgattttgaaaaattgctcaacctaataccctttcttctttgctaattcctggggaaaaggaatccttttcattttgatccaaatgaccattaatcatattataaagtgtaataattaaccctttttttaagtgtcagagacacatgaatagtgattttatttggtttcaataatcaagtaaattaagtgataaaatggaggccataattaagtgatcttgttttctaataagaccaacccattaatgtgcatgtaaagatgcctgtcatcaatttaacagctttctgagtttaatatacattaagagttttatttttggaacaacttagtaatttttagaaacttgagtacaagtgttggcaaaggttctataaaattctgtctacagaatatgtggaacacaaccttgggtcgtatctccaaggaaaactaccatgattaaaaagacaatgctttgtcaaattcacttgttatcacaatctaattgtgttaaatgccggccacattctgagtagacactttaacttggcttcccttgggaaataggaaatgaagggcccgaaagaactagaagctgcctctcaattttctttcaacatggcaaaagcatttgcatttatctgtgcccctctcttggctacactctcagctttgatacactacttgagcatgtggaggtttacctactgaatgtgacccttatatgaataatatgagacttttgtatcaacagtagtgatggtttttgtttttaagtcacattttattgtatgtcttctctacctctcactatatgacaagtttagtgaaggcagggtctgtggctatcttgtttattattgttttatatcctgggggtatcacagtgcttgatcatagaaagggctcactaaatatttatggaaggaaagagaggaaagaagggagagtgaaagaaaaaacattcaatgttctcactcttaaaccaagaaaataattgtttactttatttcattgtagtaagaaaactgaacatgctactaccttcaataaatttttaagtctgcaatacagtattgttgaccataggaacaatattgtatagtggatttctagcatttgtctttcttaactgtaattttgtgcccgttgtttagtaactctaaattttcctcttcactcagaccctggcttccccccattccacaatttgattctgtgaatttgaatattttcatagaaaacattttatgagtagaattatgcagtatttgtttttctgtgactaacttatttcacttagcacaatgacctccaggttcatccatgttgttgtatatttcagaatttccttcttttttaaggctcaagagtattcgcgtgtgtgtgtgtgtgtgtgtgtgtgtgtatcacattttctttattcatctgttgatgaacatttagtttttttcacagtcttggctattgtgaatactgctgcaatggacatggatttttaagcgataaagaataaagctcttttcatcttttaactggaattattttttagaaaatattttgttccaattttatgatttttttgctattctttcatgattaaaagttatgtttcattattatcaggttgtatatttacatatatattttgtctgatgttaataatggcatgtttactttctttgtgtaagctgatgtatggaaaatattttcctagcttttatttcacattatttcatcttttgtttcaatcattcatcttgtatattttggcttccttcttcccttttactcaacttagaattttagagtgagtaacttttaagataaaacgagtttaacagataatttagcccattcacatttgttgtaattcatgatatttgtgtgtgtttgttatctcttcatttttgaattattttgctttttaatacatcttttctccatttcttctgcattaccttccttctttattattaattgaggttttttgtgctgttcttcttccatcttttttaaactaatgaattacaaaatttgcttctttttatgatttgtctcatagttattgttaaagttttgagacctgtgagtaaaaatattttatattaatacctagacttataaatcagtactaatatcttgtcttgaacaggacttcatccctagaatactttttatttctacatcatctgcttttaaataatcagatattaaatccagattgccatcgtttcatttttaaactttgcagcagagatttttttagatgtgaacataaggtgtctattttctttgcttcttgttattttgtgttgtctttctctttcttgggtaattttttgttttgttttgttgaatcagtaagcttttcagaaaatgcctgtaggtgttaaatttctgagcagttatatatctgaaaatatctttgctcttacatttggttaatactttggctagatttagaatttaaaattatgaaatgtttttctacagacttgtgaagacattcaatatttgtttcagcacatggccttagaaatgggatatctataccaatctaattcccatgtttctgtaagtaatatacctgtttttatcttctctgagatattttggaatttgctcattattcttggagttttgaaatgtcatcaaaatatgtctaagtgctggtcttgtttagtaatcttgtatacctcaggggaaatttcagtctaaagatgtatatcttttccttcagttttttttttctctctctctctccatatatatatatacacacacacacatatatatacacgtatatatacgtgtatatatatgtgtgtgtgtgtatatatatatactttttatgtcttattagacaaacgttaggatttctgtttctgttctctgtcttaacttttttatgctctccaggccatcatgtgcttgtcctataatctggaccaaacccaaggtacacatttgtagctcacaaattcttcactagtcaccatctctgacttatcctaaatgaaattttattttatttttaaagtgattatattttaaatgtttctttttataaaatgccaaccagtttttcttaatggctgtaatgtattgaatcccttaagctagttcattattcctatttcaagatttttttctactccttctattaattgtttttttttttttttttttttgagaactagttttgtgttgtttgcattggagtagcatatacaagccattgtttctgacccgagtgctctcttttagaattttttttttttttagggtcagatcccctcatctagtacctctgcctttaaccgcagtctcatgaatccaactgctattcagcaccttcgactcagatgtctgataggcctgtcaatcttgggagacccctagctgaacttccacagaaggatgggtctgctccttccctagtctccccatatcaggagatgatggtacccttcaccctgtagctcatgccaaccttggattcatcctgatacctttcttgtcctacattctacatccaatgtatgaacttgtgctcacttttatgtccaccttcaaacaaataccatatctgactgtctctcaccactccccagctacatccctaatccaagtcaccatcatctttcacttactctattgcagcagcaatagaccaatctgggctctgcttccattcttttcaccctatgtttattatgtattcagcggcctcagagaaatgtaaaacataaatcaagttccatcactccctgcaaacaacaacaataacaccccttataatggctttaagtcctaagcatgaccaatacagccatatgacatcaaggtcctgcttacttctctgactttctgttctataatttctataatgtctatcattgttcactgtgtttcagtcatattggtcttcttgctattttggggagtatgttcccacctcagggcctttgcacagctgtttcctcacctagtagctctttctctagatattacttggcttcctccctccctttaattgtttctcacacaaaatgcacctcctcagaaaaggattgctctcatccagttatcatccactgtccctctttatcccttttccctgccctttttcttaataacatgtaacgctgcctggtgtgaccaagataggtttgtttgtgtttgttgttgttcttcaaaatagaaacatgaccagggtatgggactgatgacttctccaccagcatatcctctgagggtgctgaatcatttctgttacatagtgggtgcagaggaaatatttgttacatgaggctatatatcaaagggcttcatgaaggttttgctttactgtgaatctggagtcagataattcttttctttatttctcctctgttttctttgtagagatcatgaatatcttaagctttatggtgcctctctctctatagtttggctatgagcctccccgaggcagatggttaactttatttagaaagagggtttcaggactttattctagtgataaataccgtggctgctagtcatagaataaacaagggcatgagagaaggcagccaactagaccagctgttcacaccatggtcctttcataattatcctggttactgcctcttggctgtgtgtattgcttgactccaagtgtggggtgtcttttgtagagctttatctggagctgttttagggagaatcaatctcacttctagtagatttctcctgtgtaagtgtgggctttgatttcctctacttctatttctactaagcccattacttatattaatcccatctactttcaaccttcaaggacttttatttttcaaatttctgatctgatagttaaaattttccccgatgtgccatgcacttattctaaaatatgatttttttcctggtgtcaataagatttggcgtacagggaaagacagatatatatgacttaaattttgtcttctttgcctctattgtatgttactgtttttatcttctgtgttgttgttgttgcttaacaaatgtagctacacatttatatcttatcactgttttcttaaaaataatttgttttgttcttctcccttttatatttagaaaatatataaaaaatgtggaccatgcctttgatcagaaattattatgaaaattgttgtttagaatgggtttgagggtggaaaagtttattaagagattgtaatttaacgaaagagaggtatgaatattctgagaattgaggtgtcttatgcattaattggattgctagatggccccactgatttcctgtttttcttgttgtgttaatctatatattgaattaagcacctcaaactatgagttattagatctcatatatctatatccctacagcaatttctctaagctctggtcatttctgctactttgtaatctaaaactgcttcataacttcctagatagaaatagaatatgtgggtgctcagagtatcagatagaccccatatataatagctatgaaatttcaggctctataatggattataggatatttttgaaccttggtaggttgtaggattagttgcttaaatacatagtaccatagattgcaaatgtttaaaaatcttgatgctggaatttattagaaaaacaggaatgaatacagtttgagaggctagaaccgtggatttcaaatgctagcctgtatgagggtcccttggagggcttcttaaaatacaagttgctggttgtcattttcagggtttctgatttacgaagtataggatgggcctgagaatttgcatttccattaaattcccaggtgatgtggctgctgctcctgggacaacatttagagaaccgctagattagacagtctcacaacagggatttctagggacagcttaatggttactttatgatttgaagctggaatacccaattaggggtttttccagtctcatttcatttcatttcatttgcttccttttttctttcttccttcctccttcccttcctcctccccttcctcctccttccttttttatctcctctccttgcccatcccctttcctcccttcccatcccctcccatctcttccccttccctcccctcccctcgctgctcctctcttctcctctttctttctttgccatttcaggtgctttatctcttaagcactgcactgctttgggttatccatttaagcttagaaggagagcaacagaaaaggaattgaaatgtaaagcagatatcaagagagcaaaatttgtcattaaattggaactagcaattaatttgtctatttattcatagtctaagtgtgattatcaaaaatgcttgagaatcaatagaaccacatgggtttttcaagttggataggaccactgaagctacctggtggaaacacatcattgtattgatgagaagactgaagcaagaatatgaaaagcatctgaaccaatgttttcttttccacgttctcatcactctctgctacccacagctgcccgtcatggatatactatatgttgtcagctatattttgattacttctctgtatatttatcatcatagtttactaaaattgttagtattataccttttgcatataagaaaggatgaacatttctagttcttaaaatgtaagaataagtgattacatattaccttgaaacagtatggaacactttttactttaaaatatttttttcaatttttgtgggtacatagtaggtgtatgtatgtatggggtacatgtgatactttggtgcaggcatgcactacataataatcattttccagaaaattgggtatcagttgcctcaagcatttatcctttcaattaatgctcttagtctgttggtattaaaacaatttttattttctgatgagaaagttgctgtcactttgatcattgactttgctacaggaattttcttttcttttcttttcttttctttttttttttttttttgttttttgagacaggtctccctctgtcttccaggctggagagcagtggcacaatcatggcttactgcaatctcaacctcctgggatcaagtgactcccctgcctcaaccccctgaccctcactatctgggactacaggtgcacaccaccacgcctggctaaattttgtattttttgtcaagacaaggtttgtcatgttgtccaggctggtctcgaactcctcggctcaagtgatccacctgccttggcctcccagagtgcggggattataggtgtgagccatcatgcctggccaggaattttcttgaatgcttcaataactttattccatttaactctcacaacaatcccatcaaatcaagtatcatgattatgcctcatcattcatttcacaaattaataagcaaagtcttagggggttatcacttcccaaattattacatgccagtgaaaaaccaaagtttgagcttgcacacaaactttgaaacactattcaaaagcagtgttttcagcacctgatctttattgcctcacagagttttatacagatacaaaattatgaaatgtagctggagccaggaactatgacatggaatatacctggcatacacatggtctttgtcttttcctacatctgtgaacttgttgaagctttagatgtcttcccagctcagtgatcatgaagacgtcctcactgatgagtcatctttacttgtcatctctagctacctggaataaaacacccagtgtagtgtctgggatccagtgggcatcgtgggtcagttagttctccagccccggttccttttctggttgcctgagcttggaaaattcataaaatctctttggacctcagttacgcaactgtgaaattgtgctatagggtgacttgaaaccactttgtagattttttgggagagctaaattaggtaatgcatgtaaaagcatttagtgcaaggtctggcacataggatatatttgctaaatattcgtagaatcagatgaataactctcatgaaatattttgttaaacattgtgattgttcactgggaatattatatggctgtgtgtgccactgtccgtgtttcccctaataattaataaatattaaataatttaaaattaaatattaaataatttaaaattaaatattaaataattaataataaatattaataaatacctttggcaagtatatactatgtcttcaaaatgtttcttttccatttaatgttttcatttatctgcaacatttcttaaggcttatttgcatgtgggtaaaattcaggctacaataatagtcaaggaagtatatttctcttgttctgctcccatacaaatggtgcccccctgcaagcctcttctgaattattcctggacacccaaataaaaatggtaatttttctttccttttctcctggattcttattctaacatctgctaggaggatccacaccctgtcctaggctagtagtgtacagaccatggttttgatgtctgtgcaaaaggtacaggtttgtttgcatctcttcaatttttttcattgtatgaaaatataaataatataaaatgtactatttttaagtatacgattcactggtattaaatgcatctataatgttgtggaactatcaccagaatccattgccatagctcctttaatcttacaaaactgaaaagttgaactctttacccattaagcaataactccccattccccctcacttaagccccgggcaccactattctactgtctgtttttatgattttggctattcaaagtacttcatataagcggtatcatgcagtggtatctcatctttttgagactggcttatttcacttagcataatatcctcaaggttcatccatgttatagcatatttcagggtatttttcctttttaagactgaataatcatccatttatagatataccacattttgcttatccattcatccagccacgggtacttgggttgcttccactttttatctatcatgaataatgctataaacatgaatgtacagatatctctttgagtccctgctttcggttcttatgggtatataccccgaagtagattgctgcatcatataataattctgtgtttaaatttttgaggaatcaccatactgttttccacagcatctgtaccattttgcattcccaccaacaatatacaaatgttccaattcttcgcattctcgccaaaatttgttacatgttgttgcaaaagtaattgtggtttttgccattaaaagtagttacttttgcaccagcctagtatttttttttctgagtttttttttcttttgttagtaatgggtgtgagtggtatctcataatttttatttgtatttctatagttgttattgatgttaagcatcttttcatgtgcttaccagtcatttctgtatctcctttggagaagtatctgtgtattcagcgtttgcttattttcacattgaattatcagtattttttgttgttgaattttaggagttctctatatattctggatattaatttattgtcaggtacagatttggctttgatggcactaaagctacttcttcttaccttcgaagtcacagtacctgtaatgattgcttatgtttagcaaattaacatcattaggctttctctgtcattatataaccccttcatcctaagactcacacatgagcacctcaactgaggctggggatgtgtgtccctgttgttgggggaacacatgtccttagctctgactccctttctccagggtcatttctatcctctcttccgatgacggtctaccccacagatcctaagccacatccaagtcacctgaattccagcatgattcttacttagattcttaagtttaaatgcttgtaattccttcttcctttcctctccttattaagtacctttaaggaagtagaaaactctcaacatttagaaacacttacaagcatatgaatttccatattattaatgcctcgtgaccaagatgtcctgacacatttatatggtcctgtaaaagttttataaataatctggagcatattatttctttatatcctcactttgtgaactagacaaggtagatattaaaattccaagtctcaggaagtttgaatgatttttcttaagcttagtcagctaattaggagcagaatcaggactggaatttagggcttctggctccactttatctctgaggcttgtactattctactgggatatcattagaagaaatgccaaatgaatgccattgcctcttcagccctaaacacaaagcccagttaagtgtttccctgacatttttcctgacatctataaaaattcatattttatttttattcacatgctgattgatttagatgttatgaaaattaaataagttccaaaaggcagaagataggctatacacatatttttaaaaatttgtcattgttcaaacaatattgaatataaaattgaaatgtccctcattataaaaaaaaattctctaagagtgactagttataaggttatatcttttggcatgatgcacctctaagcagtgcttgcataaagtctctaccaaagctgacagagcttccctaaggcctaaagaacttggcaaatgttgttgaacaaaaatgacaacaatgaaactgtgtaggaggattctgcattagtgcacctaagaatgttctcgctaatttgagcacttctcaccatggaataatgcttttgttcctctctgtctttttctgctgtctcacagagactcctaacagggctccctggaccaggcttagacatcaatagggatggactagaggcattccatggaggtgacaattacagaagatcagaagtgcctagctacacactctattttcttctagcatctgaaattattgacttgaacccatttgtggggtcactaagccaccttcatataatatttattacatgtgcaaagtcagaacatatggagagcatttgcatttgaatgggggaaacatgctgttagataaattagaaaatctttatatttgcatttttctttatttaaaaaaatcaatctgtggtatagtagagctaggaatattccctttttggttgacttcttcactctgtgtttaaactttctcagcattgaggcatgtgattaaaaggagctattttcctaatacaaacaaaagcattgaacatcctgtgaaacaaaagttgttcattttaacttgcgttatatggaaatgtgacatgttttagatttgtgtaagctcatgtacttgaaaatcagacttgtctaaaatttcttttgtaagatattagagaacttttgaattatacctcttatttttgaatgtacattcctcagagaatcatctttatgcacaaataatgtttattttatatttttaatctactttagcagacccacctgattcttctacatgtaaggttgaaacagttttgagtgataaagaactgattttatggagcaactaatgattttgctgttgctacttttgtgccagcaaatacgtaatccacaagaatgttataagaaagatatttatcaagcctctaaaaaaaaagaaagtaatcaaaagataaggatgcataaatatcttaagactactcatgacatcaaggaaggtgaatcagtattaataattcactagtttgtgcatacttattgtcaggtgctgggtcaaattaaattggaatgatttgttgacatgaggatttctgggttcatgatggattcacattaaaacaatttttatgttttaagccttctcccatcaaataggttttacggtcttgtgtacacattacatgagggaaatagtactttaacattttacatgctggtgtatagtctatatcagcagtccccaacctttttggcaccaggaaccagtatcatggaaggtaattttgccatggagtggggttggggaaaggagatggtttagggatgaaaccgttccacctcagatatcaggcattacattctcataagaagcatgcaacctagatccctcaaatgtgcagttcacaatagggttcgtgctcctatgagaatctaatgctgccactgatttaacaggctgcggagctcaggaggtaatactcgctcacctgctgctcacctcctgctgtgtggcccggtccctaacaagaccattcaccggtaccagtcagtaagctgggagttggggacccgtgttccacatgttataaaaacttaggctgggcgcggtggctcacgcctgtaatcccagcactttgggaggtcgaggggggcagatcacgaggtcaggatatcgagaccatcctggctaacacggtgaaaccctgtctctactaaaaatacaaaaaaatagccgggcgtggtgggcgcctgtagtcccagctactcgggaggctgaggcgagagaatcacttgaactcgggaggcggaggttgcagtgagccgagatcgcgccactgcactccagcccgggcgacagagtgagacttcttctcaaaaacaaaacaaaacaaaaacttaaagagttatttgagccggacacagttgcatagacctgtagtccccagctacttggtgggctgaggcaggaggattgtttgagtccaggagttcgaggttgcagcgagctatgattgtgctacttacactccagcctgggtgacagagcaagtccctgcctctaaaaataaaataaattcggaaagaattatttggtgattcaagtataaaacaaaatctatcagatatttgtgaaaaacatattgttacattgttacatgttttaagaagggaattaaactcctagactctgtatggtataggagttcaacactataggttggtctatacatctaatgttggatatgtattttgtgccttttatttaaaataacatacattttatggcatttcttgctttgcattaattactggccatacccagaatcctttccttcgaataaaataacctcttttcccaaacttttacatattgttcatattttcaaccccctacacagttgttaggtcttgaatttggaagaattaaagggaataacattaatgacagtgaactatgaattaggaacctcaccctatcaatagccaatttccctccttttcagttttgtgtctcagtaatagtccttaaaacaacaaatgatacattaagtgacctgagccaatttcctcttgacatggaactattcaacaaagcctcacataagctaacatttcctaattagccccttaactgttgacttgagaaagggtttgcaatacaggattcttatatattaataaaaactataggtaaaaaattcaagatgttgttgaatctttacagttcgactcattattcaaattcttcatctttacatcaagtttctcatctttacattcctctaattcaggtcatctccacaatatgtccaataaaccgtatttgcaagatatcgggagaaaagcgagtctgcctctaggaattataactgatacttcctttgtgtgatgaacagtgatttttatgtatttagtcatatgctattagggaatagatatctctagatcagagaacagattgtgtattagtcacagaacatcttagcactagttcctccagccctagttcctgtggagtaacgcgatgagggccagatatctatccccatgggcagcagtgttgcaccgcatgagaggaaccctggaattatgaaacttggagcttacacagggcagctgggcacatctgcccttcctcccctccagagatagaaagacttgtatgtattctggcatgtaagcaaatgactctcggggagagtaaaaagatgcctccaggttttatttcatgagcatatggctccagaggagacgcatctctaaacctctcaggaacagttcattgtcttttacttctgagacatactgtccattcagtcattctttagccaaggttgccagtactctttgctaagaaaccccagatcatgcagaaatgtgaacatgttcacagagaattgtctctcaatcaatagtacctagtacattattatacaaagttctggggatgtttggcagggattgaacccatgaactagaattatgagcattggaacttatctaaaccaattagcaaataaaaaagttacacatttcttgagaaaataattttatagattaataattacatgtaggatatgcatatctcaagtcatctgagggtttaatgttttgtatactttatcttacaaaatagattccaattcatgctgtctggatatacaagcattaaggccttccaaaggcaaaatcaggctaggtgtgaaacatgagtggtatacggaggtatagcaagtagtgtcccttgatacccttggggaattggttccaggatgtcccagagataccaaaatccatggatgctctagtctctgatataaaatggcatagtatttgcatgtaatctagcccactttcctgtatactttatatcatctctatattagatataatgcataatacaatgtaactgctatgtaaatagttgttttatttgcattgtttagggaatatgacaagaaaaaagtttgtacatgttcaatacagatgcaatgttttggaatgttttggggcatatttttgaatccacagatgcaaaacccatacatataaagggctgactgtatttaagttcctcattctggtgtgattaattttatctctttttagtatacttgtggttctcaagtcactaatgttttagttataaggtgaaaggcacactgtgtaattgaatgctaaggccaattctttacctctgatgtctggaataagagccagatttcccatccttttatggaactacaagcgtcatggctattagcaatcccagaatagttctactcccactttggctgagtttaagatctttttctaaagacagtaaaaagagcatcagaaaagcatttgtgaggctgaagtacctcacataccaattttgtgggcacatttttggacccttaagttctttttgacagttttataaactcatgcccagagtagtttcctttatttaatatttgtcttaccctctacttacaggaaatgcaaggctcatcagctttttcagggagtagcatgactcagagtctgatgtacttgaaaaaaacacagcgggaatccaaacacacttatgtcatttttatgtgttagagagaaaccaggaagcatgaattctcacttttcttaacgtctttacagtgtcaaagggatatttgtgaaaagaggttgtgggaatcattgttctgaagtgcatccaagattagaagcctggtttatgtgtgctattttgcctcccagtatgagcagcctttttatatttattccaagtattactgtaaactactttttctttatacatacacaatatatctttgtctgtgatcagagcggagcttcatttccactgaccaatagaagggcatttttatttgatttaagtgaaacttggggcataatgcattctttcaaacctctgattggacatgacaaacaaaaagcttgagctagaccatggtcatctgaactatttccaataacttacctttgtaattggagtattgcctcaaatatttccctgaactctaattaccatggatacgatatcactcaacagaactttttcttaggagcactaagagtgtggaagacagaggataaatgttgtagtttcatttgattatctctatgtggatgctcacatttttttttctataaccaaccagtttcattttgatgagagtgtttggagagatggttatgctgacactagcctaggtaagagagtaagtctccctctcttaaaaaaaagtgacaatgtcacttctgctcacagtctgttgatcaaaatgaggcaaacggccaaacctgatgcctataggttgaggaaattgtgtatttgtgaatagtaatagcacagcagccactaggcctcccagtcgtactggagatttctaaaaggcaaagtgtttttagtttgttttaggtaataggttgatatttagcctattaaaaaggcagaccctggcttgacagacaaaaattaataattaatttgggagccagatacagacttaggttttttgaattcttgtttctatattcttattttggaagtttacagtttggttttatatgcaggggtgttagatgaaggtgtattgttttgcaaatagaaacagtctcaggagacaaataacaatggcatgagaaatttatgaagtttatttttagcagcactttcaggcaaggttttgccatcaatattttcattggtacccaagaagccaacagaggaggccatgttttatgaattgatgtggctacaaatattagctctgacattttttaagtgaaaaatggcagaaaagatacagaagcaaataaatatagagtctctgacagccagcagagatggaaccctttctaacaattatgaccaaaggtatgtgtgtgtgtggtagtttggtttatacttgcttgaatgctgtccttgttcttttttttttttttttttttttttggtagttcttgcaccaagtgactgatggcttcctccaaaacaatgtcagcaggacaaggatgtattggcagggtatcttttgaatcagtaaccccatactgatccttgacctaattaacagtctgctataggcatcttgcagtttactgctactgctatcgcaacatcaagaaaatgttgaaacttaagcacccataagaaacttaagggggtgtcccactcaagtcattataaattcagttttattatgctaaaattgtgtgaactatagttcacacaattcaggctggctggaagcctgaatactacattgttttatattataccacatttattggaagagttggtttgcttttaaaggaatccatcactattagtttcatggcgtatttaacatctggtcaggtcagttcaatacttggaaatgttttgatacttgaagtttccagcagattttaacacatgcctttggatgtaagtaaacacctttgtccacaataaataaaatgtaactgagcaaatgaaactgtcacaatgctttgaaaactgtagcatactgaccaaatctatgccatgattttaccttctactgatggaaagaaaagtaactttgattattgcaatctgggcaattcacttatgttatcttatttaactttcatgaaaatcttcatatagtagctatcattattccatttcaaaatgggaacagaagcttaaaaatggaataatttaaagacatacaacctagaagaggcaaagcttctgaatacaacagctatctaactccaaaggtcttggttcttataagaatccattctgttttatgtctgtgattgtaagcttttagcagtttctcttcttctatttctttttttttatattttttattatactttaagttttagggtacatgtgcacaacgtgcaggtttgttacatatgtatacatgtgccatgttggtgtgctgcacccattaactcgtcatttacattaggtatatctcctaatgctatccttcccccctcccccctccccccaccccacaacaggccctggtgtgtgatgttccccttcctgtgtccaagtgttctcactgttcaattcccacctgtgagtgagaacatgcagtgtttggttttttgtccttgcgatagtttgctgagaatgatggtttccagcttcatccatgtccctacaaaggacatgaactcatcattttttatggctgcataggcctagaaaggtgcagaaactgctttcaattcctgaagggacttgtcaggcaaaataaacatactgaaaatagctttgaccatttctaaatcctttcctggatcagagttggaggttgctcctacattcatacgcattgctgatggattctcatcaatggcccctacttctgggttggctgagatcaataaatcttagcagtttataaatggaagaaatggctttacatatcttgtttcctgaatccctttggatattttaaaagaggtgattaaagtaaatttatgtttctgcagatgcatgtaaagctaattgttttaataacagtataattggcgaaaggaagttatgtgtaataagaaacaaagcgtaccacttccaaaatattcacattagacatttgttaaatttgcagtgagtttcagcatacacacatacacaacacagaccatatgtgaacattaggaagattgatttgtttaaaaaatccacttctacaccacataagtaatatttcttactgagagtcactgaagtgaggaagaaaaataaccacataacgggaaaagaaaaacattaaatttagttatattgtatatgttttgtgtttattagtttttattaattgtaggcatgcaggtaaaaaaatcgcctcatttgaaaattaataacccagggcacaaactattaattaaggcatatagcaaatgccttttaaaagtattttatactggctgggcatggtggctccgcctgtaatcccagcactttagaaggccgaggcaggcaatcatgaggtcaagagatggagaccatcctggctaacatggtgaaaccccttctctactaaaaatacaaaaactagccgggtgtggtggcgggcacctgtagtcccagctactcgggaggctgaggcaggagaatggcatgaacccgggaggcgcagcttgcagtgagcggagatcgcaccactgcactccatcctgggtgacagagggagactccatctcaaaaaaaaaaaaaagtattttatacttaagtttttctagctgctagtttaagagagatgagaatacattcaaagagcagggaaaggagagtgtctgaacagaggaatttctaaaaatgagtacagtattaacacagttatccttacaatagcctgaggtcaggactattgttttctccacattttggatgaagggactgagacacagagaagttaagtaacttgtataagatagagaagagacagacatgaaactgttataaaaaggaaagagacaggaaaagaggagaggagagagaaagaacaaagcttggatggcaagttaacttaggtcatctacctttgaaattcaagtagtctgtaacttttgccattacatttagaggcaccctctgtgacacggtcatagaatactggttcactcttaggcattcaacaaatgcctattgagtgtcagtcatttattcaacaaacatttactgaatgtctaattaagtagcagatatagtgctagttacttgagctacattgcggagacagggcctctttgaagagcttgtgcttcctctccatgaatgctagattcatgctttccacctaaaccctacttttggaaatcaagaaaagttcacctccttcatgagacttcttggattaaccccatagtctattttcacctagaaatagaaccctgtttttgagtcatgcacgttgccagctgggataaaaggctacatttcctagtcttatacctaggtgaacccatgggtctcaggtcaatgggatgtaaataggatttgtatgagaattctgggacatcctccaagagagcagattcagctggcaggaaaggaatttgctttctgatatggtttggctgtgtccccacccaaatctctacttgaactgtagctcccgtaattgcaggagggacctggcaggaggtaattgaatcatgggggtgggtctttcctgtgctgttctcgtgatagtaaataagtctcacaagatctgatggttttgcaaaggggagttcccctacacatgctccctctttcctgtcgccatgtaagacatgcctttgctcctccttcgtcttccgccataattgtgaggcctccccagccatgtggaattgtgagtccattaatactcttttctttataaattaccaagtcttgggtatgtcttaattagcagcatgagaatggactaatacactttactacctatcctcctcctggcctggaataacatcactgggtgggtggagtttcagtcactgtcccaggacaggaggtggcctggagaatggaggccagtgcttaggtgtggagtagaagaatataaggggcttgcatccctgatgacctgaaggtcccatttcagccctcaaatagcctctttctggatttatttcatttgagagagaagcagttacatgaagtttgttactttgtttgagagataaatgcagttatattaggtttgttaattttgttttgtttttgttttagttgtatgatgctaaatccaattctaattgatatacctccttcataagataattttataaacccctggaaggaagattgttcattgggctttggcaggcagtgaccttaaaactaggaaaaactgagctttaagggcccatgaaagtccttggcttgtgggtttgctggctctttgctagaattatattttgtttttttctggttcagggtaccgtaacagaaggtgggaagctatatttttcatgaaactgattgcttttctaattaacaatcttgctaataaagcaccactgtacagcagatatagtgtttttaatgtcatggatattgtacctgaaagtaagtgaagaagtgtcagatagtttctgccaatatttgagcagtcttagttctaactgctacaattatgcaaggtatttgtcttagaagagcaatggccatttgagtaagactttccatatggtgttccacagtcactgggagaaaatgggcctttttttttccttagtgaggtgatcctctccttctttctctacaaagtaatgtggagtttggaatgaattctaatgagtgaataataggaagattttgcatactcatttggacaagataaacacaacagcatggttaaaattcttgagatgaaaggctgagtttctgtagcttgaattttagatgataaatatcaagaatctatttgaaggtcagctatcacaaatataatttttctctggcaacacttgggtagctttccttggcaaattttactcaaaaagaagataaattatttctgcctcaactttttcttttacctctcttcttctttctctttattcgattgtttgcctttgaaagtctggctttcattgcatcattagacagaattgtgtgaccattcccaaagagattgacagtgttcatggcaggctgtataggaatctttctgtgtgcaggctggtctacaatttagcataataaagatctggccttatattcataggatctagccaggaaaattagtcttacctcagggtttaaagaaatgagggtgtgtcccagagggatctgtctgtggccagcaggaaatttaattttaaaaactgaagaatatacaatagttcaggcactgaataatttgagcctgcgaaggtgcttctgccacatatattatcatagtgttagtaaggccaggaaggtctgaagtttgtatgagttcacagatattttgaaagactcatgcaggtatttttgatatgattccattttaaaatcacattgtctgtgatgtgtatttatggcattatctaccacatgtgtttgtcctgtagaatttacattacaaaaccttctctgatcaataattgacgatgagtgactgtagtagtttgggaaataacttgctttttactcttttgtcacctgcttcaatatagttcctgctgtttgatgagaattgactgagctggagcctgcaaaagtaactgtagtcaaattagttacattaaagggtcaaaattatagctgcgtggagctaaggtcatggcagaaccaaagagctctgggcacagatcttcctttcatgctcgactgggtccaataatcccccgaggctcaggtctctgattgcatttccagatggtctcctctggtgtaaacaccacccgcgctctgtccaacagcataagctaccctggcagaaagcaaaacagcaggtcagggagccctgggaattacacagtgggtggcacctgttgccaaattttgacctctctcatcccctacgttatatacccatgatattttcaacttacccctttcctttggtatttgcagggcaaactctctagtttcttagaataaagccagcttcatccactccccttcctaatctccatatattcttcaaactggtgcttagatttcctggctatcttgcagatgaattctaatatctactagtcagtagaatgcatttgtgtacttacacacttattattcaacaaatgcctattgagtgtcagtcatttattcaacaaacatttgctgaatgtctaattaagtagcagatacagtgctagttacttgagctacaatgcggagacagggcctctttgaagagcttgtgtttcctctccatgaatgctagtctcatgctttccacgtaaaccctgcttttgggaatcaagaaaagttcacctccttcatgagacttcttggattaacctctctcagatctgagcaggttgtccttctagaattgtcttaatgcatacatttgcagtcccttgtaaccttgttagactgcttctttcatgtagatgttttaaatttttcatagtgtgttgtgtacttgttcaaacgcaaactccccaagagagattcacttctggcaccttcatttttgcttttcatttcccctaatacattgctggacacttaattggtgttcaataaacatggtgaattcatttaacaaaagttattttgcacctaccatgctcacggctacaaatggacagcattatcacagcaactggacattacatagcatgcggaatggcagatggacagaccatatctataatatacttgggtaaaattttgaatgtttattagaatttcatccactgtctcatgtcttatagctacaagttaatttccaaatttgaatatgtccatacttgtttattaaaaagctggggacgatactctgtgagggtttctaaggagcatttgataaggtgtaaaaccactatagtcttggattcttctcattgctgagcagaatgggatgtgtcctgcagcaggttgagtggctctatgtggttttatgaccatacgtaggaacctgcttcttctcttgaaatggctgttttgttttatggagattggctagactggcaggtgacaaggcaagaggtgggctggccacgagagccagctgagcagtgcgagttggtgtgattcagccatttgtcaccaccatattctgccatagatagatattttctattcgagaaagtggatcaaatttcactgtacaccactttctcactaggctagaaatacatgaatggtggggcatagttcactccaaatctgatccatctaaacttttctttctggtgagttgatctgttttgagattttacactttacataaaaatagtatagcagccactctttgccagtcacaaaccacctttagctgagagtattatcatatcaattgtttcaaggaaatgacaaatgagtagttaccaaaaaaagaatgaatgaatgaataaataaataaacacaagggaatgagttgttactagacagagaagaaaaagattgcttggcatgtcccaatttggttattgaaaatttttatttttgatgcagtgctcttcttttttccttccttccttccttccttccttccttccttccttccttccttccttccttccttccctccttccctccttccctccttccctccttctttccttctgtaacttaacacctatttgattttttgaaaacattttttattagatgcttagatcagctgggacaacttaaattgcaagctaccagaaatatcatattaaactaaccagtgaagatgacagtttggatcatggaggtagggttgatttcagctgaggtttgctttagcagttgcaacactgtgatcaagatctgccttctctccctccatttcaatctagtttcctggccttggctctattctcagcaggtcttgtcttcctgttcctaaattggccatgagcatctcattccttattctaatccaacagggattatacctgttggtatacctactcctcctacttcctcccttagtctgtgggggaaaaaaaaaagaaagaaaagaaaagaacttctgagcttcaatgtgattaggtcatatgcctatcactgaactgatccctgtggatagtgatgggattttgctgataagtctcagtctcagcccctcccccaataccaccatccactttacagctgtggcttcactcaacttcccttgaaacactgtatggagaggaatggatgcctaaatgacaacttgggtgtcattaccaagaaaaagggaactatatgcaagacagtcaaaaactaattaaatgtcctctctaaggtttcatttttaagatagcacagagtttgctgctgctcctcctctttcttcttttttttttttgagacagagtctcactctatcacccaggctggagtgcagtggcatgatcttggcttactgcaacatccgcctcctgagttcaagtgattctcctgcctcaccctcctgagcagctggtattacaggcacacaccaccatgcccggctaattttttttgtttttagtaaagagggggtttcaccatgttggccaggctggtcttcaacttttggcctcaagtgatctgcccccgttggcctcccaaagtgctgggattacaaatatgagccaccgtgcccagcccacattcttcttaaagggtttgagattttttttggaaattacagggcatatagctttgtgctttattcaaaatgtcatagagcttcaaacagttcttcctgagacagatgtaaaacaattttaagatttctgagaagtaatttatatatccttataatagtcataccatgtgaaacctggcctgctaataataagaagaaacatctggaactagtgacagggtcaattttgggtattctctctctatggagaggactagttcttctgagattgatgttggcagtttggaatcttttcccagtgggaaggaagacttagaagaggatagttgatattgcctctcctcccacaagcaagtttcatctttatcacagttccctatggctatgccattttgagatttgtatacaaaccctgtacattagtgagggactcactcagagaccacctagactccaatcagtatccagcctttaggagatggcttgacctgggcagcttccccagtgatggagtttacaaaggatgacaatgaccatattttaaatctgttgttactctcttgcaagactcctctttttctcttgcttgctcttcaccttagcacgtctgtacacacctgcctttggtataacttgaaagacagccctaattgaggcattcatctcatacaatccaagagtcaggaacacagcttttggaaggaatgcattgtggattcttcagatgtgatttaatgaatatccaactgtacttagggactaaaaagagcatttttaaatgagattttgctctgaattggaaagtaagttgaggtgggaaataagccagccattaaatgctctagttttttttttttttttttcttgagatggggtctcagtctcactctgttgcccaggctggagtgcagcagcatgatcatggctcactgcaacctccaactccccatgctcaggtgatcctcccacgtcagcctcccgagtagctggaactacaggcatgtgccactatgcccagtaaatttttcataatttgtagagacagagtttcgccatgttgtccaggctggtctcaaactcctggactcaagcagtctgcccaccaaagcctcccaaagtgctgggattacaggcatgagccatcgtgcccaaccatagattttttttttcataatggcagagaatggctgcaatttagggtctttcttaggttcttcctcatccatttcttgcagaaaatttagtactttgtatttctttcaataatttcaacaattttatcctgacttttcccagagcaaaaattaggatggggatgttagagcttcctttgagcaggctatcatcgcaatgaaatcttgaccttgccccttgtagttgcctattgctttataaaacttgttattgaaattgcaaacagtccaaattatatagtagtttctaatgtactttatcagggtgtcagtttttcttttgcaagtgttttgaggagatcagattgttaatgaacattctttgagaatctgaacctgagaactgtctctttaggatgaagttaccaaggacagatgcaaaatttgcaaagatacggtgttccagcctcctccaacaaaggttaacaaccacccgagaaccccagtgccacttacctaccacctcttacctttggaagcagattgcccagtgacggataagtgtggaaactgttcaaagattgggaaagaaaattgttagaaaaggcacatagagaagagtgggattgggggcaaaaggagaaggaggatagtcttctgtgtttttttgattggttaacttaaaatctcagctatttgtttacacaaaggctatgttgatgtccatattcaacagatacaggtatttggctcagaaaagcacatggttcccagaccatttgccaaatgtcctatccttgttcagctttggttattatgaatatccttctggaagcaactgacacctaacatgtctgaatcctctggacctgtagagttcttaccccggagtgattacaatttctgaaaagaacatccctgcaaaattagctttcaaaatacgtgcagataagcccatagaactgggaattcctccagggaattatatcctaagtagcctactacaatgcttgattccttgggcaccagtggttgctcaataggttttttaataataaaaactagaaggaaagaactattgttagctaaagttaccatgtaataattggcttgggtatgtccctgcttgtttgaattgcttaatgtctgttctttgcacagcagaaactcttgtgccacttcctgattagtcatcttggtcttctgtttcctgagctgtgctccatgatctcgtgtaaatatatacaatttgtgataaaatcatcttgctcattccatagcaggtataagtgggttaattctattgggaaacaagctcaaattttaacagaagtttttctttgcttcaagggaacgagtttcccaacagtgggaattttaagcattttggcaaatcaataggggagatattttcaaaccagcatgattctatttggctcaggtaaaagtaagcccttctggactggcttgcaggtgggttcttgagtcttggcttatttaaaaagctgctgcctgttcttaataaatgccatgatatgaggcaccatgaacaagctggatttaaacctgccctatcaataattttactcataagttcttggcaagtatgtttgttgtctgctgtctgcctgtcaaggttgtcagttagctaagcatcagccaaccacatgatgctgagtccccatgattaatctgacttggtaatactgttcatctatgtaaagaattggaaaaagtagatctcccttcatgcgtgtgcgcgcacgcgcgcacacacacacacacacacacacgcacaccaatttgtttaaaataaaaaaagattagacgaaagcataaaatcagccctctggtctgaagcaattaatctgtagaagatgctacatatgctgggtgtagtggctaatgcctgtaatctcagcagtttgggaagctgaggtggcaggatcacttgagctcaggagttcaagaccagcctgggcatcaacacaagaccttgtctctactaaaataattttctaagaatagctggatatggtggtgtatgcctgcagtccctgctgctctggaggctgaggtgagaggattgcttgagcccaggagactgaagcttcagtaggctatgatcacatcactacactccagtctgtgtaacaaaatgagatcctgtctcaaaaaatttaaaaaataaaatgaaaaagaagatgctacgtacattatacacatataaattagtaaccaaatggtttaacaacctcagtgattgtgttgttctgtagtttgatgacttttatcttgctccttctcattgccattgattgtaccaggttatttcctggagcatgttgtatatcaaggtttatgcaactgtacatttaacctttcagtgcctagctttccccttttcctatagaatcacaagaatttgaaggcaacacaatatgttttctatcttatagtctgaagttaatgcatattaatggcatgctgctattactagttaatactgatgccatgaggattagataatcattgtaaaaaatgtttaatagagcattttttacaatacttagtggatgccagtatactaaatcctttatatatgcttaggtcttttatttcccacaaatctgtgaactaggaattatgaacgcattttacaaaacaggactcgttgcataacttgccaagtcacacagctaatgaacaggagagtcagaacttgaactcagggttgcctgcctctaaagtcctccactaattctcattcattctgtaaaaatagaacatggcctctagaatctcgtcatttagaaaagaacagccttttggagattggttagctggtttgagaacatgtagtttgtttatctgtgtctttgactagtaataacgttcagcctcattaaatctagtaagctaaaaggaagcaggaaatggctgtagtatagacgcttgatatttcagcgatgataatgatggataataatgtgatttcacagcttgggttatcagacccaggtgagtggataagtggattcagattcattaaaatcaccgggcctagtttgtggccttcctttcacaaaccccttaggctgcatattaccctttaatagcatatttttcccattatagttgcccttgctattcatttcaaccacattacaagtataaacatgtacaagggagaggacagatgtccttcccttctgtattaactctcttgttgtatgaaataatgttatgtattaaattattgtctcagtttatagagtctgctagactgtgctgttcagtagaactttttgggatgatggaaatgttcaatgtctgtactgttcactaaggtagcaactagttacctgtgttagttgagcgagcacttgagatatggatgatgaaactaaagaacagatgtttaagtttatttaacccatctaaatttaaatgtaaatacccacatggctggtggctaccttattggacagcagagatttagaatagtaaagctgaatggaccttagagtacatgtaaggcaacacattctttttattttagaggaatgtaggactcagagcatgaaaaggagtaaaaccaagcctaggatcctggtctcttgacttctagttcataatttcttccactaaacttaaaattgttaaaaatgttactttgaactttagtatttgaagattatcgtggtaagactttgcttatatttacaaaagcattgtaacagaaaataaattttgaattacaactgtgactttatcatatttattttacattttatgattgctaaataggtcatatattgacgtctttacatatttgttgggagcaaaagagttgaaagtaaagttttcttcccatctatgttatttagccattgattcccctctccaaagggatcagtaatagtttctttgtgtatctttttaaacattcagatatattaagtatttaaaactgtgtattgttctctcatctttttaaacaactggtaggatatgtacactacacattcatatttttgcattaaacttatatgtggagatcttttgatgtgagtacacaaaaagggtactttaaaacagatacataagcttctattgcacgtaccaactgtagtttaatgcatccctatcgatgaatatttacttcctttccaaagttttctcttaaaagtaatgctgtagagaataactttggacacataactttcatgtgtgcaaatacattataagataattcctagaaatgaatgcactaggtcaaatagtatatacacattttaaattttgataaatattataaattgctctccatagagtcacagcattttatattctcactgacaatctgtaatctctatgccttcatcaacctagtgtgttaccaaactgatcaattcataccattctgacaggtggaataaaatctcagtgtagtttaaatgtacatttttaaaaattgtgaatgagctgggcatcttacatatatgtaagggccatttgtattttatttattgtgaaatatgtttgtatgctttgtccatttccatcagtttttaaaattgacttagaggagcttttatatataagacaaaatatgacatatatggtaaacaaaatgcaaacattttcttcagttgtttgcctttttcactttgtttttcatggtgtttgctatggagaaaatataaatttttacataaacagatatgccaatctttccttttatagcttctggttttttgagtcaaaaattgagagaccttcctcattctgagagtataaaatagtaattatttttaattttaattaatttatttttattgacacctaataattttgcatgtttatggtttaccatgtgatgtcctaatacatgtacatattgtgaaataatcaaatcatggtaattagcatatcaatcaccttaaacatttatcattcctttgttgtgagaacatccaaaattctctcttctggctgcttgttggcagtagtcaccttactgttcaacagagtactagaacttattcctttctatgtaactatatctgctgaccaacctcttcccatctcccactccctcctattctccctagtctctggtaactactgtcctactttcaacttctatgagatcagtttttctagattctacatgagtgagatcatgttgtatttttctttccatgactggtttatttcatttatcataatgtcctctagcctcattcacattgttgcaaatggcaggattttatcctttttgtggctgaatagtattccattgtgtatatgtactgtgttttctttatccattcatcccctgatggacacttaggtggattctgtatttcactattgaaaatactgctgcaataacatgagcatgcagatgtctcttctatatactgatttcctttcctttggatatatacccagtaatgggattgctggttcatatatttttaacattttgaggagcttccatactgttttccacaatggtagtactgatttacattcccacgagcagtgtataggagttccctttcctttacatcctcgccagcataataacgattttaatatatttggaatttattctaaagatgtaaagtatgactcagacatcatttattaagcaatccatctttttcccagttatttgagatcccacctttatcacataaaaattttaatatatctttgagtcaacatctcactttgtagtctcttccatggaatctgcctattcttgcctgtaccacctgttttaattattttagattttatagtgtactttaatatattgaagaactattctctcattgctgcatttcttttttaggctgttcttcaccactgttacttgtttatattttgtatgaaatttagattcagcttgtctatttcaaaaacaatttctgttggtatttttagtaggatcatattaaagttcaagattgatttagagactttcgaaaagcattgaatctttctatctgggaacatgatatgcctttccatttgtttaagcattcttttatgttttctgtcagtgtttaatggttttcctccaataacttttaccatctataatttagcttattcctacattgttcttttttatgtcttcaaaatgggccttttgcatgtatgcatcaaagctattgacttgtattgattaacttgggcctcttctaaattttttcactttagaaaaaaaatattttagcaattggttattttatgttttccaaagacctaaatataaatgtacaggtgatgaactgcactttttcctttgaaatttgtatgcctttactttctttctctgatataattgtattcactatttcctccagaactagttaaactagagtagaaatttttggcatttttttggttcctaatcaaagttggaaaaacagacttttcccttgaaatgtagtgctggcatttaggttgagatagaaatatttcattatatgtttttaatcaagaatggatttgaatttcatcaaatactgtttaaacatctatgataataatttgaggtctccataggtttattaatatcataaatgaactattttagccttataactttaaaagccttattcttttaaagttttattcattctcctcccattcttgttcactattcgttgcccattcttgttctatataaaaaccccagtggtccctgctgtgaattcaatgacatcttatttcttttccttaagtcagagcaaatgtgcacatcagaagagcaaagtgtcaagtaatgatagctggaaattgagccacaaataaacagaaaatattttcttcattgttatttgtgtgtatgcttgtgcttctttttttcaagggagtagaccactgttccacatgttccacagttgttttatggtggaatgctctagttatggaaaaggagaatggagtctagccgtataaagttactaaacctgcttggatatgagtcaagggtatcctttttgtgcccaaactagaaaacctttccccttctcatatttttgagcaaggtgttttatgttgcaaagtagcccactgtctcttttcaactgcataagcccaaataacattttatattccagtcagtcacaaaatgaaaacaggaaacgtctttgaagcaaggcaaaaatgtcagagtgtctaaaacatagaagtacttggtgaaacactttcagcgtcttagctctgcctctggctagtcatttccactcgctgggctcagtcaggtctttcattagtgaaacagaggtggctgagcacttcctgtgaaatcgcagggacaggattgtggccctctggagagggggccaggaggaaaaggaaccagacagctggttttcgggagccaccagatgggagcaaatttccaaggctgctgagaagaatggtctagaataacagaattgttttgtgaaggagccttcctaaaccaaatgttctgagcgtccccgcaagcagagcaaatgagcacatactgtgttcatggggaaaaggacaaatgactgtacaaatggagtaacaaacaatttacgaaaatgtatgtggcctaaatttagtatcaaggtgatgggcaaaatgacttacaccaatttgtgacggtcctgttgcaaattcaatgacaaagccagccagtctacctagtccatagtatccagcagatatatcagtggagatggcccgagtgcaggctgcttaaataagataaatcatctgtgaagaaggaaaaggtcaaatgtgctattctctgtctttttttttttttttttggtctgaattaaatggaaaccattacaatttcttccaagaaaataaaaatcagcacctacaataatgctgtctccttctgaccctgccaagtctgactgcattccacctggaccctgcctttgtctctcatgtttttatccaagaataagtaggctaccttgtagtaaacaggaaatcttactcttacctcgcactagttagttatgcgtggtacttgatccataatcttctgcccccatgtcatagaagataggtttttccaactctcagatggaaaatcactagtgcactacacacacacgcactcatgctcagaaatattttcacagatccatttttctctgtgtgacggaggttacataattatatcagtggatgtcctgcagtccagctggtatatgtagagcaactgcatgtttgtatcactctgttaggtgcagtgtaggacacaaataaagagagagaagggagagaacactgccgagtcattaggggcatgctttcagttcctatacagccaagtttttttttaggcttggcctatgcttttttcttagtttgggtttagtatgtattcattcattcatattgccatgtgtgttcaacaaatattttgggatgcctgctctgtgccagacattgtgctaggttagagggatgcaaagacaaattagaactccttttctcaaggagacttctggttattgtatttgtgataaagttttaaagttactatactttgcctgcctagaatgtagttggatctcaaaagaattactgagggttggaggtttgagtggcagaagagcaatgattgatgaaacagagttttgaaagatgagtggcctatttgtcatggaggtaggaatggggggtgggtgggcttctggagagacacagcagaagtgtagagaagaccatggtacttgtagggaacttctgtggtttagagtgagatggatcttgcaagagctcaggctggagactgagaaaatgctaagtcatggggggtcttacacaacattctagagaatttagactttcccctgtagacactgaggggccgtgaacagcatttgtacctctgcaagatttttctggcagagacatggaaaatggtttagaaggtgaagataaggagctcaattagtgggctatttaaagtgtgcaatccacagataaaaggcaaaaacaaaacctgaatcagaagagtataccagaaaagggtgccagcctattatatatggcaatttatgatttatttaacattgaaggaaaaaacaggccttcaaaaataataaaataagaaggtgctagctatttacccctataacttcaggtacaagaagaatatttttattttactgagctcctcaactgatttaaaaaattaatactcataccagattgtaaataattcaaggaatcatagccccttccttactttttttacatttgtaagatttaaagagtcatacacccagataacatcaggctgcagagttttagagaccaactccttcagtgatttttcaagatgagaatgttctccatgttctcctgcagaagcttctctgggagccccaatatgtacaagagacagaggtagaccactggctgtgccttccctcctcctcctccccattctactcagctctgaattgcagttgcatagtttgcaaacttaatgttgtcaaaccttgttattccataatgggggcatagttgtgcaaactggaagtgattgatttacccagggacagaagacttggttaatagtagaaaaggatccctaggttccctaattgttggacaattgctcttagcagttttggttaacctggtttttatctggcttctcagtagagatgattctttcataagatcacctgcacacaaccagctactcatatatttgcttatatgtgtcatatctgatttatgtacattttctgtagacaagcttgttttaggtcatgtacttattacttactaagtgtttgttttctccatacttggggatctaaattagtaagcaacaaactgacttggtgggttcaactcaataatatccaatgaagccatttcttcccattcctaaatcctaatttagctgtgggaagtttggatcaatggaaattaaactccatatatgccaacactatgggttgataacctcttccaagaatcattgcctgaccatcatgttccttctacctgaccactccttcctgcacttttatcacatattactctaagggatcatgtctaactttttgtcttcctcaattagactatttcttgaggccaggaaatgcatcattttatccatagcatctaactcaatatctaatgtgtaataaactcttaatagaaatttacttaataactagatagatagtttaagatatgcccttgatgtagtcaagaagacaaaatgtatgggtacatttccttcttgtgtctggttcctctttctgcattgtcagggcaagttttaccctctaatttcttgtggaccagcagctgtcttaattgacagtcccaccaaaccctggatttcataggatgtcccagacaatgagaaatggcttgaagatagaaaattgtctgtgtcttaaaataatcttctataaattatgcgtattaacacagatatgtagcaaactataaaggttattttgctctgaagaggaattcagaattagaacttggatgtagcaggacacctctgttctcattgccataaagaaaaaaaaaacaccttttatattgaatttcagtgaaccttgcagccagcatctgtcccattaattttcatatacgagaacaatgtggcatgattactcaccagcaacagaagtagcagttttataaatcttatgttgtagtggctggaagggacagggttgtgctctcattgtttccatattctttgtgaaattcacctttgcagggggtggtttgctctttctcttccagatgtgcacagaaatatgccatgtcactaaacgtcatgtggcttaacatttctccaattttcagctaatctactgagaaagtagtaattttttctgactagtggtggcctacttctcctataaggctgtcttttacaatgagggaagttggcctcactttatttataaaggtgcacctaaggctggtgctttctggttctggggctgcttaatccaccctctgtttcatttgatcctatagagtttgggggagggctgaacaacagtttcattgacgtgattcagattcaatttgctaagaacctgattgtgtttatgacattaataagaaacactttaagccttttaatacgaatccccagtcactctgcttcttccctttctactgatgatactttgtgatctacatagtttaaactttcattacacaaggaaacttctactaccacttgatgtgtgtgtgaataggctatggggaaaaaaaggttcatttttgtttgagttttttacttttcataggtcattgtcaatgtggtaagtatgctctttagtgggatgatccaacactagggcttcatattcaatatcatttacagaaatagtaaatgtcaataacagctaatgttcattgagtgctaatcttccaggtactgttcaaagagttttacctattatcaactcaattctcccaacagccatatgatgttgttactgttattatagataaagccacttaggcacaaagagattaagcaactagttcattgttacagagttggaaatggaaagccaggtcctaacccaaatgctctgttgcgcacttctctgctgtctgcaggtgggatgagaggtgggtgctgagctgcctcctgtggtgctgttttgaaacctgcccatcccaaagctaagggagtatcgctgtgctaaagggttcagtcagcagccttgccagttcggaatcccctagaaccaccctccatgcatgtcatgggcagctctctgagatttctggtgcctcttactggcttgttaagttggcagatttttctccccatttgcttccttcattataaaattcccatttccattttgcctctaggtagaagctcatggaactcaaatgggaaatgatgatggtggattttcctgctgaaaagatgtacctcaaaaggaaaaaatagtgtatttaacatggagaaatgaaatcctccgaagggagcttcatgaactaaattacccagaatggccttactgtctgttgtcagcatttttctgctgcccctttgagcatcagtttactcactcatgtgtgggtcagctctactcatctgtgaaggtagataataaaacctacccccaaaaggttgcagtgaagattaagtgatgtcatatttttaaaaatgcctctgtaggctctggtacattccaatggcttggtgaatttttttttttccttttccttttccaaagggaattaaaaaaaaatgagagtgagttttgaggatcctagagcaagtaatcccagcactttgggaggatcatgaggtcagaagttcaagaccagcctggccaacatggtgaaaccacatctctactaacaatacaaaaattagctggatgtggtggcgggtgcctgtagtcccagctacttgggaggctgaggcaggagaatcattcaaacccgggaggcggaggttgcagtgagctgagatcacgccattgcactccagcctgggcgacagggtgagactccgtctcaaataaataaataaataaataaataaataaataaataaaacagcaaagcttctatgaattctccttttagcccttcatataagtctattcttcaggagccagtttatattttatggttagatacacatattaaattattggtatgtcagatatgattctattagtagtctccagggttcatagcttgttagggaaaatcctcctaaaaagaagttctttttgtctattcttcattaacttatttcacttgtaaagcattaaaatgggtcctctttacatattatgttgttttctaagggacaaatactagtggttattattacagttctttttttcatgtttggtacttcagtggttgattaactgtttcttaatcctgaaatgtggaggaggtttttgcaagtggttgtagcctggttttgaatgaaggtgaaaatgctctttttgttagctctagatcagcagaggtgaataagcatcatgaatttaggagactggcgtttttttttacataaaagttgctttgttgctaattagtagattagaattcctttaattgcattctgaccaaagacttttgggtgttcaggagggcaagttagcatgtgttgcatttgaatttatacatttgagacacattttcttactgaagctgatattcatgaagcagaaaagataaaaacttgtacatacctttttatttcttgattttaatgttgaagttctattctcagaatggattttataggcaacaatatgcacttaaatttatgatctgtttacgagacctcactgtattttgacagaggtcaaaataagggaaatcaatcttggttctcattccaaagagttttttttcctgatatcttaaaaaggctttattacattatgttgatatccatggcagagagttccaaagacatccccatgaaagggctataaatgtgaggtttgaaaccaaggcaagtcaagcagggtaagcaatcttttcacccaaggttttaaaataactgctgataagaccttctcacagattttcattcatttcttcctagttataggcaggaaattctgaaagcaggtgaattctaaaattaccttataacttgatttcagaatatagttacacaaagtgagaataactcgatgaggatgctgtttggatcttgagtactgtaagtcctgtggtttaattgacgagttgatggatttcttttatgcctaaattcaggctgaaaggcctaaaggccacacgaggcagtttatcacgagcgctattctccgtttttatattctggttcattaccagccccttcctcagtacttctatttatataatgttgttctggtcaaggtttatactaaatctcttttaacttcaacatccaacaaatatttttaaggactaatgtgtgcaaaacattatgctaggtgtttcctaaggcttcaaataacttggatgccagttttggactgtaagtgctcacaggataatagaaaaatcttgtttgcaaataactggaacataatgtacaatggaatgtgtcataaggggagtgcacacaatgctgtaggaattccaatgaaattcaccctcatctttcattgtattccctgttatttacctctccttaaaagaaagaactataagaactctacatcttttagtggcgatttcctagatagaaaaataatgaatattaaacatgatgtgttaggattggtgaggctgaagaaattctatgcattttgtcatttagtgaatatgtattgactgcctgcctattcagtgtcaagcactataggtggtaatgtatcaagaggttcatgaactaataataaaggggcacctctgtatttcacaaatatttgctgaatgaatgaactcattatattttattctcctatgtgattcctagataagttctgctacctaaaggaaagcacttatggaatccaaggtttggaaagggcttgaaagatcacattaataggtttcccttttatttgcctttttgaatctcaatatggaataactttgacttatccatactaaattgcatctcattggtgttacacaatctttccagtttttcaagattatttttaacttatgccaacaacatattaaatatcctttccatctatgggacccattccattttctaagtttacctaagactttaaaagacattaagccatcagagccaaaaacagagtttctctacttccatgttgatattctccttaatctacacttccattcattcaataaatatttactttcagggtgttcggatgagctatgggttacatagtgatgaattcagcagacatagcttctgccctcatgaagcttacagcctacaactacagaggatggggctgttgaagcagctaaaaaaccctaccttttctactattgagcaataaaagaaatgtttttcttgaatttctgagatcatttcttgccagtctttgctcatgtcactacctggaataaactcccttttatcatattgggttatcaacatcttatacattcacaaaagaccacataaatgttaccagctgcaaaaatcttattcatgtctgtgaaatccattaacatgtggcaccacttgagttgggctcatcacttgctgatttctgctgtcattatttgtgaatgtctaatttcactgtaagctcatactgtcctttcaaacatgaatgaggcctttaacattgttgtatcaatccataacattgaacataataccctgtttgaggaggcatgactatagaccctttctgtccaataataaagatgttggtaagagtaaataaaaggtctcatttcttgataaactggttagaatcaaggaggtctgagcatgacactagggttcctaaatactttcattctagacacataaaacctctagaagattaaattcagacaattttaaactttagatacacattacaacacaaagaaatgcactattataaattttaatgggggaaggccggtaattcaggaaactgtcagatctgaataatgaaataccagatagttcttatctatttacatactctgtgatttctaacactctgaacaataatatttcagggttctaaatattggttagatttttaaagttttcgaaattatataactagatgactgctctcaaaattaggccggtattttggattacacagagtgcctaaaagtgcatttttcctcctgaaggggaaagccatgtgcctagccaatattttcattccctaaggatccatggaattatgatagcttaccctcatcagtcacccaggctcccattggtgtgaattgggcaatgctgtttacatagcaaatacacttccttttatacaagggtccacaacccctgggccatggaccagtatcagttcacggtctgttaggaactgggtcacgcagcaggaggcgagctgcaggtgagtgagcaaagcttcttctgtacctacagccactctccattacttgcatcaccatctgagccctgcttcctgtcagatcagcagcagcagcaaattctcatagaagcatgaaccctattatgaactgcacatgcaagggatctaggttgcacattccttatgagaatctaattgctgatgatctgtcactgtctcccatcacccccagatgggaccaactagttgcaggaaaacaagctcagggctcccactgattctacattacggtgagttgtacaatcacttcattatatatcacaatgtaataataatataattgaagtgcataatatacataatgcacttaaatcatctccaaaccatcccccactgccaccctggagcatggaaaaattatcttccacgaaacagatccctatgccaaaaagttggggattgcagctttaatagactcagaggcatagtcttagagtgtaacaaatgcacaaaccttttcttttaaaacagactccagagggattgaagagagggaaccagtgataatctatatgcccatttcatggcagacatgctgctgtgtgctttccatgcattatatcattcatccaacaggcatctaaagaatatagagtcaagaacagttaagccattgccacaagatcacctagctagtaaatggctcaaactcagtgactcaaacccaggatttccaaccttaaataaggctctcactcccacaccgcacagctgcatatctgagtgtttatcagtgaattacattgatgtaaattcatttatgaaaatgtcaagatatcgtgagcactagtgcttttaggagagaatatttaactcatttcagacaacatatattaacttcatcaaaagtttgcctgttataaacctgtgactcactcttggtcaccatgatggtgcaacagctgtccactggacaaatactaaataatattttatccttgccccctatttcttatgagaaagccacaatgaacttccttttgtctctcatttcacccttaaagggacaaatagcattgcattatccttgaaagggtcttctgctgacccatctttgacgcttccatcacagggtgacgatgggatgtttgctgtatcacacttccctgtgctttcatgaatgtgttactggtgatgaagaatgccaattctttgtttagtagcagtttgctgggtctccctgaaaataatgtgtcagttaggctacctataaatctgagtcagtaatgtacttctctaaggtatatttatgttttgaatttgtctctgagcaatctgttggggggaaattttgctttaatatgttttataaaaaggtgagaaagtaataaagtgtaatgaagataagataaattttctaataaaataaaatatagaagtgttcaaaatttttgctttccccatatgactttgttttttccccaaatgttaccctcataacaggtgggttctgtctcttgatgggtatcaacacagtgaccacaaccgaggaggatttagcaagggaatcttactacttgtaacaaataagggaaacaccaggagcaattcccaaagcagtatctctccaagctggggggcagtcagattttataagtgtagggtaataaggtgtgatctgattggattctgcaatgaggtgttgtcagaaggcataatctgactggattttgccatgggatgatggcagagctcaatctgtttggatcctggatcctgccattgttgtgtctgcttttaattcagtccctactccttggtcagagcacttaggttccccctgtggttgcactcttggttcttccgcacatggtcaggttatgtgacctgagggtccatggcaactgaaaaacaagaggaactttgttacataaaaaattgaaccagatttgcctggcatggctacacaaatggatgtctctgttcagccttatttatccacagtttttcctcctgctgatccctttttcttgcctgtcctccctgcctgctcacttgctttctggcctctcttgcctctcttcttagccagagctgtatagggatttagttcagtgtttcctccttcattgtcattggacaatattcactcatcagctccaggtcacctccctgtcctcacctgtgaccagtcttccttccaggttcattgccattttcaaagtgagtctgcactctctcaccacccgtttgcttatcacccactctctatgtgattacttgtgatttgacatctgcccatgctactacaatgaaatggctttctcagagactatcatatgtctctattgacaaaaccggattagtgctgcttattttctgcagtatttactgttgttggacaccgcttccttcaactttctcctctcttggttccagggcactatactaactttggtggccatatactcagtgcctccttatacatgagtggaagtaaggggttcagaatgaaatgattcagtcagtctcataaagagataggacatctgtggagattaaagttctcagagttagtagtctcattgctttattccacatgatgttgacaaagaagtagaaagggaaagccaaatccttcaatctatattgctaattaaaaaatgattttcttttcttctttttagtaaatgtttgatggtgtcttgggagtagccttagtagcaaaaggaaatatttatgcatgtctttgggaaaatgtctttccattttctgtggttattgtatctgtaaaaattggacaccatttcttaaaaggattatgtgaaaattttatgatgcctggttggtgaaaggcagagtgtcctgaaatatctaaaatgtagaatcatattctttctattgttttgatataattagaagtgtcgattttaaaattacactgaaaggcattttatttttaacattgttttattaggtgagtgcaaaagtaattgcagtttttgcattgttgaaatttgccatttgatatgggaatacattcttatttttaattaattaatttattattattatactttaagttttagggtacatgtgcacaatgttcaggttagttacatatgtatacatgtgccatgctggtgcgctgcacccactaactcgtcatctagcattaggtatatctcccaatgccatccctcccccctccccccaccccacaacagtccccagagtgtgatgttccccttcctgtgtccatgtgttctcattgttcaattcccacctatgagtgagaatatgcagtgtctggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttacagtcctttgggtatatacccagtaatgggatggctgggtcaaatggtatttctagttctagatccctgaggaatcgccacaccaacttccacaatggttgaactagtttacagtcccaccaacagtgtaaaattgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcacgtcctacgcccacttcttgatggggttgtttgtttttttcttgtaaatttgtttgagttcattgtagattctggatattagccctatgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggttttcatggctttaggtctaacatttaagtctttaatccatcttggattgatttttgtataaggtgtaaggaagggatccagtttcagctttctacatatggctagccagttttcccagcaccatttattaaatagagaatcctttccccattgcttgtttttcctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagtttttttcaattctgtgaagaaagtcattgatagcttgatggggatgtcattgaatctgtacattaccttaggcagtaaggtcattttcacgatattgattcttcctacccatgagcatggaatgttcttccatttgtttgtatcctcttttatttccttgagcagtggtttgtagttctccttgaataggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctaattgccctggccagaacttccaacactatgttgaatagtagtggtgagagagggcatccctgtcttgtgccagttttcaaagggaatgcttccagtttttgcccattcagtatgatattggctgtgggtttgtcatagatagctcttattattttgaaatatgtcccatcgatacctaatttgttgagagtttttagcatgaagagttgttgaattttgtcaaaggccttttctgcatctattgagataatcatgtggtatttgtctttggctctgtttttatgctggattacatttattgatttgcgtgtattgaaccagccttgcatcccagggatgaagcccacttgatcatggtggataagctttttgatgtgctgctggatttggtttgccagtattttattgaggatttttgcatcaatgttcatcaaggatattggtctaaaattctctttttttgttgtgtctctgcccggctttggtatcaggatgatgctggcctcataaaatgagttagagaggattccctctttttctattgattggaatagtttcagaaggaatggtaccagttcctccttgtacctctggtagaattcggctgtgaatccatctggtcctggactctttttggttggtaagctattgattactgccacaatttcagatcctgttattggtctactcagagattcaacttcttcctggtttagtcttgggagagtgtatgtgtccagaaatttatccatttcttctagatttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttcttctctgatcttagttatttcttgccttctgctagcttttgaatgtgtttgctcttgcttttctagttcctttaattgtgatgttagggtgttaattttggatctttcctcctttctcttgtgggcatttagtgctataaatttccctctacacactgctttgaatgcatcccagagattctggtatgttgtgtctttgttctcgttggtttcaaagaacatctttatttctgccttcgtttcgttatgtacccagtagtcattcaggagcaggttgttcagtttccatgtagctgagcggttttgagtgagattcttaatcctgagttctagtttgattgcactgtgatctgagagatagtttgttataatttctgttcttttacatttgctgaggagagctttacctccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttaacagtggggtgttaaagtctcccattaacaatgtgtgggagtctaagtctctttgtaggtcactcaggacttgcattatgaatctgggggctcctgtattgggtgcatatatgtttaggatagttagctcttcttgttgaattgatccctttaccattatgtaatggccttctttgtctcttttgatctttgttggtttaaagtctgttttatcagagactaggattgcaacccctgcctttttttgtttcccatttgcttggtagatcttcctccatccttttattttgagcctatgtgtgtctctgcacgtgagatgggtttcctgaatacagcacactgatgggtcttgactttttatccagtttgccagtctgtgtcttttaattggagcatttagtccatttacatttaaagttaatattgttatgtgtgaatttgatcctgtccttatgatgttagctggttattttgctccttagttgatgcagtttcttcctagtatcgatggtctttacattttggcatgattttgcagcggctggtaccggttgttccttttcatgtttagcgcttccttcaggagctcttttagggcaggcctggtggtgacaaaatctctcagcatttgcttgtctgtaaagtgttttatttctccttcacttatgaagcttagtttggctggatatgaaattctgggttgaaaattcttttctttaagaatgttgaatattggcccccactctcttctggcttgtagagtttctgccgagagatctgctgttagtctgatgggcttccctttgagggtaacccgacctttctctctggctgcccttaacattttttccttcatttcaactttggtgaatctgacaattatgtgtcttggagttgctcttctggaggagtatctttgtggcgttctctgtatttcctgaatctgaatgttggcctgccttgctagattggggaagttctcctggataatatcctgcagagtattttccaacttggttccattctccccgtcactttcaggtacaccaatcagacatagatttggtcttttcacatagtcccatatttcttggaggctttgctcatttctttttattcttttttctctaaacttcccttcttgcttcatttcattcatttcatcttccatcgctgataccctttcttccagttgattgcattggctcttgaggcttctgcattcttcacgtagttctcgagccttggtttttagctccatcagctcctttaagcacttctctgtattggttattctagttatacattcttctaaatgtttttcaatgttttcaacttctttgcctttgatttgaatgtcctcccgtagctcggagtaatttgattgtctgaagccttcttctctccgctcgtcaaagtcattctccatccagctttgttccgttgctggtgaggaactgcgttcctttggaggaggagagtcgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcacttctgttggagtacccggccgtgtgaggtgtcagtctgcccctgctgggggatgcctcccagttaggctgctcgggggtcaggtgtcagggacccacttgaggaggcagtctgcccattctcagatctccagctgcgtgctgggagaaccactgctctcttcaaagctgtcagacagggacatttaagtctgcagaggtaactgctgtctttttgtttgtctgtgccctgcccccagaggtggagcctacagaggcaggcaggcctccttgagctgtggtgggctccacccagttccagcttcccccctgctttgtttacctaagcaagcctgggcaatggcgggcgcccctcccccagcctgctgccgccttgcagtttgatctcagactgctgtgctagcaatcagcaagactccgtgggtgtaggaccctctgagccaggtgcgggatataatctcctgatgcgctgttttttaagccggttggaaaagcgcagtattcaggtgggagtgacccgattttccaggtgccgtctgtcacccctttctttgactaggaaagggaactccctgaccccttgggcttcccgagtgaggcaatgcctcgccctgctttggctcgcgcagggtatgcgcacccactgacctgcgcccactgtctggcactccctagtgagatgaacccggtacctcagatggaaatgcagaaatcacccgtcttctgcgtcgctcacactgggagctgtagaccagagctgttcctattcggccatcttggcttcaagagcgggaatacattcttacatgtggttatgttatacatcattttaataggtatttctcacttgtttttgctaatgacttactacttgctgtttattttatttttattttagactatgaaagtgatgttagataaaaagcaaattcaagcaatttccttattgtagttcaaaatgggtcataaagcaatggaggcaactcacaacatcaacaacaaatttggcccaggaactaacgaacatacagtgtagtggtgattcaagaagttttgcaaaggagatgagagccttgaagatgaggagtgtagtggctggctcttggaagttgacaacaaccagttgagagcaatcttgaagcttatcctcttaaaactacaagtgaagggccaggcatggtggctcacgcctgtaatcccagcactttgggaggccgaggcgggcagatcatgaggtcaggagatcgagatcatcctggctaacacagtgaaaccctgtctgtactaaaaatataaaaaattagtcgggcatggtggcaggcgcctgtagtcccagctactcgggaggctgaggcaggagaatggcgtgaaactgggaggtggagcttgcaatgagctgagatggcgccactgcactccatcctgggcaacagagtgagactccgtctcaaaaaaaaaaaaacaagtgaagttgccgaagaactcaacgttgaccattctatgatcgttcgacatttgaagaaaattggaaaggtgaaaaagcttgataagtggatgcctcatgagctgagagaaaattaaaaaatcattattttgaagggtggttttctcttattctgtgcagcaacaacaacaaacaatttctcaatcagattgttacttgtgaggaaaagtggattttatatgacaactggtgatgaccagctcagtggttggaccaagaagaagctccaaagaacttcccaaagccaaacttacaccaaaaaaatgttcatggtcactgcttggtggtctgctgctggtctgatccactacagctttctgaatcctggctgaacaattacatctgggaaggatgttcagcaaatcagtgcgatgtagtgaaaactgcaacacctgcagccagcattgttcaacagaaggggctcaattctccaggacaacgcccgactgcatgttgcacaaccaacacttcagaagttgaatgcattgggttacgaagttttgcctcatttgccatattcacctgatctctcgcgaactgactcccacttcctcaagcatcttgataacttactgcagggaaaatgcttccacaaccagcaggatgcaggaaatactttccaggagttcatcaaatcctgaagtatagatttttatgctacagaaataaacaaacttatttctcattggcaaaaaagtgttgattgtaacggttcttattttgattaataaagatgtgtttgaccctagttataaaatgatttaaaattcatgatctaaaaccgcaattacttttgcatcaaccttaatatttgaaaattagtaaaattgcaaaaagaaagcccttattagctgttaataaatataaaatatataaaatgtgtgtgtgttaaactaagtgccttgagtatatgaagctatgaaaatgaagacaacagccttactaacattccatctcattattgttataactcctggttccatcataatcttgtttttccatcccaacagaatctgaggtgcagtcatttttgtgaagctgttattttcatcacaatgtgatctatacctaatgattacattacctgtacatctgaagctcgttcgtaaaccatcgtcccctgagagtatacctaacataggaaatactatatatatttggccgctgaagtgctataatgatgccctaaattacatatccctttctacagacataatttgctttattaaaaataacttctgcataactattgaagaataaaacagccacttatgcacaaggtgagggatatctgcatatctgagctagacaaaaagtatgtttgataatctattgtatgttttgctacaaaagcaaagtggttccttatgattggctgaaactctttgagttcttgttctatctttcagcaaatgaagatgctaattgtctttattctagccttttataacattaccttggctcttcaaagtcaaatggaacctggaaaatcgaacttaattccattttacatttttcccttgaccatttcccatggtggggaggtatgtgtctagatttggaaaataagcctgcttagttttttttcccagctcagtgcttagaaacaaccccctctagcaaaaccatgcctaggaaaacaaagtatccagctaggctttcaaggttacttgggggcaagacatggatagttacgtccttggaggaaaataaatacaaggcagtagatccaaatgtatttgtcatgcaaagaacattagctgagagagagcttccatatataggtttgcaaaactgagagcaaagccaaagccattcctgggttttgctttgtgatatagtctccaaatggatactattatgattaatctattctgagttccttaaatgctattgtaacaatgtcaggggccaagttcaagtctaaagtacgtgtatgatgatcatagctgctataatactcataatgctgaagacatagtaacaacaatttataataggagagcagttttgtgcagcaaaatagttccgtggagcagaattagatcatgaaaatgttgcatggtgggcatttagtcgtgaaagtataaatctgtacctaatgattgatgtgaatcaggtttcaaacctattagatgtgccatttaaccaggcaacatttgcccattatttttttgcatgaaaagtaattaccgtatgtttaatagttactgaattgtgactggcaggtgtgccccaccataataataatgatgacaataataatatcttcaacttcaactcactctccacaagtcagggcaaagagagaataaacaatgattatttggcgtgtttgaataatataaaagccagtctaggtaatttaaggcaaagatcactttcaaaagccagatttatatatttttccctcctccattcaaataattgtctcagagtcccatttcaacttattttaatagttacttcctgcatatctgtgatgggttctcaaaaactttcaaaaccactttcacatattccgttacttagcccttaacaacagtgtcgaatagggtaggagagaaacattgttccctgtttttcatttagaaagccgagattcagagaggttaaatgactgtttctactccacaaaaagaaagaaatcagttgaattttctctgataaacctgccaacgttagtgatacgaaagtgaccacaccgatagagtggtgtcactgtcaatattattctgttggcaaacatattgtatctggaagtcaagggcaagaaaagaaagttagaaattgctgagataagggctgtgctaccgaaaaaacactgaaagggtgccccagctagggtctcaaacctatacctctccccttcagcctggtacttcaatactgagtagattatggtgcccattttgagggaaggctagtgttatctcattcagattaagttttgtgttggtgtgacacagatgggtttatataattaatgtcatgtcctagagggctgtgaacattcctacacttgaggcagtgttcaaaatctattactgtttttttttaattaaaaaagaatttgttttctttttcccctagatggaacttaaactcattgtatatgattgaagaggaacaaggagaaggagaaggagagaaacaacatacaataaagttgtccaccaattgtcccaggaaaatttgtttctcacataggggtcatcacaactgctgcattgcagtcagctggaagtataatcttccatgaatctgaagatgtgatgaaagatagtaggcacaggcaaagcctagctttaagaaaaacataaaatgaggactttgagaccctagggcctctttccttcttcttccccttgataggcaaaggcttttttccaaatcatctttgtaagaagtcccagacccacaatgaactattgaaataccatgatccagtaatgtcatcttcttctgctattaatatggtaatcattttaggtgatagatttcaccttcaacagttcttgaagaacattcagacagttcaccctgaaatgggtgaaaaaaaatcaggtacctcctatttcataaggatgtgagccaggatgaagcagtatgttatcaggcttggcatttcgcaagctgagtagagtccatgtgatcaccaggtataatgttatgctggagttgggtttcatctcttgcttgggtttggaatgtaaacaatcttgaaattgtatttggagagaaggaaaccctgggaaatgtttatttttaaaaaacatggattttttacaaaagcaaatacatgttctaatttacatcagggagcagatacctctttacttttttgagatttttctgagacattaaccttaagttatcacttgtgtgtatcaggagaaaagttgggagagtgggagagatgggtaaggaaacatttttaaatgtacttaaatctcccatgatttatttcaagctgtaaagcatttctaaaactcgagtttgttaattatcccaaggaaaaagaagagaggaaaatagtcaatctgatagactggtgacattccatgtagcctgatactaagttgtgacaaaatatctaacattcggccattgtttttgatatttgtactttttcttgtaaactatttgctctgggacaaaaagtcattggttttgaacttgatttgggcaactaaatgatatacttaaccacctgctttagcccgaccatgactttttaatgacttccattttatttggttttggaaattgatttgccctttaaaaataatatcagcatttaaagtaattttgcttgttttttgtttgtgtagtagctaaatatgctaagagaatgacttcaaatatgcagcctttatgaagatgtgaaaattgctgtgctctagctacaaatggcaattccgataacaagagcttgaatgtggccttgaggcaagggaaaaacagaaaaagtccactgaaagtcaactttgtccccttaatttgcaggcactgtggggagcagggaatactccatgggcacaggcatcctcccgagccatattggttgtagtgttgtctattatatctgcacagttcctcctttgattctttctatgaatcatgtgttagcaacccaagtagctgccattagctccagccatatgggtgaaggtaggggtagaggttgcagagcttaaacataggtatccagaaatcattggctcttcccatttcctgactgattctccaactatcaatctgcttgtaagcacattcacaccactcagtgcccctggtacataaaacaagagcagtgactgaaataagctctcaaactagcaaactgaacaagctatacaagacttcttggatattgaaaatactaaacattctcatagctatagaattaattatttggaagatattggcaagtaccttttcatgtctacagtgtccatctattaaatgggaactactactctgaaagtagcagtaagttttattaggggaagggggagaatcatcacaatcatctaaaactgttttgtttaatgttacctgccaagatatgtgtctaagaggctgctgtggctcccaccagccctgacctctgcacatcactgaacctgtatcctactgttaatgatacatatgtcatatttacaaatgcctcatgtgtctcagggtggtaaaaatgtttctattcaagaatggcaactaaaaacacccataggtccatcatattggattaaccacttatatccagctacctgaaactactggcactactcagaaaataaattttcttttaccatcttgcccacttaccgttctcagaaagtcctgcctttcctttcccttctttatccaattaacccaacttttagctcttacatcaaatcttctggaaagccttctagacatttctctcccttcctctctgccattatttctttttcaggataggttagatattatactgggcgctctcatagcttcatgggcatacccatgtcaaagtagccagcaatcgctattctaagaaacttgtctgaatttgtaattggattgtaaatatcttgagtgcaagatcttcaacttgtatagttgtatttccaattttcaacatatgttgagtgaatgtattctaaatataatattaagcatggcctatacctggtaatataaacatggaaatagaatgattatttaatttgtcatgtctgtgaaggacccttgatggtatctagtcttaaccctcaacttacagttgaggaagctgaggaccatagtgtattcattcattttttgtttattaattcatgaattcattcatgcaacacattgcattgagcatccatgtgtgcttggcactgagctagccactgaccaggtaatgctaagtagagcagaacaaaagacatggtccttccctcatagagcttacctcttagtgcagtagagacacagtaatccaatcatcacacaagacatttatactcaccaactgtgctaactggggactatggcagccaactgatgtgaagatttggcttaatggcaggagtcaggaagcctttcctccaaggtgtggtgtttgaactgaaatctgaagaaccagcagaagagcacaaggagggaaaggagtttgccaggcccaggccagtgggtttgaagccttgaggcaggggggaatgaggtgcattcaagaaactgaaaggcggaaagtgcaggagcagaagaatgagggactcaagaagaaagaggcagtacaaaataagaatgaaagatggtcaggggccagttctgtaggacctgtagccatttaaaaatgtttagttattaacttagaacagtgagagcactgaaatgtgtgagggtcagaagaactgggaggtggcctgataacacatgcattttgaagaatctctgctgcagtgtagagagcagattggtggacaattgatggactgagcagataggtgagaggtagccctactgggaagaatatgctgaagtgtgtgcaagagattttggcagcctggagagtagagagcaccactgacctctctgttttttctaactttctcaaaaatgctacgttcacctacatcttatcaaagaaggcctttatttacctatacttctagcatgctttgctttagattttcccatttctcaggtaagggcacagaggctaacgaacgctcctttcctggggccaaagcgttttcagtttgggcatctcagtaacttttggcaccactgctggctttaaggagcctgttatgtagtctatggtggatctgaataccaggcagacagatgacatttttataaatagtgtgaggaaaccccagaagtaatgtgaatggatgagagttcaagaccactgctgacctggaaagccaatgactgaggcaccagaggaagtaggctctcagagggaagacagaacaccccctttccagctcattgagagtgaagcaggtgcttttctgaagcaggtgatattctgaagatccacctcctcagaacaagtgttctgaagtttctctgaaatgcagagaatctaccatatgatatggttttgctgtgttcccacccaagtctcatcttgaattgtacttcccataatctccatgtgtcatgggagagaccttgtaggaggtaatttcatcatggggggcagttacctccatgctgttcttgtgatagtgagtgagttatcatgacatctgatggttttttataacagggttttcctcctttgctcggcacttcttcctgccgccatgtgaagaaagatgtgtttgctcccccttctgccacaattgtaagtttcctgaggcctctctagccctgtggaactgtgagtcaattaaacctctttccattataaattacccagtctcaggtatttcttcatagtagcatgagagcagactaatacaccatctgtaagaaacttggaaaaatgatttgtttagagttccatctgagcagtcatattattagtaagatatatatgtcgggaaaagaaatttacttcttatgactttttacattttgagatcttattgtttgatgctccacgttgagggagccatatttctccacctggtcaccaggctcattaggagggacagatgtggcctcacatttcatgtgcggttcttgtctcagcccttctttttctcaaagattcctgccttttgtctacttttctcaaagtgccatcttccttctctcaggctcttttgggattacccaaccaccattgtaggcaactctagttctataggcaactctagttctataggtaactctagttcagtatcatgactttcatggtttctataaaaattgccatcccacagccttcttcacatctgtgacaggcagttgagaggggactgaggaaaagtattgcccatacatggaatttgtggagactcaatcaatgttacttggattgagtaataaaggaagttatttgtctaagtttgggcagcaagagaatggcagggacagaaccaaaagcagtttttaaacgataatctttttttatttttttactattaaatacagcttgggggcaaagaagagggatacaatttgttgactttcattgctacatttttggacaaggaaagagaaacagagactcaggactgtttagaagtccaaatgctatttatttccccatactacaatggctgttgaaaattctcctataatatgctacaaatacaagtgtattagagagtttattgtgtatatttttgaacatagtgtaatttcttgtatgatgttaatacagttcttgttcttattctctgtaagagcttgtgttgctgttatctctagataggagcaaacttcataaaatgtagaattccctctgcatgcatagggaagtagcttttaaaatattagcctattccattgtttagttataaagtaaaatgattttttaaagtgcaggataagtgaatttttatgtttcatttttagttattgaattgtctaggtaatgcattttaggagggcactgttcctcccagaacttaggaaagcagtcattcaatcactcagtaatttttagggatttttaaaatagatataacaattttaggatgtcaagttttagatgtctagttttaacttgtttggttgagctgacatttaagttcagtcccaatgtgatgtgaatggacctagccttttacctcttctttttttcctcttcattggaaaccagtacagagaacatggtcacttaataagaaagatgtttcctgctttgtttccttttattcaactcagaactgcctgggggaaaagattgcttcctttctgaatgtggtaagccacaaaatggaaaatgtgcacacgagctctttcctattaaccttggggaaaggtgacagaaatgtgtgaacaatgctgttagctgtttaaatgttcttttattattattaatttggtttaagggttttgcctaacaagtaactcccttgatttgtatgtttcagagttgtttaatttttctccaaaataacaatttgtccttttgaaattctttgttagatttatgtcattccagtttcaatcttggtgatgattcttctatctgtcatgagtggtttaatctgcatgtttataattatagcatataaagccacataattcaaggtgggtcttggtatataattcctttgtactttttgggaaaataaggctgtaatggaagtaataaagatacctgagttgggaatgtttaggtatcaccaaatattagctgttcagaaaaatatccatgataaattagaaactgaaatcagcacatttttctggtttcggttcttttggggaaacactgttattttttaattcctggcttaagaattgtatttgattatgcgaagacaaatccaaaattttaaattctaatccaagaccttagataaattagggaattagggaatctgtgtatgtattttataaccatatcaccatatattgacatacctatgtcactgaaggtatattgtaaaagataatttggccaactgtattggaccaactgctcttgaactctctaagtacaattggtttaagatattgcctgaaatgactattttgcttatggtgtcattctttcatggtcaagatgacagttctctaggaatgttatttcatttctagaatgtcagccaaacagctttttatgatcctgagcagttatactctaccatcccaaacacacacacacacacatacatcttacacacacacacacacacacacacacacacacacacacacacacacaaataagccctgagaattttcagagaaattcatggtggaagatctgagattagaacccaggaactcctaagattccttggttttgtatcaaaggtcaataaagagacatgaagtcaatgaagtcaacaactgagggaaacatccctgaggaaatgcataatggaagtgctggtgtaactacctcaaataaatatttctactgaaactgatcagtcatccatttgatcaggtaaggcaggcaagcccacctctgattgcgtagtaattcactgatcattatcctgatttcagtggatctatgccatactcaagacctacatttgtcagtgacctgattgtcttattgccctacacagacatataatcagtccagcctgtgtgaaactccttgtgacccttatcatcatacttaagctgttttggtctttcaaatgtattcgctcttctttaccattttgaagccatcactctttcaccactgccagctagtcttagtaatctttcaccgtgcactgtctgttgcctcactgaatcctcacagtcattctatggcataggtaatatgattgtcattgacattatgttcataagggatccaaggttcagagggattgtattgttcagggttgcacagctaatttctagtaaagccaggaatcaacttgcgtctatatgattccatggtctatgcacttagctgtgatgtatgcgttctatctcaagtgatcacctctaaaatcaggatcagttcacagatatttgtgagtctctcaagagaactagggaaacttctgtaaagttagctaatggctttttaatgttatgtggtaattgtggtgaagcaattgtcaattccagttaaattagcttaaaatgataagagcaaacacatatctttgatgataaggctgggatagaggttaatgtctcatcaattttgggtctctcttagatgtttgaccttatcctaacaacttaagctttaggtaaagtctgcatttggtactctaatctcttcctatcagacacaggtgctcttctctgcccaactgcaattcagtccaagacatgccttctccagttagtctctggagaatgttgttcctacttagactcactgcatagatcttaacttgtactcctgctggtggtgtgcatatatgagctgtcacttgaccatgcagccacacctggagacccatttctaggttcagagtcatctctgatgcagcctgtaatttccccactagcatgccactctgtaggaatgaaccagacattgccacatcattctatgtagcattttcttaaaattagagcttcactataaacaatctttggtcaaggaaaggctttgttatctactccatggtctctttgagaaaaaaggcctggtcccattaagctcttgcctcgtttttgcctttcagggattattcgtgctctgtgttagatgtgaacttttggttaggtacataggaaatatctacctaagacacttgtgatttccaccaagtttgaaacagcaatctaaaagctaactcattcattaaatgatggaattgttaagttggtataaagtgatggtacaaaagcccatcagggcaggtttgaaatctaaatgcctttcagtatgcattgaacatgcgcatccatgagaaaatagtatgataaagaaagcagggtgtgaccttattggattcatatttccttatagaacctccaaattaagacaaatttccagacatttctaaaagcagcaatacaatcaagaaaacaaaacaatgagattcagtatgtagctactgcaaatttgtcagaaaataagtgggaaaataacaagatcctaggaaatctgttgtatggagctgaggaaaaggaatgagtttaggtttttctttaagttattgaagaaggcatgggattatcttctggttgctagtcttcccttagtttcaatgggaaacttatcagacacacttatcttgcagaagcaagataagaggacaaaagaatttggaagatcatggtggaattaaaaaaaaaggaatgtagtcagatggtaaatttagtctaattatatttagagatgggttaacataatcagaaggtaaggaacccaattatgagataggtgtgataacatagatggcttaataaaatacaaaatagaaagatataaatagaatgcttttatataaattctggaggagtttaaaaatgagtgagtgttcaagataacttagaaggaaagatattaatataaacttgaggtatgttggtcttgaagaaaaatgaaaaagctcattttgtgaaatgagtggaagaataccagctctttttcagattttcaccattttattaatattttttgattatagaattttaattatgtaggaaggaatttattaaaaagtaaacacaaaataaaaccaatcatatagttttggccaaattgttgcttttcttttacttcatttcctaaagggcatttctcagagtcacttgaaagtaaaacttgagagggttttatttttttgatttatttatttattttttttagtggctgtttgttgaaaaaccttgttgtaggctgctaggcattcttttactaagaatttcgaatgcacctcatgtgcaaaagactgcttaagtgtgtcactgcagaaactagcaggatttcaaaatcaaactcatcagttttctgtgataggatgatggtttgggagatactcaagaaaggagtacgtgttagtagctgaagatttttctgtcttcttccttgtgttgtcagatccacacttttattttccttttttttttttttgagacggagtctcactctgtcaccaggctccctgcaatttctacctcctgggttcaagtgagtctcctgcctcagcctcccgagtagctgggattacaggtacgtgccaccatgcccagccaatttttgtgtttttagtagagatggggtttcaccctgatggccaggatggtgttgatctcctgacctcgtgatccacccgccttggcctcccaaagtgctgggattacaggtgtgagctactgtgcccgtccttgttttccttttgtcaagaaagccagacattctgtgacacggtaaatgaaaaagggcttggacccaaccccagctctgttgcttgcttgttgcgttgccataagagaccctcaagaagaatctcacaaaatccactgccctcccttagtctcgctttcccactaaatcgctccatgcaaggggagccatttatattgcattaaacttttctcggtgttctctaattccaggggttcttactgcctgagagggtcactccaccatgtgggtaagcggggtgtccagagtctgcccataggccatcagcatcagtttttcaaatcctgggactttcactaaaaaactgtggttcttattttaaaaacaaaacaaaccaaaaaaactgcaaggaagcaaactccacaaaacccatcaaaaccccaaaattttcttaaccttaataacttgttctttttccatgcatatctaattcctccttttaaaaaatacctaaaaaattgaaattggtttaccacatattcctgttggcccacgacacataatgattaatattttttcctttataaaaaattgattgcttttactgtgacaactttgacaaagtctttcaaagagggagagaaatgtgaattcaaaaggataatgtggcttttattttttttactttgatcctgttttgtgaagcattacctaggttagtattgcctcatgttaatcagtgaccataaaggccattaggatgccttgatagatgcccttggtctcccttgactttgattgaagcatcttaaaggcctgtatgcatgtggcacaacatctaacattgtaattgctcactcagtagctctgagcacttactcttcaataaattcttagatgccgtggggatggcgaatgaactttttaattacatgtctgttgttttctatcaccaggaactaaattaatgggaaattagttcacaaggtttattatgcattttccctctttaagaggggactctttctgacagcccttccacttttatccttttaccatttttttttattggcctcagtactgaaattccttctttcttgttccaactacatcagaaacattcaatagacttagcagcctatgaaagtctgacaattacttcctcacggcagccttgtttcaagagtaggtccagaataaataaaagtttttcattttcctggtggcatctgttagttttcaacattgcccagagaaagagttactgtggaatacaaaaaaatgagctatttttttcttccttttggggagaaacagacatatagaaaaccatgagtgcttccttcataaatcatattttatgtgcaaccagtaagagagagagatgatgatggttgtggaaaagtcatagtggataacctcaatttattcagtcttctgagataatgtaagagtaaagcatggaaacaggaatacagagttcatcataattatagatcatccattcaaaacattttgaaaacagtgctatgtaaacttgggatgacaaataatgaagcatagttaacacttctcattggttgtgaattttcaaatacatccaagtatttaatcatggccattcatcattctgtaaatcaaaactaggtctttgaattctctccctttcctattctcagattaaggcatatttggtttcatataaaatcttatgcataattttgaatttcttgggccaatcaaataatggtacataatttaatttaaaaaacttttcagaaggagaaaactcatgtttcacatacttcttattaatcctaaggcctagcaaagggtacatacagctgtagttcacctcaattatacactgtaaatatttagattagagacacgaaataagttttgggagttgcaagaatagaatcagatgtaggaggtattcttgtagaatagagatggagatgggatttaaaattttttatttcactgctagagcaataaaatcagtattaaaaacaaggagaggctgggcacgatggctcatgcctgtaattgtagcactttgggaggctgatgtgggtggatcacgaggtcaggagttcgagaccagcctaaccaacatggtgaaaccccgtctctactaaaaatacaaaaattagccgggcgtggtggcgtgcgcctataatcccagcaacttgtgaggctgaggcaggagaatcgcttgaacctgggaggcggagattgcagtgagctgagatcagaccactgcactccagtctgggtgacacagcgagactccgtctgaaaaacaaaacaaaacaaaacaaaacaaggaggggcatgggcttggattttcataggaagagaggctgagaagaacaagaatgctgacatttgttttgtgaaatgggtctgaatgcctataaaagactagcaggtactcagacatgcctgtcaccacttggcagcaaagcaaggaaataggacagtattacatttgtgaagttgttgatcagaaaactagtgtgcagaggaatttgtgtgttttaaaatattcccaaagtggcagaatattactgacatttgaaacaatagcacagtctacctatgttaaaatggtatttccatttttaaattatattttttcaataaaagtcttgctctcttcttaagttacagatttttactttttcattttgcttgttcctgtgctccttgatccatcaatgaaaatgtgattttctgttggagtcttcgataaatatgtaaggctattttcattgcatcagaaagctgaaagggaccttggctgatcatttgtgtaattgaatcgtgtctgcgtttagggcacaattttcattttatgaaagaaacacaagatttcccatgatgttttgcatgtctacaaattcaggcgaatgagtctttcctcgggctcagtgagatcagtggggtcatgctagtgaattaactggcatgatatttgcttaacaaaagcatgccataaataagagacttaatagtcagttggcaagttgcttcatgctaatgctgtttttaaaatttaaagtaatggatgaaataaagttttatatacatgtctggatttttgaaaaataagaagatttgaggcatagtgtattatagcagaaatgtcttttaatttatttttagttgttttgggtacatggtaggtgtatatagccaaaaaccacaattacttttgcatcaacctaatatttacagggtacatgagatgtgttaatacaggcatgcaatgcattataatcacatcatggagaatgaggtctccatcccttcaaacatttttgctttgtattacaaacaattcaattatacatttttagttttttaaaaatacaattaaattattattgactatagtcacccagttgtgttatcaaatagtaggtcttatttgttctttatagctatttttttgtacccattgatcatccccaccttcccccaccccaaccctcccactatccttcccagcctctggtaactgtccttctatttccatgtcttttaaagtgtctccctcatttctgtgtacatgtgactcactggggaataaacagggaaatcctttgtgatgaatcagatgtcattctgagacacagagcttcttatacttttctttaaaatcatatttgcccttctagatcagtatcaagcaaataacaaccaagaatcaacatgcataaaaatgacaaggttatcccagagttctagttgtcattttcatagttgccagcacccttttccaggaaaacaaagagagtggccatctaagtgatgccgttgaggaagctgcctttcccctaatttctggagagcctagtgtagagggagaactcctgcctctgggaatatagcttttagggcatccctttatccattctccaccattccttcagtgaaggaaattataaaagcaaaactgggacccaaggcatgctttgagtctctttgcctcagcccgggcaactgtattctccgaattgagttcattaatattgtcttcttaggagaaatattatctttctccagactgggcagggagtctggcttgagaggcaacaataaagaaagaatatgtcttcctctataaagaaaggccactttataatgaatttcctttagatcacgaacagcactgtaagacccagactgtcaacttgtgcttttgaggttaggagctgagaaaactcttcttgattaataattgagacctaaacatggcaaaaaacaggtctgcctcagcacggagatcatgcatcgaggtggcgggcgatgccttcagtgggttctcttttcttcctgtctcctctgcgattatgtggcaagtttagagtcaactacaggaggagtttcagacaagaagcacagtttgatagaaactaatttctggattgtgattgtgtgagacctcctgggtgttcctgagactttcggaggatgattcttggccttgctttgtttttgttcttttcttctttaggttttcatctgaaggcaagtaactcatgtccctacaaggaaattcccctgaggaattagagataagcatgcatttctcaataaaacattttcagaaaaaaagttgctgtgtttccgggagaagcagatggctgctattgagagacacctaggtttgtgttctgggaatctgtctcctactcatgatagcagggggcagattcagatctgcaggaggtagaaataggcatcagatcactctgtcctaaaaaacaaacaaacaaacaaacaaacaaacaaacaaacaattggaagaaatgaattgatcacagaagcatctagagctaggaccaattaaaagtcagttagtttatatgacctatttgaagatttctcaacaatcttgacctattgcttaagagcacaacatttgtagtaaaatgagcctaagttaggatatgacttaagatcactgaccagctgtctaagcttgttagggttacccaatattgtgaaacttcagtttccccatttaaaaatatggaggcaataatagcaattacctaactggttattgcaagcattaaaggaggtcatcaatttctgtttgaggttggaaaatccttcaaaagctttctattcatttgagtaacaagcaaaacattctgatttaatatctgtatgtgcttcagtgtctttgattatcacatttagaatattcaatattttacttgtaatagtgaataaaaagtttgctggttgagagagtgaataaatgggtgaatggaagagtaaataatgactcttgtaacactattagttatggagtggatacacactagaccagtggggctgagaaaatttaaaaaatattcaagcagtagaaatttttacttaataaatattgcttgggaggctgaattaatgataaaaataaatgttttgcatttgacattatctacccaataattcacttctctctgcattctctcactctcttaaagaagggtaccacattgatgatgctaaatgattcttgtagaaccagccagaggtggaaaagaaagtagttctgacacttggttaaaaaatatacatatacataaataaagtcaaactccactgccatctctactcaaagtgtgtgcatactttcttaagtacacgctgagatgactcattttacacttctttttttacatatttaccctgttttaatgggttggggaatggcaagagcaaaggaaagaatagctgattaccattcaagacacacatccaaatcacataaagaaatctttagatctgagaataattgtgaaaagaataccaaattccagtgtagctttaaaaagtgcaccgttatctttaattacctgcttgatagaagaatatttattttggaataagaaggaataatttcaaagttgatggccttgttataaatataagcaaattaacttttttagaaagccatttcgaactccgaagacaccagcaacatttttattgattaattctttagtgttataacaagcaagttgtttttatgccgtatttatgagctggtatataatcacacatctcaggggtggagaggaccttaagaatcatccacttcaacagcttatttgaaatgtgtttgtttttatgttctgtatatattctgttcttttggttatctctctctctctgtctctgtgtctctctctccatgtatgtatgtgtgtgtgtgtgtatgaaatagataatatatataaattatcataaaagtatatttacatatatattttaatgcccactctattggacttgtaagaaaatcttacttctataaagtactctagaggcatatacttgtagcttattttgtgacatatgtttggtcatacatctaataacaaatctttgatcaggagcataattccaattagagcagtggttcttgacagcggcagtgttccatcctaggtattttatacatgtatcagaattttattttatcatctcaatgactagtaaaaggcaaggttgctgggtgccctgtgatgcatgtgacaatctttctcaaaaggaatcctcctgcttctcctaaaatatttgaatgacccactggattttgatgtaggttagagactgtttataatcatcggagcctagattttattttacttaaatcgcagagtactgtttttgctattttaatatgctgtaagttttcccagaaaacaacttgtataaattgacaaaacttattttgttcagaatttttccaggagatgctcaatatttcagaaaacgacctatctaaagacaatagtgtttgtggcatttaagatagaaataaagtacaaaccgtcagtctgcatgcaaactgtagttactgtattctcacgattctaattatgggtgcaggcacccaggactttgctatgttttcaaatatagtttttttctattgctatatatggaaattcttataattttattctgaattaataaccttacatcttttttatgatatacttgggacattatattgatttttaaattttgtatacagataggttgtattatctataaatttcaaatcatagatgatgtaacttattatgtctatgataatgaaagaggcattaaattatgtacgagtgcaataaggagttgcgtttgatagggccaaaaagccctgaaataaaaaagcagtatactcaggggaatttgctacatcttctagtacaagtagaattatggggcaatatactatttatcgattgttatatagtaatatcgccacaaactgagtggcacacatttatcatcttagagtttctgtggttcaggagtctgagtatggtttagctgcaacatctgcaaggctacaatcaagatggtggccagagctgcagtctaatttgtaagattggctgggaaaggatctatttcatgagtcatgcagttcatgtaggaatcgaggtccttgaggcctgttggactacagacctcaacttgttgctgtctgctggataaaggcttcgcttacttcctcaccgtgcagctctcttcagtatggccacttacttcattgaagccacaaagggagaaagtctgaaatcaagacagaacatataatcttatgtaatgtcatcatgaaagtggcatcctgttggcggagcttgcagtgagccgagatcgcgctactgcactccagcctgggcgacagagcaagactccatctcaagaaaaaaaaaacaaacaaacaaaaaaaggaagtggcatcccattatctttgctgtattccattggtgacaagtaaggtatagattccacatgtactcaaggggcacgcattacacaagggatgaccactcacctgcaaggataattgaggaacattttcgattctgttcaacacagccaatttcctatagcagtgttaggtggaggggatgagttattgggatcagaaggtagctagtgtgttctgtagtctttattccaatgaaagataactttacccattaatgtgaagtcaattgtactcagagaagagggaaaactagattactagaatgtaatctgtttaagtcttgtaagactacaaagtccttactaatttgatgtgcatttctctgatgagcatttctgtagcactggagtccagtgatgcagggatgggttatccacattttctgccactcaagatctttccatccaggtgatccagctagttctcaggcccatcaaactttgatccagggtcagatctggaagaggtagagagcatttttttaattccttatttaaaaaatgtgatttttgtgggtcatgtgaaggtttgttataaagataaacacgtcatgggggtttgttgtacatattattacatcattgaggtattaagctcagtacctggtagttatcttttctgctccgcttccctcctcctaccctccaccctcaagtagacctgagtgtctgttgtttccttctttgtgttcctaagttcttatcatttacttccctcttataagtaagaacatgcagtatttggttttctgtttctgcattagtttgctaaggatgatggcctccagctccatccatattcccacaaaatatatgattgtgttcttttttatggatgcatactattccatggtgtatatgtaccacatgttctttatccagtctattattgatgggcatttaggttgattccatatctttgctattgtgaacaatgctgcaatgaacattggcatgtatgtgtcttttccggtgaggttgcagagaaaagagaacccttacacactattggtgggagtgtaaattagttcaaccattgtgggaagcagtatggcgattcctcaaagggctaaaagcagaactaccgtttgacccagcaatcccattactgagagcatttaagagtcaaatgtattcatgacataaatgtgtattgaaaatctgatatgttttagtgattgttttatagggagggggcagagactctgcttttatgaagcttacagtgagtgccagccaccattttagcttttgggggccttctctaagaagggtggagtagttaatgtagacaaacatgggttttggcagcatacgaccatgaattaacattatatttccgcttaccagccgtgtgattttagcttacgaaagctactctctggttgtttatttcttcaagtgaagaaatgggtctaatagtacctatcacacaagattttctgtgaagattttgtgagatcctatatattaagcacccagtgcataggtgttctcaatgttaaatcccctctccatgtctgaaccttcaataaaacagactattacaaattacatatgaagactttgatgtttaacgtcatccacacaaagttaggcaaaagtcatatataacaaatatttaagtaatcacctggaacaagatctctttagttattttttaaatatgagatctcacaattattctcagcatttcctgttcattgttttgctatgggtagcatgtcctgattactcagttatacaaaatatttgaatggcttaaaggagtatttgtgtttgacagcataaataatattgtttttgaaaatgtatgaatacagatagaaatcaatggactggagtatatgcatttgtctatcttggattgatctagtgtattgagtcacaaaatttagttgatagaagggatagagtatgagaaacagagtcccacaactttgcatcaacttagaaaattattcttttatttaacattcattcattcattcatttattcaacatttttaagtttccgttccaggatcttgagtacagacatatgtggttttattgcactttgctttatcatgctttgcagatattgtgttttttacaaattgaagatttttgacaatcctatgtcaagcaagtctattggtgccattgttccaacagaatgtgctcactttttgtcacattttggtaattctgaaatatttcaaaagttattattaatctgttatggtgatctgtggtctttgatgttaatattgtaattgtttgggagcacaacaaaccatgcccatgtaggttgcaaacttagttggtaaatgttgtgtgtaatagttgctacaccaaccagctgttccccaatcactctccctctccttaggcctccctattccttgagacaaaataatactgaaattaggcaaattcacaaccctataatggcttctaactgttcaagtgtaaggaagagtcacacatctttcactttaaaccaaaacctagaaaggattgagcttaataaagaaggcatgtcaaaagctgagataggccaatagctaggcctcttgttccagttagccaagttgtgaatgcaaaggaaaagtccttgaagaaaactagaactactttagcgaatacacaaatgataagatagtgtgacattctaattgctgatatggagaaagttttagtagtctggataggagatcagccacaacattctcttaagccaaagctaactctcttcaattctatgaaagcttagaggtgaggaagctgcagaagaaaagttggaacctggcagaggttggttcatgaggtttaaggaaagaagccatcctcatagcataaaagtgcaaggtggtgcagcaaatactgatgtagaagctgcagcaagttatccagaagatctagctaagattattgatgaaggtggctacactaaacaagagattttcagtgttgacaaaagggttttcttttggaagaagatgccatcttggctttgaatagctggagagaataaggaaatgactgacttcaagggacaggctatcttgttaggggctaatgcagcaggtgaccttaagtcgaagcccatgctcatttaccattctgaaaatcttagggcccttaagaattatattaaatctatcctgcctgtgctttataaatagaacaactaagcctggatgccagcacatctgtttatagcatgatttactgaagattttaagtccactgttgagacttactgctcaaaaactaaaaaaaaaaaaaaaaaaaaaaaaaatactcttttaaaaatattactgctcattgacaatacacctggtcactcaagagctctgatggagatgtacaagaaggtgaacgttgttttcatgcctactaacacaacatccattctgtagctcctggaccaaggagcaatttcaacgtctaagtcttgttattgaagaaacacattttttaaggtgatagctgccatagatagtgattcctctggtgtatgtggacaaagttcattgaaaagcttctggagaggattcatcattgtagatgccgttaagaacactcatgattcaagggaggaggtcaaaatattaacatttacaggagttttgaagaagttgattccggtcctcacagatgactttgaggagttcaagacttcagtggagaaagtatttgcaggtgtgatggaaatagcaagaaaattagaattagatgtgatgcctgtggatgtgactggattgttgcaatctcatgctaaaacttgaatgattgaggaattgtttcttacagatgagcaaaataagttttcttgagatggaatctgctcctgatgaagatcctgtgaacattattgaaatgacaacaaaggatttagaacattacataaactgggtagataaagcagcaacagggtttgaaaggattgcctccaatttctcaagaaattttattgtgggtagcatgctatcaaagagcattatatgccacagagaaatattttataaaaggaagagttaaagcagcaaatttcattgttgtctttaaaaaaacaattagcacagccatctcagacttcagcaaccaccatcctgatcagtcagcagccatcaacatcaagggaagaccctccaccagcaaaaagattatgactttctgaagattcagatgatcattagcatttttagcaataatgtatttacaaattaaggtatgtacatttttcagatatgttattgcacacttaatagactacagtatagtacaacttttgtatgcactgggaaaccaaaaaattcaggtgacttgctttattatgatgttcactttattattcagttcactagaactgaacctgtaatatccctaaggtatgcctatgcttgaaaaatgttatcagtaagatgtgtaatgtgtgacaaatccagataatacattacttttggagaagctgagctgtttcaaaagtgttccttttatttgaagaagaagcagagtagcccaatcaagtaattttatttattttgaacttacacaataatttacgcttttgtttttcagcaagtagtaagggaggtgggttaatctgaaatgaaatgttcttagatcctgctgttcagttggttggagggcattaaagatagttattacttaagatctctgttgttttgaaattcccattttcctctgacctaaattctatgatgtaaaagaatcccagccaccacagatagactgtttttccttatttaaatgctttaaaatttagttttgacggaatggtctcttaatagaattcttgtgattctgtaacatcttagcatctttggttggcacttagaatattctcccacaggcatatttcatttgcctgtatgcttgtattcctcattagcttatttcctctggagagtgagactctgtttctgcatgtaacagttgatcagtaaatgttttgattattactatttagatcctgaacatgaacgggctcctattcctttcctattgctgcccccaatgaatttttacattcaaaaagtaatgacgtgttatcttggtttttgtttctgggaaatattaggaatgctttttggcaaatttcaagggaatcctatttggcattagaaattatttattttgaggcctcgtgtaaaataagcttcaggattttgaataactttgggccctggagagagtaatacctaatgaaaactgcaactcaaagaaataatgaaaggcctctttaggaatcaaggtggtagctctagctcttgaagtcttctaatcaaagagtcaacaaccatttttgatctctgatcgccaaagcaggcctcagaggggtcaactggccatgcagcctgatctcagagtaatggctcctcctatttcaagattcaactcaagcatcaattcctgtaagaaaccttgacagaactgccttttctcccacctccaagtcaatgtgaccactccctttttgccttcactttctctcctgacttgcatttgatcagctaaatttatgtaaaaaaatgaagcctacaaccctaagctgatctgaaacacacagcaaatggaggtagccacatatatatttgataatttcccagtttatagcataacagttaaatcattgtaatttcttatggaatgtatggatcaaacattacatttattctgtattgtgtgcatttggagtaatccatttgacatttttttttacattgtgctagaaaagttaatgaggccactgaagagaaccaaaagtaggaattagaactgaagatacagcaagaattgctaaaagaaaggaaatactgtataaaagagaaaaaagacttttatggagtgattttagagtaactatggctttgtaaaaatgcacatcagtttatcagttttataagccaatgcttggtgggtatggagtttttcagtgatccagtttcaagtaaataagcaacgaataagaagaaattgtgtttctttctagaatgtgttgtcaaccactgaatttaatgctaccaatagatgcagactcatgaagtgcagtatgatttcgataaggcctaagcaattatcaaatcagaaatggatctctcatgctataaaattgtacatttaagcaaataattttaagataattggctttcaaactatttttggatgtatcagaagggatggttgtggaaataacagcacagtaaatgaatagttactggaggacaggaaagcagaaaaaaaatctgaagtgtaaggagatacagtcaagctgtttataaaatacatttagatacaaaagaggtcactgtgtggaaaacctttagaatcactgttgaaagaaaaaaaaatgtccacttcccaatttcaagttctattgggattgtttgtattataaagagttgactaataaattcctgccaaggattatttccctatccaaacaaaatgtccacaattctttatgagagaagatgatacccatagcttctgcttcccgcagtggcactctcatcacatatattggtaagtatagaggtgccaaggagaagcaggcaacagttttctccatagcatccatagtcatgctgttcagcagataagcctagtacagttagtatgtcctgattttttgctaaatcctgggaaaaatgaaaagagtcttccttatgcagttgtgttttgctgctgagttgtgtttgcagtgtattagaagaaatacatgtaggaagcctgttttcagtacaccactgtattactccatggtcttgaatttctgaggtcttaaaatagggttattaatattacggagaaagtcacactgctgggtaatctggttgaaatggagacagagcataaaccaatagaggtgtacacatatactaagaattttgactggttaagggaaacaagaaacaaatgtatttgttttcattagtaaatatgattttttctcaggatatgagtaagaattagtgaagagggaacaatattaaattattttccttagtaaggtaggatattaaaaattaatcccttctatttgtcagttttccatgtccagagttaattgaacagttgtgttaacattaatataacattgcttgctggctaccaacaataatagcatggaagaatgttttaaggtatgtcttctggtagaataactatatcctcattattaacagtgtggaaaatgtagaaatgtagaaggaagcaaataatcactcatccagagatgatccatgttaatgttttagtgtatttttttctatatttgtagctttgccaatttcacacagttactttttaatatatacaccggggttaagtctttgtatgattacaaaataaattcttgttcaatttttgagaaaaataaggaaactatgaaaacagtataaagaagagcatgtgtgattcctagaaaacagcaaaaataatttggaactgcttttaatgacaagggtaggcaatcaagtttgctaaaatgaataggataatcagctccagccataaataaattagtatctttttaatgtgtctgttgtgtgtattctgcagctggctcttaagtaatttttaaaggaggcctgatatgtgttcggagggggagcaacatgattagaatatggtagctagcttggaataggcatcatcaatgattcgaatgcatgctctagatcatgcatgctttggaagctacaaagcttctccaaatcttggagaagcaacacagtgagaaacctgtcactaagcttttgaggattcctatctggaagaggactgttaacagtaaactcaggctgcagttgattttctttccatcatcaacatattatctgggtctagtgaattacaaaccctcctcttggcttaacattctctctgatggctttctgcacattggcttcctcttcttgctatcacggtaattactcaggagacataccataggttttcttgggtttagatcagcttaggaaagaaaagaaaacttaatcagtgaacagatttctttggcattttccatgtaatcctgggacccctgcttgttagttttgtcctgtttcctgttacagaaaaggctgaaaatcagcatgcagatgaatgagatagcagatggttttcccgtgatagagaccaacaatttgtgagatagaatagtaacgacaaacatacataagagaaaaggcagaattagagtacagtattttaaaagctttcaggcgctcaataaatgctcactattgttaaagagagagaaaaaaggaagtcctgtataatacatcaataagattttaattttcagttattattatttgagctttatttcccagctctctgacacagatttaggggtggtgtggatattcttagagtggaaattattgaactcttagattaaaggtactcgagttcctagcttgccctgtaactacacatatagagaagatcactctcgtaggtgctagtaagtaggagataaaagttttagggggaaacacagagggatactcagaactgggagcagtcctaaggtggaccttcaaaatgattcatgtcttagaaaatatgatttaagagaagttaggtctatagggtcattttatctgaggaaagatggctgtaaggatctttaatgataggagtcaaatatatgagagattgttgcaaggagaatgttaaccagctattctacaactcgactggggatagaaatagctttaaattacaatatacagaatttagattagataaaggaagtatgctctgaaagtaagagttgttaaaagttagaatatgttttccaagtaggttacaaaattgttttaataaaattatttgtgtttattcaaaaataatgaaaacatatatattacatatataaatattgatatattacatatcaatatataaacctaggatataaacccaatatgtaattgatatgttacatatcaatatatattatacatgtattgatgtcttacatatcaatattatacatgtgttgatatattacatatcaatatattatacatgtgtttattatatgtgtgtgtgtctatgtacaaaaagatagctttttgacctcaacagcattataacttgataattgtcttattttggaactcacgctgaagtagctttcagatactgttctagaaggcttaaattaagtatgttgacaataccccaaactactggatgatatttgtaatgaatttcaccctatatcagtacagaagggtgtcacagttcagcaaaacaaaagagaatacgctttgttaaacctctactttctgaattttaggacagtgaggaaatttaacattttcaatttttttttcttttcttgactgaaaagaaagtcaagccagcaatatgtttctgagagagcagtgatgcatttcacaacactgttaactgtctgcttggctttttgaggcttccagagttcagaattgtcttctcttgaataggtcagtgcatttttttccttcagtttttctccttaagcagcaaaacagaccatttaacttccaaatatttacagcttgcaaacagataaacttcccaaatctgtttttttttatgaaaaggaaaacgatcagccacaataatctataatacgatatatttgaatcaaagttattagatgccctagggtcttttcatggcagattttatatatcaccaccattaataaatctgttatcagaattatgtctttctctctgttgatagttatttttagactaacatattcatacctccttctgatgaaaaacattaaaatttgaataaggcatattagaaaaccctaaagctctgtatttacacaaaggagactcataaatattggtttttcagggtgaagcattgtgtgttattccattttgtaccacagggaaagcctagtcacacatggggcctcattaaaagaggatctaaagaaatatttaatggttgaaatataaggtcttattctgaatatctaccttcactttataataatagaaactgaactgaaaagattcagtaagtgatttagaacatccactcattttaaaagtaatgtctaggcctaggaaagtgacatcatgttccaaatgttacaaatccagcgtttttccttgatgtctttataaatacattgtttacagtttttattctcctccatatatgatgccccttttctaagattatttcgtaggtatatcctttaatgagagaacctcataaataaacttcctgaatttgaaaacgagtgagaggagacttcaagtttgtggactgagctaaacatgtgtctactctcccttcaaacatcccatggaaatggcagtaaagacagaacaaagagaatacatttctgaatatactgaggaacatatactccagagagcagaaacaggaagaggggcctctgctaaagctgaaggagtcttcaggagggaacccagctgggctctgtgttctggttggcagatacagagagtagccaaggtcaaaagcagacaaacagaaagtgaggtgattggccacaggtttggaaatggctcaggtttgctctttccaaccccttgcatgtcactgcacatttacctccagaagtaaagcaggagaactctgcaaagggaaccaacaatctgcatgggagggcattgcctccaagtgtgtgggctggcgaccaagtgcagccctctgccctagttatgggagttggagagggacttactggtttgcatgttccatgcaagagctaaagcaaagcacatctcggagaagtgagccaggaaagtggatcaatccatgccaacaacctatattaattaacctgataattaatatgtatataaagtgaaaaaaaagaaagaaaaaagggaaacagccatgagacaggatttcacaacctctgcactatcaacattttgggcaagatactcttttgttctggagaagtgttctgtacattgcaggatgttaagtagcatgcctggtctctatccaattgatgtcagaagcaagcaacatccatccctggccactgtgaacaaaaatgtctcaatatctagacaaagatattgcagcatactctggaggacaaaaccagcactagctaagaaccattatcctagagaaaatagaaatggtttagagaagagatcttttcaagatatctaccttggtatcctcagacatactgaagaattacagtctctaaaataattttctgatacggaaaatgaagaaatcaaaggacagaaataacccacggaattttaaagtttaattaacaaaattgttgaaaaattcaaggaaaccttccaaaaggaaaagaaagaagaagttataatatgtgaaaaaggggaagagacaaagagaatccgtttaggaagctaagtgtctgtctaataggaattctaaaaccagagggaaaaagcacaataaatgagacaaaataatcatgacatttcctagagttaaagaaaggcacgtcctcagaatgaaaggcccaaataatgttgagaacaatgaattttaaaatacctacatcagacacatgctaatgaaactttagaataccaagacttaagatcctaaagattttgaaaaagaaaaacataaacaaacattctatcataggaatgacaatcacagtcaagttttcaatctgcatcttgaaaatgccagatgataacaggacagtgacctaatgttcggacagaaaacaaacctaataccaaatggaatcaaacaggaaactcagaaatagacacgttaatatgctcaagtgatttttgacagaggtacaaaagtcattcaattgccttttccacaaatggtgctggatgcccaatggcagaaaaaagtaagtcttcacctaagtcttacaccttacacaaaagtcaactgaaaatggatcacagacttaaatataaaatatgtacctataaaaccttttagaaaaaaacaggagagtgtctttcagatctaaggtgagccaaataatgggtcgacttgatactgagatcacaacttataaatggaaatgttgataatttggactttgtaaaattaaaaacctttgccctgcaaaagaccctttaaaaggatggaaagacaagctacagattgggagaaaatgtttacaaaccaaatacttgatctaggactagtaactcaaaagtcaacagtaaaaaattttagtaacaatctattttagaaaatgaacaaaagacacaaagagatatttcaccaaagaggatatacatttggtgaaaaagcacatgaaaagatgttcaaggtcattaaccattaagaaaatgcaaattaaaactacaatgaggtatcactatccaactatcaaaatggctaaaataaaaagattagtgacgagaccaatcgctggcaaagatgcggagaaactggattactcattcattgctgctgggaatgtaaaatagtacagcccatactaggaaagagttcaatttcataaattaaacatacaactaccatatgacccagcaattgcattcctaggcttttctcatagagaagtgaaaacttgtgttcacatagaaacctgtacgctaatgttgaatgttcacagcaactttatttgtaatagctgcaaactggaaacatctccagtgtccactaatgggtgcatggttaaacacattgtgatacatccataccatggaatagtattcagcaataaaatagaacaggcatgcaatggaaagttacatgcaacagcctggatgaatttccagagaaatatgctgagtgagaaaggccaatctcaaaaaattacataatgtatgatctaatttttataccactttgaaaccataaaattaaatgaagaacagattagtggttgccaggggttaagtaaagtgggaggaaagtggttgtggctataaaagtgccacatgaggaatgcttgtaatgatggaattgtctgtttcttgactatgagtgtcaatatcctgaatgtgatattgtgagatgttaccatgggggcaactgggtaaagggcaaatggaatttgtcttatttcttacaactgcctatgaatttacactgatctctaatgaaaagtctcatttaaaaatttgatagtgcttgattttatcagttgatcaagctgctcttagttgaaataacaatttcagaaggatcagcataatgaatctaccagtcactgaaaactctcaattatctgtcttgtcttccctttcagtttttgtttcatttctgttttagtaacctcttagaaaaaggtagtattaaaggagacctaggtctcttttaccaatttaggataacttcacaatctccgcagataaattggtatctgtgtacacacacaaaaataggaaattcttgtgagtagtttacaggggaagtgcttaatatataaacaaggcagtgctctggtaaaattacttattgcattgagattaagaacataataaaattattaaaatagcctaccactttcattacagacttaaaatgttcttccttttatctctgggggtttgataatccctgtttattgttcttttattttgctgtatatcacgttggccatttaatcattggctctttagcagggtgggtgtagagagcattaaaaaataataaatgatgcagtttatcatcacctccctgtaaaacacaaggcacgtgaaggatatgagtttcctttaagctaacgtatttacttaatgtgatttcaaacaaactcctacaaaagtttttggttatggcatccattttggaatttgaaaaatatatataattcatctgaaataaatgtataaaacagctaattttctggtaagatataatatgtgggattatcactactacttttcaaaatgtagtctaaagaatattacttaaatgagctttatgctgagtaaagaatatgggggaaaaaaccctaagagtataaaagcccagaaagagcctcttctacgtatgagagtgtatgtatgatatactatattaatatatgtattgtttaatataacctattttgataaataatagtataatagactatattatatactattatataatatagggaggaaagtaccattaaataaaagatactggagcaactggataactatttgaaaaacaataaacttagaccatttgttgcactatacaccaaaataaatttcatatagattttaaggttaagtgggaacaaaaagatatcacacacaaaaaactgtatctgaaagtaaatatgttctccttatagtagagtgaaggaaatcagttaaagcattcaaataaagagaaaaatgtaaagagaaacattagtatatttgctatataaatggtaaacgttttatatgtcaaaaatcatttgtatattaaatatttatattaatctgtcatatgtggtagatgattaatatacctagcatataacatgctcatataaataataaaaaaatcataagagaaaacaagacaaaagccatatatgtagataattcatcaaatggaaaattataaataagcaaattttgaaggaaaataaaataatatgttctatgattaaagtggtcaatgtctttaaaggctaatattaatagctgacttgtggtctgtaaagaatagtttatttaacatgtgacttataaaaatatataacacttttggacagcatttttagagataaatattccacactttttgtagcattgattaactttattcacatcttaaatacttataaaaatctgaatactactttatttcaatgttatttaaattggtgtcaagttctggctaatctacctaccgaatagtaagaatattgttatgcagatcattgttattctataaaatgcagtaccattcagtcattcaaaaatacatttccaaaaaatgtttagagaaaatgctaaaattatgctaagtgaaaattcagacaatatttaaaattttaatagtctgacagattctgatatagataaacagaaagaaagaaaggtaatgtaattttcatgtaattgtacccatgtatatggggaaaaaaggcttgaaggcagtatacaacaaaatgttaaggacttgttatttgcatctactatttcaagaattccttctgaatataaccaacagtttatgcacaaagaatttaattgcaatattcttaataacggtgaaagtcaaatattcatcaataggtaagtgtttaaattacattatcaaatactcagatgatataattctatgcaggcattataattatgtctttgaagtgtttctgttttaataatatgtaaaagtgcttatgatataatgctaagtaattaaaccatatgaatgtatgttaaaaggctgcatgaaaatatggtaaattgtttgcataggttatcattgagtagtgaaatcataattgctatttctttcttttttctttttttttttttttgagatggagtctcgctctgtcgcccaggctggagtgcagtggtgcgatcttggctcactgcgagctccgcctcccgggttcacgccattctcctgcctcagcctcctgagtagctgggactacaggtgcccaccaccacgcccggctaattttttgtatttttagtagagacggagtttcactgtgttagccgggatggtctcgatctcctgacctcgtgatccgcctgcctaagcctgccaaagtgctgggattacaggcgtgagccaccgcacccggcccataattactatttctttcattatgttctggacactccaaattttcaactacagggtccagcctttgcaatcaggaaaaaaaaagtgtttaaaaacatctctgaggacttacatataacaccagaaggatttatacatttatttagttaatgtggttaataaaaccaaaatattctttaaaccatgtcttagcttcattcttgtctgcaatactttggcactgcctggatttggcatcatgaactgctgcaactaaaataacagtaaggtgcatttatacaaaggaagaaatgagagattaaggtcccctgttaatactaaggagcctgatagattttgatatgttttgtgcactggtatctgtattttcattttattgatttttttctaaggaccttacagctaaagccaggtccccaaagaagtcaggggtttttgtgttacccacaacttggcagaatgtctgcaattactccttctgcttttaactgactttgaatcctctccttttggcttgagtacctggctttcagccaggagaagggaaaatactctatctgttggttttcaaatgtcatttcccctttggctttgttgatggtaaaattctgcctttgcatctgaaattggaaactcttctaatcctggagtctgagtgtaattaatcggaaggctttctcttatctgtgtctaggatcagcctttagtctgatcttcatttttatccaggtgcaaaactcaaatacttttacctttagtgcagtggcccaaattttgtccctagttctgcctgtgctatcattaactgtcattttttaattatatctacacacgaatgtgggccagaggcagcaagatctggattttctcttcctctctgagtccctgacccttggattgttcttccttcttttcaattttggtgggttctgggtttagatttgtagcctaacctagtcaacaacttctttggcatagaaaagaattatttctgatgtgtatattttcccagaagttagaatacccctttgatatatttatttgtgtttaatccacagaaagaatgaagaattaagttatattaacaagagtatcttgcagtatatatatgctttaaagttcacagtgactttgacatgcctctttcatttagttttcacaactcttggaacgtgtttttgcccattttctgcataagaaaactgaatttcagtaaaattaaattgtttttcccaggcaacccagccaggaatcactagtccccctctctcaaaatccagcatttgctcactagaccagagctgctttaaatgacaatagtgtatggaattcattatagtagaatccattctaaacacattgttaatggtttgatcaaacatctttagtagcaccttttcattcatgttttattatgtatgtgtgctacccactttctgtgcagaaatttcaaggaaaaggaaattaggctttctgtaatactcctaatccctgtccttaataagtccaaactctttaacatgatacataagactttcactatccggggaccccagggtactgcaccattctcatccatgtttctcacctctaagcttgtgatactcctgtcatgcagcattttcctttgttgtccaaacgtgtcctgctttaaatgttaccattctcaattctcatctgcctggtgaccttgtgtttcagtggttgtctggagcgttagtgttcattagaataacctggagggtttgttaagacatagcttcttggacgcccacttccaggtttctgattcagttgatctgggccctgaagttgcctttctaacaagtttccatgtggtcctcttgctgctggtctggcatcacactttaagaagtattattctacttatccttcaagacctcaacctaattgatctacagatccttttccaactataggaatatttaattgcttgttactctatgctttcaagctcttgtttgtgtaacatctcacattttttggtgactatttatgagtgtcttctttgcttaactgtcttccttttacaagggaaaagacttgtttgacttgtgtttagatcctcatgggctaacatgatgggaactcatgaagaatttgtatgaataaataatgaacctggaaacctttgttcatttaaagttgcttgtacaggatgaatgttttgcttcattggtttccattattattgtcttcgttcccattcaaattctgtttctaggcaaactggaagaggaaaactatgtaaactgaaaatacaattctaagcctcccaaccatctgagtggaccccttctctcaaccaagggcattccaaagttaacctgaaaaactagttcaggccatgataggatgggggagtaggacatgcctcaatattccctcctcccttctggaactcaggcacagctgaccagtattaacattaaaatagattttaagactgacaaggcagactgtttatagcaataagataccacattccagcctgaatctagtatagtatcacctgacagatagcagaccctgaaagaaatcaaagtattttatctcaaattatggttttttgccatatcttggaatagtcctgcaaatctgtctctcatgaggaaaatccacattctgaagagaatccctttccttttccaggcctctttcctgatccagaagaaaatcaactctgataagaaacatttacaatctattctctctgaagcctgctacctggaggcttcttctgcataatgggaaccctggtttccacaaccccttatcttgacccagacattcccttctattcattctaggtctttagactataacttgactctttcatccaattagaaaatctttgaagctgtccgggcatagtggctcatgcctgtaatcccagcactttgggaggctgaggcgggcagatcacccgaggtcaggagttcgagacaagcctggccaacatgttgaaaccctatttctactaaaaatacaaaaaaaaaatgagctaggcgtggtggtgggtgcctgtaatctcagctactttgaaggctaaggcagaatcacttgaaccccggagacagaggttgcaatgagccgagatcgcaccattgcactccagcctgggtgacaagagtgaaattctatctcaaaaaaaaaaaaaaaaaagagagagaaggaaagaaaatcttagaagcccctcacaccttgccacttcaaattgtccccccttttcaaatcaaaccaatatacatcttacatatattgattgatgtcttatatctccctaaaatgtgtaaaaccaagttgtaacccaaccatgtaaggcacatgttcttaagatctcttgagggatgtgtctcaggctactggtcattcacatttggctcagtctaaatctcttcaaatattaagagtttgactctttgacaactaatacatatatattttaataaccactatgtgccaggaactgtgcttcatatatattattgtgtaattctcagagtaattcccatgacataactatagtacatctgttttaaagatagagaaactgaggctcaaaaagactaagtattttgtaaatattctaagactggaaataatatttgatttcaagattttcttattccaaaatgtgttctgatctgctgctctaccccatctctactaaaaatacaaaaattagctgggtgcagtggtgcacacctgtaatcccagctacttgggatactgaggtaggagaatcacttgaattcaggaggcagaggttgcagtgagctgagattgcaccactgccctccagcctgggtgacagagcaaaaatctgtctcaaaaataaataaatacgtaaatataaaattaaattaactcttgcttgtctcatgacaggtaaagatgatgggacagtggctgcctatcttcagataaaataaaggtaatctccacattaacattactagcagtggttcctgctctcttctttcttttttttctttgcatccagattcaattcctaaattactcccagtatgacagtgatttctactgtgtttctccttcactctctgcagatcattgaagaggtagctgcaaatgcctttcacttgcatggcttttccaaaatgtattcagattggctgaatttctgaatcaaatacaatttattttctctcttatcctagcagaagatttaagcaaagagatatgtaaaatatattaaaaaatttttaagtttccttttttttttttgaggcagggtcttgctctgtctcccaggctggactgcagtgatgtgaacatagctcactgcagcctcaacctcctgggctcaagtgatcctcctgccttggcctcccaaagtgctgggactacaggtgtgaatcactgtgcccagcttatttattctttctttttttttgtacccattaactatcctacctctctttgtcccaactgcccttttcagcctcttgtaaccatccttctattccctattctcatgagttcaatcattttgatgtttagatcaatatgggacttatatttttaagcattttgatttaattttcatccgttggccaagcttggtgttctgcatttgcaaattttgttagggtacagggtagtcatggctgcaatctggagaaaataatattcaagatagtgttccaggacttattattatcatttcttactggtccattggctgagttggaataccagctaatttattagatataccctatgcttccattgtgcaaacctcagcctatacttggctacattctcttgtaaacattttcaagctttttaaaaaaattccaaggttaaatttgagttgtagaaaagaaatatgaataatggccatcataattattccattataaaaacacatacacacactcaataaaatgtgttgttttaaaattattaccctaaggcaagtggtgaatagatccaataaaaataaaagaaatagaatgaataagaagataataagacgaatggaagactacattctttctactgactggtcatcggtttttctaaatcttggtcctttatctccaatgggtctttgaggacaagcacatcttatgtactttgtaaatatttgctgtttatgcacattttgagtatcattgtttagctttgcttttcagatgcatgaaacaagtaaatttgaggcagcaaatgagtaatttgtaaatctagacacaatgagaaggcaattaagaatgctgcttgatgaaaaagaataagagaataatgttgtaggtaagggacaaactaatttcactaatagtggctttatatacagtccagtatgtgaaaatacttaagtaattaacattaacattcacactgtcatcctaggtagtgataagatactggcgaccacacacaaaaatggaatagatatctgtgtctgtaaaactaaaaactcttcaagggagaaaaagctctagtgaaaaatggaattcaccaggaagtcactcaagagaatgcaagtattaaaagcactttattataagataaggatgtcccattcttaaaataatctcctagggaaggcttcaaggatagcattatactaagtagagaagttgtctgacaaataggtaagtataaaaatcagagaacctacagaaaacaaatcattctttgagttgcatgaactttaggaaagagtctttatcagccatgatcaaataaattggacaggtcatataacaagttagaagttgccaaaatttttttatagaagaaacagatgtcatcttcttttgtaaactacatcctgaacatatcccatcctgactgcttcgtggcgtatataaactcccactccacccccttttccccgtctcaagcaagctgacctaccaagctgtgtatttttaatcactttctatagcaatcaagaatttgccatcagagaaactgcttcactgcgtcttatctttccatgcctgttcttgctaaacagatttaagataagagcaactggcagtaagtgcccttcctgaaaacagaggtcacagatgtttctactgaagcccagtaaatggttttgggagacatttgaaatcttagtcatattcaaatcccaaatacaatttctcttttttttcccagaaatttcaaaggttttagaaatattttctactggaaaggtatctctcattcttactcaaaatttagacactaatgagtagatggcaagtcttgtttataagcattaatcatgaagatgaacatttataactgaaaaaagatgttcgaattttggggtttgtaaaagaactaggaatggagaacatttagagttcactatgtggtgatattcacaaaagcaaatgatgatataactatgtcacttggaaggagcttcaggcaggttctttctcttctacatgtaacatgtaagcctgttttggggtcattgctgaggaaaactacttcttaagacaattttacgactgcattgtttcaatagtacaccaaactatgttggaaagttatgacctagaatctgaaaaagaaaaaagtgatgaaggaataatgaaaggctgcatgacagaagtatttagtcttcattcctgtgtttgaagcagaaaaaaaggtattgagggctaaccagactctgccttttgctaaattgaagagtatcacatcaaaggccaaagatccattttaacaggtgccttaaaaagttgtactaaatgatctctgtgcccctttggatcatgaattgtctacataactgcacaacgaatgaacgtaagaaaaatgaattggctggtgaagcctgtctggtaaacaatccatgatcctgagggaattgtagttttgcaaaatattcagcaactactttagtttaaatattttatatgactcattgaagctccaggaagatactactttcttctcaatatcagttcctggttattgtcatcattcctttatcagagtttgtttccttgtcaaatgaactcttaatacatgtatctatcactgacaattttgtagaaaggtcattatctgttctgtttcccactccatgaaacggaacttattccattcaacttcgtgtaaagtcttttcaaatgacacaactgtaattaggaaagatgtcaataactatttacagatatttatgttgtattcagaactgtactagttagagtgtgtggtttaaaaatttaaaaaaaaagtgggtgagatggtgagacttaactaccctattacaccactactaggatggtaagaatttagtaagtaaaccagaaagttattagaaaaacaagtaggagcaaaataagctctgtggcattgaactaagaataaaatgtgaagagaaggggtgagctctattatctacttagggatgccttcagtagaaaatgggacttaaaaatgggcaaaacttaggagggtctttccaggaatgagaatgaacagatcctgggataagttaataaggttggatttattaatcacctgagattctcttttttgattattgggtcatcttgtacacatcaactctgattacaaagtaattagtaatcaataattatttctgcatgtgccactggataaccattcaatacgtaaaaatatttaggtgaaaactttgcttgccaaagtttcaaaagttaaatacttaccaggctattatcactatagaaaacaaaggatgagacgttactatgaaaaggatgggtacaaaagtcatttgaagaagaaacgtactaataaaaatatatttcttaagtactttagtctgcaagtggcataattatttgtgtgcaatatccagaaatacatgcttcttggtgggttttaacagacatatttttacaattaaaaagtatatgcctaatttatgttgtggcagattacatttttcaaagacagttacactgataaatcccaacccacatggccatgttataggtgatgttgacactcctccattgggaggtatggaccagttttagtgactcactttcgtccaatagaacgtaacaggaataatgctacagtccaggtcataaaagggagtagaacttctaccttgttctccctctcatgatgttagaccttggaacacagccacatattgtgagaaagcccaaactaccccatgtagagaaatcacatggaaaggcccacagagagaggaactggggatccagctgatatttagcatcaattgcaaaatgtgagtgaaggaggcttcagatgattctggcctagagccttcaacttttttttttttttttttgagatggaatctcactctgttgcccaggctgaagtgcagtggcgcaatctcggctcactgcaagctctgcctcccgggttcacgccattctcctgcctcagcctcccgagtagctgggactacaggcgtccactaccatgcctggctattttttttgtatttttagtagagacgggatttcattgtgttagccaggttggtcttgatctcctgacctcgtgatcctcctgcctcggcctcccaaagtgttgggattacagacgtgagccaccgcgcccggccgagccttcaacttgattcttccatgagaggccctaaacatcatggcaaagagtctaaccatctccattgtgctctgtctcagttcctgacccacagaatctactagcatagcacctctaagttattgagtaatttttagatagacaataacaagataatatgtcaatctggttttcatatctaaatttatactggctccagatattcacttaagattttatcttggccaggcatggtggatcacgcgtgtaatcccagcccttcgggaggccgaggtgggcagatcacttgaggtcaggagttcaagaccagcctgaccaacatagggaaaccccgtttctactaaaaatacaaaaattagccaggcgtggtgatgtgcgcctgtaatcccagctacttgggaggctgagggaggaggatcatttgaaccctgcagaggatgtggtgagttgagatcacaccactgcactccagcctgggtgacaagaatgaaactctgtctcaaaacaaaaaaaaatttctctctaatatacaaataatatcactttcaaaaatgtatctgctcttctaaaaactcagtttccaaatagtgggctagtcattttgccaaattttagaaaacagttttaaaaaatcacacgtagctccaaatgtggtgcactttccttggttttgttcagtgctcaatacattgatgttgctaaaggccatatcagtgccctccgaccatggaagtttggccataactagttcaagccctgaagaactgaccctgggagtcaatccatatgctgctttgtcccaccaagaagaatctctcttctaagattttgaactaagagattgagagttagagagtagctatcgctgaagctgtcaagatcatctagacttgtaccatctcatgccagtcagatgactgttattaaaaagtcaaaaaataacagatgctggtgaggctacagataaaagagcatacaaattcactgctgcttggaatgtaaattacctcagctactgtggaaagcagttagtcagtttctcaaagaacatttgacctggcaatcctattattaggtatatacccaaaggagtataaatcattctaccataaagacacacgcatgcatatgttcatcgcagcagtgttcacaatagcaaagacatggaatcaacctaaatgctcaccaacagtagactggataaaggaaatgcggtacatatacatcatcaaatactatgcagtcattaaaaagaacaagatcatgcccagtgcaggaacatgtaaggaactggaggccattattctaagcaaactaacactgaaacagaaaaccaaatgctgaatgttcccacttataagttggaggtaaacactgagtacacctggatacaagggaacagtagacactgaggcctactggagggtgggaggaaggtgaggatcaaaaaactacctatcaaatactatgcttatcaactgggtgatgaaataatctgtacaccaaacccccataacatggaatttacctatataacaaacctgcacatgtatccctgaacccaaaataaagtttttttaaaaaaaaataagatcatctagacttgggtaggtggccattgtggacatcatacaagcagaagaagctgatctatggagaagacccataggacagtagtattgagaaagcatagagtcccagagagagacaatccagtttccacagccttgactaatattattgctttataattctgtaaaatttcctctgaagccttccagtaagctccttttccacaaacaagcctgtttgactagcttcttaatattaaaaccaaataatttctcaggtggcaataagggggaagtggagtgcattggtcacacaaaagacaacaacatgaaaatcttaattgttttcagtgtcaaacacttgagtttctggagacaaaactccctcttctaagaaaatcaaactattatacatgataattgtcactttgttagttaagacacatttatacaacattttaagatttggagggtagatactttattaataggtggtatggttctgttcttaagttatgtttctgatttttagatagatcattccctgtttctgtttgtgggaaaaatggctgtctcagtaggctgcattataaactcagttggaaaaaactggtttatttgttgaatgagaacttcatttattttgtgtaaatgagcaccactttttattattcacaggttattgacaagcataatattaagttaagatgcttgacattaaaggattaacatgtacaaatttgaaaaacaacagccgcctagtagacactcagaatttctgttcattgatcaactaagcataatatctctgctctttagcaagtggtttaaaaaattgatggttattagtagtataaatcttggaaaatttgcagagaaaatataatttgtctattctaagtatgttaaatggtttaaatgatatgttaaatagtttaaatgatgaatagcgtgaacaatattagctatactgtattagccattagccttgtaacaaattactcccaaacttaccagcttaaaataacaagcatttattaactcagtttctatgggtcaggaatccaacaacagcttcatggaatgaccccaactcaaggtctcccatgtgactgtcatctagctgttggccaaagctgccattttaaagacatgaatgaaacaggattatccacttccaagctcactgtgtggctgttgtcaggaagctttagctccttaccacgtgggattctccatgtggctatttacgacatggcttccctcagagcatgtgacacaaatgatcagagaaagatctaggtgcatggcctcatctcagaaatgaaaatccttcagttttattgtatcaacacaggtacgatgtaggagggacaatacagtgtgtggaagctggagatggagatccttgggagctgagttggaggctgctaccatagctatatctcttgctagagttcccgattttgcagcctgccatcacctcacctaagactgaacagaatcactgcctagatttacaatatcccagtatattctttttcatgtgcactctcactttacatctcaattttcattccgagcagtacttttaagaaagaattatcttcccctttaatgtgaggaaaaactcccctgtgtataaaaacaaaataatcattcaccatctctttctagtgtgtgacatgcagtgagatttaacttcattgctttgttagaatattctgttctctgtggagggccgtgtttttaaaaaatcactcttcagtttctgctgcaaaaataaaataaaattctctgtgaagtttgtcaagtgaaatggacacaaacatggctcaaagtctagaggaaataaaatgaagccacaatctcagtctatgaaaaagagataagttaggataaaactacagcaaaaaatgtacaggaaaagaatgctgctctttaggagagaaatcagaaaagtcagaagataaaatacagagcaaaaagtttactgatcccaacagagaaacaagaaacctcagagcacttatatgcaaagtatttgcggtgttttggggcccactgactgtaagggaaaccaggtatacacagctttagggcacaatggagagaaagctcttgatatactctcctgagtctcataaacagcaacatcctccaacgtaaatgacagtgaaagaatatgatgaactcctgatgggttgatgccacaggaggatccagccttatttttcctcagctctttcctcaaggaaaagactgggaattgataatactaaattgacaagtccaaataagccttcaggcaaagcagatgatccttttttttttttttttttaagtatccaaaccagtctcagatttcttcagccagaaagcatgtttttgcaggctttttacaaatcctaagcaaagttatgtagttctcgagagttatagaaaaccaggtttgcatcttggctctgatacccctccctgtgatactttagaaggcttacctggcctctaaaaacctccatcttctcatatgtaaaacacaaaaaaccctgacacatagtatgtgctttgtaaactgtagctcttgttaatagtgaataggttttgtttgtttgtttttcccaaaagaatttgatgcttgtgttttgaggagttaaaattctcaatgtaatagaagactctataataaacttacgtcttcttagggtgatacgaaaattattaaactcaatccccctttagttgcaaacaatcaatactcaataatttttttgaattgatgaacctctgattgtgtgcaactatcttaattatgtctatattcttggtcttgtgatgaaaagtatccagaaaatgtctactattcatcactgtatgccttcttctttttagcacagagctttgtacatacgaagttctcaactaatgtctgttaatttaaattgaagaagctttagggagttactacaatttaggtctggaactcacatcccattttccttcttttgtcccacccctacccatttcagccatgcatatgtgtatttggagccctggatcttcaaaaaggcagcaaggagctaattaagccattaatgaattaactttattttttgaagtttataacttatttagacttagtgatctttctttgctcattaacacctctccctgtaggcagagagaaaaaagattaaaatgtgactctgtgaattcttaggcccatataaattcctaagtacaggggaaaagcatcgatttgtaagtcaacatgacattagtcagaagtgttggtttttctttatctgcaggatctgtttccaaacatatttgatacccaggacttgaaactacatcaattatttgaggaatcttgttagggctccatttgtatggagaggtaacactcactggtggcagtggtttgtgggtagaaggggccttcgggtatgtgcggcaaccttgtcaccagaagctgacaccaacaatacacactcacatttaaaaaatgccaaaattgtatccatcacctccaaaattttccttatgtgaaaggttttggcaaatccttgccagattttaaatgattcattctacatttgtatttcacagttataaagcagaactttgcacaacaagttaacttgccaaaatattatgtaaatattgccaaaatattatatcatcaaaatattgtataatatctgtgtattactttttgtattatatatttgtattacataatttgtgtatttatttgctgcttatttaatttataaacataacagaaatataagggaaaaaaagccagataaattttccagaatagatgagaaatggagaaatctgagtccttccttcaagttcattgattatgagttgagtaaccatgatatgctagtatcttttcaaatatataattttttgattatataaagataaggttgatcttcatctcagacaattttccagcctagtagaaacaataaacacagttggattgtaacccaaacttcaactgtaggtcatctcacctaagttagtggatatttggtataatgtttagtaaaaagctacactttgtggcccttcatcatagcaaatattggctttattggcctttaatatcccaaataagaattatcaagaaaataggctccattttcattattaagtatttcagagaaataaaacaataatactgccttaccattgtaggtcattttatagtttccaagggttttcaactatatctttttttaaaaatttgaactttataacatccctttacagagaagacattttacagaggaagacactgagcatcagggacattcagtgactgctggctggtaggcagcagaggtcttgaccagacccctggcttaatcttcagagttcttccatgctgatgcatggaagacttgcccaaggaagttgtctccatatgaaacagccttgaaaataagatgactttcagtctagtttgatcaacatttatgtaaacatgtaattaaaaattgtttgcttcaactcaacagtatgtctctgaatgggaactggttctttctcaggaatattcttggctgaatgtgtctgtgctgtgtcatatgcctcctctttacatatgactgtgggagggtgtggctgtttctataaacactgaaaacagacctgtggctaacaaaggattgtgggtggcagttgcttttagaaaccttggtgaaacttttcaaaagaatgtttcctatcaagcggtgcgttgtacatgtgggagaatccctgacagcacgttgctcttcctggagctccgtgagcatttattcccagtaatgtcctttggtgcttctttccttcatcccttaacgaacctaatccactctagccactcttcgtgatgtgaggtcaagagggtgaacatggcagatgtggcatttatgcgattacattctggtggaagaaaatgggccattaaaatgcaaaccaaaaatcaatgatctgattaattgcagattgtgataactgtaagaaagaaacagagtgccctgataaaaattaagtacgctgacttatttccatagggtttctgagaagatcttcactctggggaaacaatatttaagctgcgagctaaaggatgacgatgacacataggaaagaatgttccaggctacaagaccaatcagaacagaagccatgaggcgggaagaagctacatgtctctaacttctagtcagtatgaccagagtgtagattgagacagacatgcagcatagaatggaatgagatgaaaatggagacagaggcgggatctagaatatgctatatcttgagtcttctaaaatgtgtccagcgtctgttctcagtgcaacaataaactatcaaagagttttaagcagggctatgagtttatctgacatctgttttaagaggtcattctattttatatgagtggaagagacatgaaaaagaccagttagaaggctaccagaacagtccagcagagagatgatgttgggagcaaataaagaattccactgtggaaatgtcacatttgagatgcccaagagacatctcagtagaagatttcaagcatccattgtatataaaaggctagagctcaaaggagaagtctgggtcagagatagatatttcagagttttgaacatatatgtgatacgtaaacaggaatacagattaagaataggggataggatcaaaccttgagaaattcgaatttttaagataagatatggaataaaaagataaaactgtgaaggaaagtcagcaatgtgaagggaagagcaagagtgtggagttgtcaaagagaagaggatctcttgagaagaaaggagtgtttgatttgaatgctgctgagaagtcaatacaaagaaggcaggttttacaacaggaccagcctcataattagtgcatctttcaaggagtgtgaagtactttcttcactgatttctgacattccgatttgtcttactttacttcattgcaccaggaggaatttgaagatccatccaagttgtcagccatgaaaacaaaagtgcagcacgtgagccccagctgtgctcctacctccttggtttggtttccatgagtagttaagcttagaaaaattgtgaagaaacttgttgtgtgggagcgatttttcaaagacctacaaacagaagtaccacttgacccagcaatcctaaacttgtatatatacccaaaagaatatgaatcattctatcataaagacaaatgcatgtgtatgtttattgcagcactattcagaacagcaaagatgtggaatcaatctaaatgctcaccaaccgtagactggataaagaaaatgtggtacatatacactactgaatactgtgcagctgtaaaaaagaacaggatcatctccttggcaggaacatggatggagctggaggccattgaccttaccaaactattgcaggaacagaaaactaaatacctcatgttctcacttataagtgggagcgaaatgatgagaccacatgggcacatagaggggagcaacagactctgggtcttaccagatggaggagggagagaatcaagcaaaataactaatgggtactaggcttaatacattgggtgacaaaataatctgtacaatgaaaccccatgacatgagtttacctaaacaacaaacctgcacatgtacctctgaacttaaaaaagaaactttttctgtatcttaggatcatgagaaagaatcacgttcaaagagtaacaaaattgatattatatttagacagggaatgggattgcaagtgaagaatctgtggaatctcttgatttgtgaagatttcttttagagttcagtaatggatctgtgacatccaatttttctagttaaagagaaagagcattgaactaagaatcagagacttggtttgcagtcccggattcattggttattggttgcttaaacttgggcatgtcacttaaccattctgacccctaatttccttatctgaaaatggtaaaaatcatacctacctgatagacttgttgtgagtgttaaaatgatgtggcttaaaacctagaggaggcattcaattaatgataccttatttttattaatattagcatattgggagtaagcacagggccaaatgcaatcatgtatagaaaagcattccgctaactataaaacattgaataaaatgcgctgatgtgtttatgattgataactgttttttgtcagctttttaattttagctgcaccatcttactttttggtacagatctatttactatctaggagttgtgggggacttggtgggtagccagaaaagatgacagctagcagagcttaggcacaggagcagatgtaagtgcaggtggctggcagtgtggggaccctggaagcagctgctctcagggtaaaatccacgggaggactaggcagggtgagagagcatccccaggcaaagtagagtgacctgcctctgagagtttgggtgtagaatgcagcaggatgactcagaaaagtctgcagagctttagaaatgcttttttttttttttttttttttgatgtggtgtaaggttagaagactagaatgacgtttgtctattattcaggagatgttctttgtaggagaaagaaagggaaaaagaaaaagattccaaatattttagtgggcattatgtagttccgtctcttgctccttcccttaattccccctccagaggggaaacagatatctgtgaaactgaaaagcttgcatctttgtgagatctgctggagggaagctaccgtttaaacccagtctccattattttaaatggttttaagcctcacatgtagtgctatttatttttccttctaaaaaatatttctgggttatgcctccatatacaaaactcacctttgtgccattgtgctgttttgatgataggtaatttagctagatttagctaccatctattgagcacttaaaattaatctctgtaataaactctattcaggcatttcatcatttaatttaatacaaaccctgtagaaagtggatatcactcctcttttgctaattgggcactgaggtttaaagaggttaagttaatttctcagtttgctatagctagaatggaataggtccattatttcaatataggtttgccagactccaaagcatgtactggaactactgtggtataaaacaatatccactccttagaaagatcagcatattcatcttctatgtcctatttataagtgaaccggtgtgctcttccctctttattgagatttttttcaaagtaggaaaaagggaaggaaaaagcatttattgaccacatgccatatgccatatttctttacaaatattttcccatcattcttagaaataaaccccaaatgaatatttttgtccatgtctttcaaatgaggagattgcttagagaagttgaggagttcgtcaaaatccaccatgcttatttattttcttttcatcttacatttttacatatctagtgattgtcagatactgagttatccagggttaaacagaagttacagtctgtgttaccaagggcctcgtagattactggagaagacaaagatgcaaataggcaattataataaaaaatgctacacagacagacaggaatatattcaagtcactcttaggcgcttctcctcccaaaacttaatcccccacttccattacgccatggtgccttccagaattagcgcagtttgcatactgaaggaaactgaggggtggtcagaaacccagtttgtgcaggaaaaaaaattgtggagatcaaaattagcttcagtttttaatatcagccattaattctgaggaacaacttcatccacttaacttgattttccatcttccttgagtcccaaggcaaaactgaaatggaaaagaatctacaggatgctttcatttagcaaagaggcaaacaaacccaaatcgagcagtacatcatagcaacccactaattggaagtctgggtaaaacatctctcatcccatttctaagaacttagctatttatccaaagcaagacctcttgccccctggagctctattccccaaagagaagacttctttaaagagatcgtccttcttagaaaaggagatttttctttcccattcagatatttctagattggttcacgtggatagagaattctatgccttttttagccactgtgactcagatataattcattttgccttaaaacgcaaagcatcagtaaacattgttagcattgttatgtcacccttttttttttttggttgttcacaaattttctttgttaaaatcctgtgcagctttttgaattcacactaaagaactttaaatttccaaatgaagaaatttcctggccagtttttggttttttttttttgaagatgactgctgcctgagtgtcaacatttgagaaaatatagaatttaatttttggaagtcactagatatagcaacctgcctggtgccagagaagagctgtctatgctgtactgcaatttgacttttaatccatcgtagatctgctaatggtatggcacatgtgaagtggtaaattcttgagtgtttgagacaaacattttaaggtacccatacataatgttaagttcacgtttaggaaagtagtaccagttaataagattacttatttgaaaataagaccagtttatttcaatctggatattcgaattatcaaataatctttttttttcaggattttcttggtgtatgttacctttttagtgaaggaccagtgtctcagagctttattttttatggtagtttaattatttaactgaaacctggaagaattaatagggtcagaattttagatcatgaaacatattttattgctcagtggatgatattcttcttggtattatttgctcttccccagagtcaccatatggtataaattattttaaattcccacaattatcagttatgtatatactaataatatcaaaatcatttgtttgggacattttttgtaatttattgaattttcaaagtcaattttgttcagaccattttttttttacaaagtagcttaaaggcacttagaaactgacagtattggatatttcatacgattttttagaattgcagtatctgccatttatctgaggactggtgattcaaaaactctgtttttggttaattttaattaaaaacatgtccactcaaaatactgctcaatacccaaatcattgcctaccttgtatatagttatttttcctaagggcaaaatagctaagaccataaattacgatggcaggcacatggtttgctgacagaactatataaaatactgttttcatcctcatgtcagctctggtacatgcctctttactttaattccttggggaatctgttgtaagttatagttttaaaaaacatccctaccccactagctctgtcagcttacctttttctgactgaccattttatttctctgaaagaacagatagaaactgagttatgtcttagctgaacttgtagtgccctaaatattaatagctgtgaaccagtttagtttaatttggatatttcccaatcttacacctgcgatattgcaaggtagttataaaaagtacacagaattcatctctataaatatatgctcattttatatcctttacaatctgtttcctagattcctaatccaaagaggccattagtaccaatgacatgatggatagagtaggttataatgtttagcagctcattggagatgacatagtttgccaagttaatttacacattttcatactacatatattatgtacaatattttttgtatggtgggttttcatcgagtacccttctctcttgtaagaaattattttttaagaaacatgttaaagagtaaagatgttttaaataagcatttctcaaatggttggtccttactaccaagcatattctggaactgacactttagttttacttacttccagcacatttcatgggaaatggagatgtccaaggaaacaggaagacgttaattgatgatacattttcttctaatattttgatatcccccaaagaaaaaaatagtccaggagatagattatactagaacagtttggctacattatctaaaagtatgttcccatggaaaattatataataggcttagtacattttagaccatttttttcattttctttttttttattattatactttaagttttagggtatatgtgcacaatgtgcaggttagttacgtatgtatacatgtgacatgctggtgcgctgcacccactaactcgtcatctagcattaggtatatctcccaatgctatccctccccctaccccacaacagtccccagagtgtgatgttccccttcctgtgtccctgtgttctcattgttcaattcccacctatgagtgagaatatgcggtgtttggttttttgttcttgcaatagtttactgagaatgatgatttccaatttcatccacgtccctataaaggacatgaactcatccttttttatggctgcatagtaatccatggtgtataggtgccacattttcttaatccagtctatcattgttggacatttgggttggttccaagtctttgctattgtgaatagtgctgcaataaacacatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacaatgtaaaagtgttcctatttcttcacatcctctccagcacctgttctttcctgactttttaatgattgccattgtaactggtgtgagatggtatctcattgtggttttgatttgcatttctctgatggccagtgatggcaagcattttttcatgtgttttttggctgcataaatgtcttcttttgagaagtgtctgttcatgtccttcgcccactttttgatgtggttgtttgtttttttcttgtaaatttatttgagttcattgtagattctggatattagccctttgtcagatgaataggttgcgaaaattttctcccattttgtaggttgcctgttcactctgacggtagtttcttttgctgtgcagaagctctttagtttaattagatcccatttgtcaattttggcttttgttgacattgcttttggtgttttagacatgaagttcttgcccatgcctatgtcctgaatggtaatgcctaggttttcttctacggtttttatggctttaggtctaacgtttaggtctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgttttggtaccagtaccatgctgttttggttactgtagccttgtagtatagttggaagtcaggtaacgtgatgcctccagctttgttcttttggcttaggatggacttggcgatgcagactcttttttggttccatatgaactttaaagtagttttttccaattctgtgaagaaagtcattggtatcttgatggggatggcattgaatctataaattaccttgggcagtatggccattttcatgatattgactcttcctacccatgagcatggaatgttcttccatttgtttgtaacctctttaatttcattgagcagtggtttgtagttctccttgaagaggtccttcacatcccttgtaagttggattcctaggtattttattttctctgaagcagttgtgaatgggagttcactcatgatttggctctctgtctgttattggtgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttatttcctctcctgcctaattgccctagccagaacttccaacagtatgttgaatagtagtggtgagagagggcatccctgtcttgtgcaagttttcaaagggaatgcttccagtttttgcccattcagtatgatattggctgtgggtttgtcatagatagctcttattattttgaaatatgtcccatcgatacctaatttgttgagagtttttagcatgaagagttgttgaattttgtcaaaggccttttctgcatctattgagataatcatgtggtatttgtctttggctctgtttatatgctggattacatttattgatttgcgtgtattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttgtttgtgtctctgtccggctttggtatcaggatgatgttggcctcataaaatgagttagggaggattccctctttttctattaattggaatagtttcagaaggaatggtaccagttcctccttgtacctctggtagaattcggctgtgaatccatctggtcctggactctttttggttggtaagctattgattattgccacaatttcagcttctgttattggtgtattcagagattcaacttcctcctggtttagtcttgggagagtgtatgtgtcgaggaatttatccatttcttctagattttctagtttatttgcatagaggtgtttgtagtattatctgatggtagtttgtatttctgtgggatcagtggtgatatcccctttatcattttttattgcgtctatttgattcttctctctttttttctttattagtcttgctagcagtctatcaattttgttgatcctttcaaaaaaccaggtcctggattcattgatttttttgaagggttttttgtgtctctatttccttccgttctgctctgatcttagttatttcttgccttctgctagcttttgaatgtgttttcatctaaatatttgttatattttttgatgaagggcaaaacattttggttacagtttctttgaatatttcattccacttacgcttttcaaccaaatacaataaaaaaagcaagaaggggttgtcattcttttttttttttcatttgttcttcaatttagcattgaaatattaaatccaaaagacaactacctttagtatgagattgtatattttgaaaatgtgcagaggtttaggtattttataatagtgacaatttacatatttataggaaatatagtttcaaatagattttaaggaggcagctgttaaaatttgacatattactgaaacttaattagtaatatcgaaatatttcagataacacagggatgactgagctaacctgattcaacacatcagttcacaatgttgtgaagaacacattgaacattttcatggaacaatgcattctgctgcttacttcaagaattaggaaggtgaataagatgattcttactctcaaagagcttataatttagtagaagaaagacaataagtctgtgtgcccatacatttattaatacaaggtgggtccgggtcatatcttataatttgtactaagtgtcatggggtagaagagaaaaaaacatttaatgtgatttgaaattgagaatgtttgtgtggatatgtattttatataagatacttataaaaaactaaatgcatcaacccacagattttttgtcttatggcctctgttagaatggtagaatgggaagaactatttgggttgttatatacacaggcctagttattattcccttgagtaaaatagggctttgttacagctaacctaataagaatatttcagtaatcaaatatttaaggaacattgttgaggtggcatggaaagtcaacacaaaaaaggaattccacttgagctgtaattttgttttatttgcttagcgtagattagaattgtgatacttgtactgttagttgcactgtacataaatattttgaattactgtcgctgattggaactaccttcgtgctttaaattaaaaaaaaaagatgtatctgtacattctaaatagtaaaaactctttttggctcaaatcttttaattctgaaggaatatactggcagatacttagtagacataaataatcattaatgcatgtatggtgtatttcattcagtagtaccaaaatctaaaacacattgagttgtctggcatggtttcattgccaaaagttgtgatgtgactctgatgtaacctggtttgttctgaacaactccaaatggttcttcagacttgcccaggatccatctggctcctgggaagccttatgttatcatggctataatcccagactctggtgacagtctgcctgggttcaaatccaggctctggtactcactatctgtatgaccttgaggatgttggtttgtctgtttcccttgcaaaataatgaacattatattccctatctcaaagggttgttgtgaggatactctaagataatgcaggtaaaagtgggatgttaacagcatttggtaagttgtaaggactcaggtgctggctatgtaaaaataaacttttttaagatggatagatacatagatagatagatagataggtagatagatagatagatagatagatagatagatagatagatataaaaacctatacctgaaaacattattttcataatatttcaaaagcttctattgtactatctatgcttttatacatagtaaaagcagatgacatgctggtcctactaaatttacaggttaatttttagatagttactaagaaatcaaactgtgtggaattttctggtacaaaattacaatatgcaataccttcctactgaggtacccattactgaatatttcttttctatcatatgtgaaatgcatcaattttaaatatttggagacatacctaatttaagtgaaaatctcggtatttcctgaaagtcgccacactataacagataaccaatcaaatttgtctagcttataatgtctgtcagcctgggtgatgtggatgggccactgtgttctcaactgcactgtctcagtgattggagccagttcatgaagcgctacagcctgtaggatgccaaggaggttctttttcgtaatcacacacaagcaatgtggtaaaaccctcaagggatagcagttgctttcacaatctatttacacacatacacacacatacacacacacacacacacacacagagttctttgttattttacatctggcaacaggaagagcatgctggacagacctctggcatcataaaccatccttccctctgacctctgtgtgaatcagcagactatgatctctgcagaatttaggattaattgcagcaaagaaaaagaacctctctgaaatctaaaatgtagacttggtcattagttcattttgcatgctgtggaaactatatttggcatcattaacagctgcttccatgagatgttgagcactaaaatatgattggtgaacactcaggattttattttgtggtattggttgcaattatggagatgttgatagatcaatttccacatcatctaaacccttaactaagaaataaagtggtacataatatgcatgtcccctctatatgagactttgttaattttcttaatttaaaaaatttttttaattctatgaaggaaaagaaatttctctttcagctgatgtttccctgaacacacattgtgatcatttactatttcctaagtgattcaagcagcaatcttgttttagaatatttcaactgaaatgccagccctggaatttcagtgctgattttaggaattattctaatgacttcttgacaagctttacctacatcaggagcaagtgaacttggcagagttgggataggagacttgcctccaaaatgttaacttatatataaccaccttgttatcgcattagttgttttcatggtggctgtggtggtcaatagcagaggcaatggaatgagctgtaataagagtcagcaaatctgagtggacttggcttctcccgtttgccatggtgtaaatatccccaccatgattgttttcaggctaccaacatgatgtcactaaatgtggaattgagaagggatgtccaaaatatacatcaataaatcagccctcatttgattttcttctcagtgaactatgtggttaaatgacttttatctacctttatctcgccattagcaggagacattatggaaaaatataatgccataaagtcacctctatgtcattgtccttgttagaataaaaattaagacctctaggtttacttttatgggttgagcctttgacctatctgtggaagtggtaagctggaacaacaaagaggaaaatgagagtctgtgcttttaggcaggtagttaatgaaggaccaggtaggaatgaagaagccaagttctagtccaaattgccattgattatctagaagattttggacaattcacttcatgcagtagctcaacatccatcaaagagtttttgaaagtctattatgtgccaggtgttggaagatgtgaaggtgaacaagcagatgatttcaccttaaaagagcttgtagcttagtgggaaggaggaaaaaaaaggaagtaataataacaaagtaagaaaagagctagcatagagctggggaagcaaaacacacagaatgaaagtggaacctgatcttgcagagtcctggaagggttctgggaagagatgactgtgtgctgagcaaggaagaatgaatagaaagtaggcaagaaggaagggtgagatgagaggcttcttgatttgattccagatctcaggttttatttcaccgttaagtatgatgttttagtctctcttttcttttttagaaaccttcactatgttaaaaaacagtttttttctattttttaattggcaaatagttttttttaaatcacaagtaagtattgtgtaattgtgtcagatttttttctgcacctattaaaataattgtataggttttcctttattctttaatgaggtgatatcatatcaaatattagaccaatattatgtatctgaaaaaatatgcacacacacatataaatgagtgtatttgtgtgtatatgacttttgagaatacattaatgagagagattgtactgtaagttttttctaataatacccttgtgatagcaaggttataatggccacataaaatgcattactaattgctttttatttctctttcttggaagagattgtgtatgattgctgtaatttcttccttacgtatttgggagaattcaccagtgaggccatcttggcctgaatttctattctggaaacgtttaaaattactggttttatttatttaaaagatttagggttcttcagattttacattcttctcatgttaactgtaagttacagtttttctttttttttaatgtgttgttattattttttgtatatgtccatagggtacaagtgcagttttgctacactgatgtattttgcattatggtgaaggcagggccttcagtgcctccatcactggaggaaggcacattgtacccaccaagcaaccttccatcatccactatctcccacccctcacccctctaagtctccattgtccacacattcatgatggacagtgtgcactctgcttccatgtgcacacattatttagctcccatttataagtgagaacatgcagtatgtgtctttccatgtctgaattattacacttaagataatggcctccagctccatctttgttgcaagttggtgtttttcaaaaaatttccttatttgggttgggcacagtggctcacgcctgtagtcccaacactttggtaggccaaggtgggcagatcacaagatcaggagttcgagaccagcctgaccaatatggtgaaaccctgtctctactgaaaaaaaaaaaaatctaaccgggcgtagtggtgcacgcctgtagtcccagttactcaggaggctgaggcaggtcgcttgaacccaggaggcagaggttgcagtgagctgagattgctccactgaactccagcctgggcaatacagggagactccatctcaaaaaaaaaaaaaattgcttatccattttattcaaattgtcaacttcattgacataaagttactgttcttatctttttgacatctgtaggatctctatcaatatcccttttgtttttatacctgatattggtcattcgtgctgtagtttttttcctcaataaggcttgttaagagagttttaattgtattagattttcccaagggcaaattgctggccttgttgatgttctctattgtacacttttttctgttttataaatttgtgccttttttttttcactttttctcatttctatttcctttgggtttgatttttcttttttgactttttgaattagagtatagattattgatattcaactttcttcctttctaatatatgcatgttaggccgtaagtttctctttaatgagtttcagctactttccctaggttttgacatggtattttctatattatttaattcaaaatatattctagcattcattgtaatttttctttaatccaggggttatttaaaaaatatgttgcttaaatttaaatgatttgaagattatgtagttatttttctgtatttgagttctagcttaattctaccgtggtcagagcatatggattgtatgattttggtgctttaaaatgaacttgttttattgcttatcatatggtccaattttgttaaacattcaatttgccctgggaagtaacatgcattttgcttattttaaaagcagtgcattataaatgcaaattaaggcatttatatataatgacatatatatgtgtgtgtgtgtgtatacatatatatgtatacatatatttgcttttgacttgtttcctcagctactgggagaggtatgtcaaaatctcaaactttggttgtgaatgtactattctttataaaatttaaaactgtgttattaggtctataaacattaagaatgtttgtatatttttggtgtaatgacccttttatcagtatttttttcatatttatctctagaaatgctttgaagcctaatttgttattaatatatcaataattgtatttcaaactagattattcaattcatgtaaacccgatgtagttaatactttatgacaaatttatcgtgcttgagtttggtcaggattctcaattctatatttgatgtcttttatcaagttttgtaaatacttggcctggatatactcaaatatttcttttatctcaatctttatctctccatagcttttgggattctaattacttgtgtcttattcctttatgtcatgtctttatgttcttttctaccatttttatttttttctcaatgttttcatccagaaatttttctgacctattttcttattaattaatcttcttcttctgtgtcaattctgctatgaagcccgtccactaggttttaaattcaattatagaactttctgttcaaaaatttccactttattctttatcattgattttatttcactggtaaaattatctgtctggtcatctttttaaaaagtaatatgaataacagttatttattctaaaatccttatgtaactgtaatatttaaaccatccaccaggtccatttgtgctgagttttctcctggttttcagtcatttgattttgtatgtatgtatgcttggtaattttggattgggtgtcagaaattgtgtatgaataaaatgtaaaggttctggatgatgatctgttatctcagagaggaatgtattttcttcaggaaggaatttaagtacagatagaccagcttgatgcagttagaaagtgagacgattcaaggttttattcctgtcattctgacagcttgttattttcagtttctcctttgtcctaggatacagcccttcagaggtctcaaatgaaagacggggccttttttctttataggtcccaaactccagtttttgtctttcagttccattaaactatggaaagctctgagctactgttttctgttcagcctgtctgccccatcctgcttgtgaataagcagttgcctcaagtgaaataattttcctgctttctggatcttggtctgtcaagttctaactgtcttaatcattcctcagtatcttcaaacatttcccctgcatttatagttgttataagtactagtatgatctaagctattctgttatagctggaagcagaaatgctgccatcgaaagagattaggcattggaataatgtgatctgatttgcattttaaaaagatttttctgaacaacaatatcctcatatgtgcaatgaaacattttgataaaaattgttctctcaggcccttttcagctccaatattctgcaagtcttgagagtactaatagtgtgtcataccatgatttcaagctgtcaaaaccccagggcttttagttttagtaggctaaagttagaaaagcttagactctggggaaaatggccaagaagaagactctcatctttggtgtctttctatgtggcttcatcactgtacttcttgttagctttcagcaacatcctctcttttctgggtcttggtatctgggcacctagactatttttccagtaacctgaccactctctcctcatgtggtggtgccccattccacactctcttctaaaatgtttcatacttgagatttaaaattcactgtccatcctgcatttttctgattttttttagtaataaattaacatttattgggtagttatgtgccagacactgtgctaaacacttagatggaatattttattccatattagctctatgaggtagggacaattattatccccatttacagatgacaaaattgaaagttaggggagtcatgtagcttacctaatgttacagaggtaaagtggctgagatgaattctgatccctggaatgggcatcatttagaggggtggttcccaaaagccagtccacagactgtcttgttctctaatatataaaaaataattcagcaacatctaggagcataaatccagagattctgaatcagtagttcttggatggggcccagaaatctgaatttttttttccttttcaatgattacattttagtttactgtacaatgaaacagagaaaactactttttttttttttttttttttttttttgagacggagtctcgctctgtcgcccaggctggagtgcagtggcgggatctcggctcactgcaagctccgcctccggggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctacttttttttttaaagatctgagagtgtgaatcttccacctccttttcaaccaaagttgaggaatttgtcctgctataatctcaacccttgagtatttctttttttaaaaaattttattattattattattataatactttaagttttagggtacctgtgcacaacgtgcaggtttgttacatttgtatacatgtgccatgttggtgtgtgcacccattaactcgtcattcagcattaggtatatttaaaaaaaaaaaaaaaaccttgttatctcagtatgtttttattatgcaaatttcctctaaataatgaaagctcctttttaatgttatattatgatagcaaaaggtgtgctctttgtagagttagcaggatatggttgtgtgacaaaaagccaaatagtattttaggctccaatgaagaggaatatctgtgaagggggtctttcttggtatttttgaagttccacttgaaagtgctgttggccatcactaatcatgagggaaatgcaaattaaaatcacaatgacataccaccttaccccccagccagaatggcgattagtgaaaagtcaaaaaacatagattttggcatggatgtggtaaaaaaaaaaaaaaaaaaaaaaaaagatgtttatacactgctggtgggaatgtaaattagtacaatctctatggaaaacaatatggggatttctcaaagaactaaagacagatcaaccattctatccgacaatcccactacttggtatctacccaaagggaaggaagttgctttatcaaaaagacacctgaatgtgtatagaatcatcctaagtgcccatctactgatgagtggataaagaaaatgtggtgcgtgcatgtgtgtgtgtgtataccatgaaatactatatatatatatacacacacacacacacacacaccatgaaatactattcagccatttaaaaagaatgaaataatatcttttgcagcaatttggatagaactagaggccattattctaaataaagtatttcaggaatcaaaaatcagataacacatgttcttacttatgaatgagagctataggtatttaaaggcatccagggtggtataacggacattggagactaagaagcggggaggctgggagtgagggtgagagagaaataactatgcattgggtacaatgtacactacttgggtaataggtacactaaaatcctaagcttcaccaccatacaattcatctctgtaaccagaagccacttgtatccctaaagctattgaaataaaaaaaatcacaaagtgctgttgcctactccacagccatgcaagtttgattctggatctgagacaagctatgatcacattgttgtagagaactgaggtccttggaaaataaaacacaggttcccaaccagaagttaattttattctgctgttaaaatggaactatgacttttcttatttataagaactgtccttcctttttaaggttaaaacatgttattttattataatgcaaataatattcattatttaaaaatagaaaaataagaggcagatgtagttctagctcttaataaacctggctaaacttttacaaatttcatctgatcatttatatacttttctacatgattggacttatttataatttggatttttgaatagtgctttaacattttttacttaaattgtatacattttatagattatctcttgataagcattattttaatgatatatatgtataaataatatatattcttacataatacacacacatgtctatgtaatgacatatatataatattttgcaatggtgcatatgtgcttgttcccttaagatggatatttatttgactgttttcttattgttggattattttgtttcataaataacattctatgctgaaaatatttttaattgctataaattgcccaactaagacatataacttcctgttatcctttcactacctttgataacacactaaatttttctttactatatttcattcccttcttaatctcatttctaaaaactgtatttctgtcttacaatatatatatcattccttcagtactcctacctgttgatcttctcattgttatttactggcttgtcaggtcttggaagataggcttctcatacaacccaagcctgtcttttgacctgactataaatattttattgtttacatcttcccctgcaaagaattcctctaggatctgcccctttcttgttctccaggcagtatgccttggacattctgtagctggctgggactgattccttgccaggtcagtaggacagatgtgtagactaagaaattaactagtgagttcaagtggaggttcctggcctgttggtgcctgtgaacaggattcttttgagtatgattagtgacatgaaggtcctgaataatatcgtaggcagaagaagtgccattactactcacagtgtaagaagtagcttgagttaactggtgaaagagctaaaagtcaatgaaaagtattgaacttttaaaatgtattatctattgaaaagtttaaaagatcatttattgattaaggaaattcctttgactttaatagctgtgagctctaatgggggctagaaactccagcaagtggtacagtttctagaacctagcagataatttttcattgactagaattccatgtgtgatacaatgatttggcaaagtaaatcacaataattattatgttcattgttttctcctttgtttaccttgattaaccatctttggtgattgtttcataattgttgctttctaaacaactttattgaagagctacaaatggctagctcttctcaaccctttaattagtgtctgggatcggtggatgttagttgaggggaaaaggttattttaataatttaagacaaaacaatttagaaattgtatttttttgaagacaacttgctatgtaaccttttataattccctgaatttttctgaaattgatgttttctttagtgtatagcagtgatagcatgaaaccaccactgacttttttagggcaacttgctggctaattttataaaatttgaactgcactatatgaatgaagaatcatctgtagcaattgctcttttccaaatgttcttttgcttcaaatgccgtatctgaatattagattgtttctccagatgttacaggctcatgtttccttctgctgaattcaattgttggttcctgcttatgtttctcaggatttgtatcatttctctgtcttaagtaaggtttttataaatgctcatcaatgttgtagagtttggattcaattcagatagaggctatttccaccggacttttgctcatctacttcctccctggagaatggtgaaaaacagtcctcttttccctcctctgatagggtgatgggctactattgctttctctctcctaatatattgagtacaccgacctctcaccgaaaccttaggtcaaagtgagaagaggtgattgtttttaattggatgattgctaccatatacttctcttttggtgggatcccaaaataaataaataaataaatgacactccccccaaaaaagaggaactaaaaaaaggctgagaaagcatgccatgaaggtccaggcttggacaacaagcataccatgatgtgaattttagccccatcacctactaactgtgtgaccttgggcaagcttttgaactcaccagggcctcaatttcctaacctataaaatttttgtgatcattattataattacaactaagaataagtaccttatcgttttgctgcaatacacgcgtgataattgtcctaaagtgcttagcatggtgtctagaacgtattatgtacttaataattattgtctgaaaaaataaacacatgaagaaaataccttattgtcaaagaatataatactgtgccccaacttgtgaaagattaaacctcttgtgtctccaggatttctaatagcttatcccagaaaggcagtgcagaggacatgtgggctctcttcctactgcagactcgggctgttctgatggtggggtccaagggcagccttgcttctgccatttgctcagttgatcttgtgaacagctgcggttcttgctgtaactacttgctcgctctcagtgactctgtactgtaaatgtttcatgtgaaggagcactgctctaaaacaaagctggaagacagggaggcaattgccagagctgtcattgtgctgagtcagggaaggcttcagcaatcatccaaagagatgtggcatttacacctgcagctggatgggttatgaacccaaataggtccttaaaaaggaaggctcatctcctttccccccaacagccccccacccactcaatttttgcctactttaagggaaggtttttggtaactaatttttcatctgctcattagagcttaccaattacagcatgtgttacaaattataggttccaggactttgggtgaaatatgcttcgtaaataatggcatattttgctgtgagcagtccttgattttggactcttgcattacctttcatctcgcaaattttccgtataggaatacttggatgtacaaatttcaggcaagtatccgatgtatcttatagaatcagctacccgacaatattgtcaaaaagagaagcaacgctttcagatgatgtaagcatagaatcaagcaaggagttggttgaatccttcttgtgcttttcctttgagatcaccttatttcagaatcctaggaggattgaaacattcctactttgatattttcctctggagatcacttgttaaaagtcgtcaggagtgacatttactagtcttgtattttctctggtcttaacttgaaaagttctgctcatcaaaaatgagtatgttgagatgatattttctatagaaattttgtattttacccccttaaaatcctcacttttcacatgaaagtgtatgctcagataaaacaagactcatggagagcacatgggtgagatcatgctaggctctcattgctaggctgagatttgcatttttctgaaaatcagagtgctgaattttcttagctttgaagtagctaatgggacagtgtgtgtatatgtgtgtgtgcccacttgcatataattccgaatcacttgtttatgtgtagtatatgattctatgacaaagagctccctttaatgcaaatgtaaggcattcatgagcatctcatgtataagctcatattttgaactttgtttttcttttactcaaagaatttacaaaatcattttgtggtttgaaaagtaattcagatttcctataaaatgttatataaaattttaaatttagattttagctagcaagtattggcttaactgtagaaagaacttcattttctaggaccattcaatagtctagcttctgctttatgacaatctactcgtgttttttaaaggataataatattaaaacatttttataaatctcacaataatgctttatgtatattaactcatttggtccccacaataaccctgatggatgtcattattattatcctcgttttttttttttgagacagagtttcactcttcttgcctaagttggagtgcagtggcaccatctcggctcactgcaatctctgcctcctgggttcaagtgactctcctgcctcagcctcccgagtagctgggattacaggcgtgtgccaccacacctgtctaattttttgtatgtttagtagaaatggggtttcatcatgttatccaggctggtctcgaacccctgacctcaggtgatccactcgcctcagccttccaaagtgctgggattacaggcgtgagccactgcacccagcctattatcttcattttaaatatgaggaaactgagacacagagagagaatatacattaagatcagaaagctagaaagtctaggaactaagattcagaacaaaatcatctgattccactctctgtgctcttaaatacttcactagaataagtcttattttttataattgatacaactggtctaaatattaatgaagttttaagattcaatttacatatagcttctgtctctgtaagttaccagttattactacctaaaatacacttgtagtcaatagtaacattgaatattcctagattttattttataataccaaccagaataggaggcctcaaaacacctgtgatggaaaaaatgcagtgcctgagtgcatgcagctaagcctgatcactagaatacatttcatttatattttataagataccaaagacttcagaactacaaagagaactatagttgctgcaaccagaaacctattcacatatacgtacttttataaatcatgtgcatatgtgtgtgggtaccttcatgtgtgtgcatatataaatacatctaaaagctgagaaccaccttagtctggggcattaaaattttagtaaacttttttgatgtatatgttgaataagttgcaaagttgaagtctgttccctgcctccatgtggcttacgtacacttgctaatgagaaaggagcttattacaaatattcatagatgtgatatatatgtgtacatgtgtgtatatatatgtgtgtgtatatatacatatatatgtgtgtgtatatatacatatatatatctttctccccctacacacacatacacacacccctttattcgctctctttttttttttttttttttttttagttggagtctcactcttgttacccaggctagagtgcaatggtgcaatcttggctcactgcaacctctacctcccgggttcaagcgattcccctgcctcagcctcccaagtagctgggattactttctactatacaaattttactgtcatagacattggcttttgtacctccaaaatgtttgttattatccacggaaagggtacccacattttacttctatggataaattacacatatattgactgatagctactatttaatgaaactttttttgtgtttcagggtctcaactctatctttctatctatctacttatctacctacctatctatttttttctcaattaattccagaatgttaaatttcatgatggcaaaagtcattattaattttgttcactgacatactaagcacttaaaatgctgcctggcacatgtagagactcagaatatgctttcagaattgaatgaaaatatcttgacaaggtagcacagtttttgcttttgtttttgttttaatagagtcagggtattgctctgtcaccccacccaggctggagtgcagtggtatgatacagctgactgcagcctcgaactcctgggctcaagcaatcctcctgcctcggcctcctgagtagccagtaccacaggtgtgtgccaccacgcccagctaagtttttattttttgtattttttttgtttttttgagatagggtcttcctcagtcttcaggtacaatctcagctcactgcaacctcaacctcctgggctcaagtaatcctcctgcctcagcctcccaagtagctaggaccacagacacacaccaccacacccagctaatttttaaaaaattatttttagtagaaatgaggtctcactattttgcccaggctggtctcaaactcctgtgttcaagtggtcctcccgcctcagcctcccaaagtactaggattacaggtgtgagctaccacacccagcctaatattttattttttgtagacacagggtccccttatgttgcccaggctggtctcaaactcctgtgttcaagtggtcctcccgcctcagcctcccaaaaggttgggattacaggtgtgacccactgtgtcagcctctcattgttttccatctgacaggtgagaaactgaacctcagagagcatggattactgacccagtatcacagctagtgcagtgcagaagcaggagtggaacctccatttggctccactggccagactccctatctgtgactctgtctccaagaagctcttcgaggccagacagcagcatcttctggggtcttttaggtcacaagtatccctggtcttttcatgactacacatttctggctgactttagagctctagatgtttttctcctatgttgatctaccccgtaaggctccatgagaggcttggactattgtttcacagtaggcttcctaagacattttgcttagctccttgaaggcttccacctgctcttgagcttaggaggagaatatggcctagtcaaagagagaagagcataatagcagataggagtaagtgagcaggaaacacagagaaatggtgaagaggaggaaagaatggccaatagaagatggaaaggcagcagtcacggtcacaaaaaaagggtccagaaacaatacaggagatgcacaagagatttcattgcttttaagaagtgttatgctaaaatatcttcctctatagggaaaagacaatggcaaagaacttttaaaatttttatttggctacttctatttaagtattaagtatatcgcggtgtacaataaatgtttacttaacaaaatacataaaactctttcctgggctaaaccttgaaagacagtcatacatatttcataagttttttgttgtaaaatatttgatgatttcgcagttagggggtttcttagaaagtgctatacataatcagatataacctttccattttatatttccttgtgtaagcaccatgacttctagtaatcttgagtgtctccccttttcaattcacttaggaattttgcatttaaactattgcccttgtttagggagaacaaaacaacacatccaaaaaaatgaccaaatgtgtacaacctggtattacatttctgatttacataatttccacctcagaaaagttttcttaaatacaaaactcactcactttattttaatgcccgaaagaatagcccagataaatggactccaaatttgaggcctgagtaataatgcattttaggattagactagtcatccttgctattttcgtggtgttcatcacgtacagagtacaacaagatactctattatcccttcaggctgttggataaatacaaataagcacatacaaccaaaacaaatcattgtatctgtgaattgaaatgcatgtcataagaactttaatctggtgcaattgctcttatagccaagtaaatatagtcagcaaagcttaccttttatgttaagcattttacagattacatatgtaagataaatttaagatttgtgtttaaatgacttttaaaagtaaaaaaagcattgggaagacttcttactcagaggttgtggtcagtcattttcaaataatttttcattgccaacatctcatacataaacttatataagcttctacaacccctcccagagtcagccttctctcttctttcagtaacatcctgtgttgccatctgactgaactgcaccatttgtcaccagttccaacacatcttgtcaacataccttttctattggaagaaaaaaagaaaatgggcttgaataaaaacatgtaaataaatgatgagcactttgctcttttggttgaattaaacagtgttgaaaggtgttagctagagaagacttaatagaaagtataacattttaaataatgtttaaggggaaaaagaaaaagatattttaggtttcagaataaataaaagataaaaataaataataaaagattttaagtattagggatgacttgcaaaatctcagaggtaaaggtaagaaacactagacagaaaataattttatttgaatttaaaaaatgggagagaatccacagaccctttgagggaactggatcatctttgcagactccctgagatgtcgaaaaactgtgagtctgcttgctttctcaatggggatgctcatggtatggggcaatttctcagccctgatcatctgctgcctggaaatagactcagtgctgttggtaggggatggtgggagtgagaccggcctttaggactgcaggctgcatgggagtggggtgaggcctgtgattgctggctttcccccacttctctggtatcctgtatgactcaacagtggcagccataatccccctgggaatacaacttcattagactgggaaccacatccccatcccccacagcagccacagcaagccctgccaaaagagaggctgaactcagacacacctatccctgcctccacctggtggtctttctctatcagccctggtagctgaagacaaagttcataatctcttgggaggtctatggccctgtccactgcctaagaaaccttaatactcaaccagatgtccctagggcaagtttgcaacctgtctataggaccacagctgatgcactcttgaaaatgacacctcctggctggaggctaaaccaaaaccagtgcattaaacaaaaacacaaccaaggacctcacagagtccacttcactcccctgctacctccaccagagtaggtactagtatgcacagctgcaagacctgaagagggatcgcatcataggactctgcagatattccccagtacaagcccagagcccagtagctccactgggtggctagacccagaagagcaaaaacaatccctacaattcatctctcagaaagccccattcctaggagaagggggagaacaccacatcaagggggcacctcatgggacaaaagaatctgaacagcagttcttgaatcccagatcttccctctgacatagtctacctgaatgagatgggaccagaaaaacaattctggtagtatgacaaaataaggttatttaacaccccccaaaaatcataccagctcaccagcaatggatccaaaccaagatgaaatctgaattgccagaaaaaagaaaaattggaaggttggttattaagctcatcaaggaggcaccagaaaaaggtgaagtccaacttaaagaagttgaaaacgtgatacaggatatgaaaggaaaaatcttcagtgaaataaagagcataaataaaaaacaattgcaacttctggaaatcaaggacacacttagagaaatgcaaaatgcactggaaagtctcagccatagaatcaaacaggcagaagaaagaacttctgagctcgaagacaaggcatttgaattaactcagtccatcaaagacaaagagaaaagaattttaaaaaaatgaacaaaggctccaagaagtttgggactatgttaaatgtcccaacctaagaataactagtgttcccgaggaagaagagaaatctaaaagtttggaaagcatatttgagggaataattgaggaagatatccccggccttgctaaagatctagacattcaaatacaagaagctcaaagaacacctgggaaactcatcgcaaaaagatcattggcttggcacacagtcatcaggttatctaaagtcaagatgaaggaaagaatcttaagagctctgaggcaaaagcgtcaggtaacctatgaagaaatatctatcaggttaacagatttctaagcagaaaccctacaagttagaagagattggggtcctattcttagcctctttaaacaaaacaattattagccaagaattttgtattcagcaaaactaagcttcgtaaatgaaggaaagatacagtgtctaccaggcacacaaatgatgagagaattcaccattaccaagccagcactacaagaactgctgaaaggagctctaaatcctgaaaccaatactcaaaatacaccaaaatagaacctccttaaagcataaatctcacagtacctatataataataacacaatgaaaaaaaaaaacccaacttattcaggcaacaaatagcatgatgaatagagtagtatctcacatctcaatactaacattgaatgtaaatagcctaaatgcacctcttaaaagatacagaatggcagaatgaataagcattcaccaaccaagttttcttctgtttttcaggagactcatctaacacataaggactcacatcaacttaagataaaggggtaaaaaagatattttatgcaaatgggcatcaaaagcaggaatagctattcttatatcagaataaacaaaatttacagcaacagcagtttaaaaagacaaatatgttcattatataatgttaaagggattagtctggcaggaaaataccgcaattctaaatatataagcacctaacactggagcacccaaatttataaaataatcactactagacctaagaaatgagatagacagcaacacaatagtagtgggggacttcagtactcccctgacagcactaaactggtcatcaagacagaaagtcaacaaactctagcctgcaacaaatgaacttaacagatatttatagaacattctacccaacaactgcagagtatacattctactcatcagcacatggaacattgtccaagatagaccatatgataggccacaaaacaagtctgagcaaatttaagaacattgaaattacatcaagtactctctcagactacagtggaataaaattgcaaatcaactcctaaaggcatccccaaaccatacaaatacatgcaaattaaataacttgctcctgaatgatcattgagtcaacaaggaaatcaagatggaaattaaaaaattatttaaactgagtgataatagtgacacagcctatcaaaaccactgagatacagcaaaaaatggtgctaaggggaaagttcatagcattaaatgcttacatcaaaaagtctgaaagagcacaaatagacaatctaaggtcacacttcatggaactagagaaaaaagaacaaaccaaactgaaacccggcagaagaaaagaaataacgaggatcagagcagaactaaatgaaattgaaacaaacaaaaacaatacagaaaataaataaaaagctgtttctttgaaaatgtgaatgaaattgatataccattagtgagattaaccaagaaaagaagagagaacatccaaataatcgtaattagaaatgaaatgggagatactacagccaataccataaaaatacaaaagattattcaaggctactatgaacacctttacacacataaactagaaaacctaggggagatggataaattcctggaaatatacaaccctcctaggttaaaccaggaagatatagaacctctcaacagaccaataacaacctgcaagattgaaatggtaataaaaaaattgccaacaacaaaaaaagtccaggaccagatggattcacagctgaattctatcagacattcaaagaagaattggtaccaatcctactgaaaatcttccaaatgatagagaaagaaggaatactctctaaatcaatctacaaagccagtatcaccctaatgccaaagccagaggacataacaaaaaacgaaaactacagtcagtatccctgatgaacatagatgcaaaaatcctcaataaaatcctagtgaattgaatccaacagtatatcaaaaagataatccaccatgatcaagtaggtttcacactagggatgcagggatggtttaacataggcaagtcaataaatgtgatacaccacttaaacagaattacaaccagaaatcacatgattgtctcaatagacacagaaaaaccatttgacaaaatccaatctccctttgtgactaaaaacctcagcaaaatctgcatagaagggtcataccttaaggtaataaaaaccatctatggcaagcccacagccaactttatactgaagagggaaaagtggaaagcattcccactaagaactggaacaaggatgcccactttcaccacttctattcaacatcgtaccaggaatcttagccagagcaatcagacaagacaaagaaattaagagcatccaaaatggtaaagaagacatcaaattgttgctgtttgcagatgatatgatggtatacctagaaaccctaaagtttccaccaaaaagctcctagaactggtaaatgaattcagcaaagtttcaggatacaaaattaatgtaaaaaattagtagctctgctatacactaacagcaaccaagctgagaatcaaatcaagaactcaacccctttcacaatatcagcaaaaaaataaaatacataggaatatacctaaacaaggatgtgaaagacctctacaaggaaaactacaaaacactgctgaaagaaatcatagacaacacaaacaaatggaaacacatcccatgctcatggatgggtgaattaatattgtgaaaatgaccatactgccaaaagcaatctacatattcaatgcaattcccttcaaaataccatcatcactcttcacataactagacaaaacaatcctaaaattcatatggaacaaaaaaagagcctgcatagacaaagcaagactaagccaaagaacaaatctgaaggcatcacattatctaacatgaaactatattataaggcaatagtcaccaaaacagcatggtactggtataaaaataggtgcatagaccaatggaacagaatagagaacccagaaataaacccaaatacttacagcccactgatattcaccaaagcaaacaaaaacaaagtggggaaaggacaccctattcaacaaatggtgctgagatcattggcaagccacatgtagaggaatgaaactggatcttcatctcttatcctatgcaaaaatcaactcaagatggatcatatacttaaatctaagatgtgaaaccataaagattttagaagataacatcagaaaaacccttctagacattgacttaggcaaagacttaaatgaccaagaacccaaaagtaaatgcaacaaaaacaaagagaaatagatgggaactaatgaaactaaaaagtttctgcacagcaaaaaaaataatcagcagagttaacagacaatccacagagtaggagaaaatcttcacaatctatacatctgacaaaggactaatatccagaatctacaaagaattgaagcaaattagcaagataaagacaaacaatctcatcaaaaagtgggctaaagacatgaatagacaattctcaaaagaagacatacaaatggccaacaagcatatggaaaaatgctcaacatcactaattatcagggaaatacaaatcaaaaccactatgtgataccaccttacttcctcaagaatgaccataataaaaagaaaaaaaaaaaccaacaaaaaatagttgttggcgtggatgcaatgaaaagggaacacttttacactgttggtgggaatggactagtacaaccattatggaaactaaaagtagatctaccatttgatccagcaatcccactactaggtatctacccagaggaagtcattatacaaaaaagatacttgcacatatacctgtatagcagcacaattcactgttgcaaaaatatggaaccagcccaaatgcccatcaatcaaccagtggataaagaagatatgacaaaaatatttatatgtacacacacgccatggaatactacttagccataaaagcaacaaaataatgacatttgtagcaacctggatggaattggagattattattctaattgaagtaactcaggaatggaaaaccaaacgttgtatgttctcactcatatgtgggagctaagctatgaagatccaaaggcataagaatgatacattggacttcggggacttgcagggaaagtttggggactggcgaaggataagagaatattcactgggtacagtgtacactgctctggtgatggctgcaccaaaatttcagaaatcactactaaaaaacttactcatgtaaccaatcaccccctgttccccaaaaacctattgaaataaataaataaataaataaataaattgaatgaatgaaccaaaggtattgcacgaggaagcaacataaataaacttagtgagtgaaacagtgaagaaaggggcaatgtgatggtggtgataggtatacaggttaccttgttcacccttttaatactgtggataaacagaatcaagtaatttgttcagctaactagattccatgaaaatatgtagccatttttctggctaaatgtaagaagagggaatgaacaattgggttagaaccttcataaaaagacatccacagggaagctacaaagatttcttatggtccccaacaacaagttcgcatactgtgcctaccttgtttttctcacagtttgatttcaatcctctcacattttgtgaggtggctgtttataccaatctgtggcctaagatattcttatgactattacttgtttatcaaaatggtacacattcttcagttgcagctccacaggctttctggaactactgtaattaacattgatttctttatctctttccttatttgtcatgtatgattagcactacatagaatgacatttactttttctcctttttcttttatatgtgctaattctgtctctttagcctagtcagaagctctgagttcgcagaataaccatgaacacagaattaaaggtctagatagatcttgtctaaccctttcattttcaaagaaggaaagtttgtaaaatggaaactacagtgatattgagtgtatactatgtgtcagacagctttaacatttttgtatgaatcactcgtgttgtcatctcaaaggtcatatggaatacatactattattgtcatcattttacaaatgaaaagaacgatatgcagagaagtggcttgctgagggcacacagctagtaagagacagtgctgggattcaactctagaccttctggctctagctcttaactttccaagttagtgctgcaggtagaacaaaaactctgtctcataacttctttctccatttcagggctcttgcttgttctaactaatttgtaccaccataattcttatactagagcataataaaacaaaagagatgcaagtgtttattaacttcagccttgtatttcacagatcctaaacatgtaaacatacacctgatacactctcatcctttccgaagagagcaagtaataatgttatactgagtgattaatgaactgatgtaaggactcagtaatccgcatgcaattagtggatcaacaaagcaatttacgcagtaggtatgtattttgaatagtattctttctgtagggaaccagctgtatgtagtgtttaattgaatgcttttgcatcacagagtgatttggagtcaaatcatcaaccgcatttcccaatgtgtcaagtagacagttaacttatcaaaacttccgtagtactcagttctcttccaatgtgctccttatcttgaattcttttgaaatagtgtgccttataattttccaggaatgatttacatgtattcctgttcagagacagagggatggattacataacattccctgaggccctttttgccttcgagtaaatgctctttatcattctaagcttcttactctgagtaatatttgaacatgaccctgtggattccccataacaatttctgatactgtttccctagttgatatgtttggatattttccatactatgcaggctgaattctctttttaacttagtatgttctttttcactctgatgctttgacttttgccatcatagttttctttattttcagagtttatcgactgtcactaggctttcttctgagtcctttcgccaagtcatccatactttgctcttctaatcttctgttataacaggcttcctgttacttatatttttgctgttatactctgaatttgttccagattttctggtagagatttccctacaccaaaaacagtattccaggtgcagccacttgagaattgagtagagataaatatgtgcgcccctttttactgtgatgtcttgccatctgcagttcggagcctgtaaaagttagatttgggattgaaaataagacttccactaggactgccatttgcagcacaaactcacctggatggtaactgctgtctagccgcagctccctttcgacaggtccttctcagaagacttcttttccaggcttttttcttcctgtgcatatctgtgttttcattcattttcccctggtgaataagctggccctttcccaacctgactctcatcttgttatttgatcccaagatctgtaactcctctcagaccatctgcattatttctctgtccttgctgatgttttgcaacattctccagctgactatcatctgcagatttcattagcacaccatttactatgttctgaagatcattaataaagatgaataaacagaagagaagaccttctgcagacatctgtggaatttctctgggctgcccccacaactcgatcgccattgttttattttacctttttggttttttgcctagtgtttcattcacttccctccataagcaccctgttgtcatatctgagtaactgcactcataatgtgtgattttcttgcacagctttataattgcctaaacaattcatcatttgtctgacagcatttttcctttattaaatcccagttttattgacagttttcattatcttctagattgcagaagctatatgtaacaatgtgtgtgcccattctgatttctcctcaatttattactgttttaaaacctgtactatagatgataggaagagagtacgatgagaagagatagactcagaatctctatggctcttcttggaaaaacaccataatgtgtatggaagatcatgcatggggattttcctgcaaggcgctaacagtgaactttctatccaaaaagatagaaagaagttgtctctggttttgaacaatgaagatttatatctaacttatattgaaaaatcaaaggattagattttttaaactgaataagaaccatagctgtacttagagaatatctgtgatgcacttggcactgtgataagatgtgatgtatatcactctttatgattacaccaaccctgaatggcacttattttcaggtgtgacactagcctatggcggctgtcatgaggattagaaaatggtgtcccctccaggaggatactgcctgtgcctgagaatagagcacaggctgcatctaaggacccactgaccttctaggccagatatctttgtgtgtggcagagcctgcctaaatgtacatggaagccacgatttctttgtcatttaaatgaagaggataagatacctataaaagatagatttgagattgatactaatgtggttcctccatgccatattgtttctctgcacatagaacaaatatggatctaactcatacttctgtgattgcctactaaattcaaacagtactttgtgtttttacttagaaaagaatggatatggccgggcgcggtggctcacgcctgtaatcccagccctttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccggcctgggcgacagagtgagactccgtctcaaaaaaaaaaaaaaaaaaaaaaaaaagaatggatataatttaatatgtaaccttctcttccaatctttagctatgctgttgattttcttcccagtcttcagctatgttgtttttgttattgtcattattattattattatttattactgaatctagaaagaatcatggagaagaagcagtattactctgggccaggtattctttgtaatatctttaaaatacatttgaactctgttcacatatccctttgtttgcctattagatccggtcaacattatgcaaacacacaccttcatgatattgaatattgatcaatttagtcacatgccatgcaaacgtagaaataccacttaatggctgggcatggtggctcatgcctgtaatcccagcattttaggaggccaaggcaggtggatcgtctgagctcaagagttcaagaccacccagggcaacatggtgaaaccccgtctctagtaaaaatacaaaaaaattaactgggtgtggtggtgcattcctgtagtcccagctacttgggatgctgaggcaggagaatcacttgagcccaagaggcaaagttgcagtgagccaagatcatgccactgcgctccagcttgggctacagagtgagactccatctcaaaaaaaaaaaaaaaaaaaaaaaaaaaactactacttatcaaggaatgttttgaatgctttaattctttgacttaaattactatatatatttataaaggtgtagaagatttaacaactggaatgtgtgtgtgcgcatgcacatatacacacatatgcacatatgtatatatgtgtatgtataacatatatatctataaataaaagttatttaccaaagcatcatatattttcattttcttttctttccttttgttagcattttcatttttcttgagtactgtttttattgaaatgcaccttgcactttagctatagagcttttccttgttgaacaatgtagttttcttgctcaacaactctgacatccaggtaaatggaaggaaaatggataggggagttgtgtgttcataatgccactttgccaccctgaaatctatgcagataatctacttggaaggctttgagccccagtggaatacagaaccatgtaagtatcctgcattgatttacagcacctgctacagctgcttggatcttggcaggcattttctctcctgccaaatgctgttgaaattgctgggctggtttagatggaggttatatttactggacatgtttataatcttcagagtgatctaagccatagagagctaatttcccaaagatcaatgactaagggaggatttcagaggttatcctctttatccgatttcctgtgtcctaatgagatggctgaaacctgtttggaatctttctgattaggaactcttgtgagagtcaataaagaatatgacattcataaatctaaataagaggcgacttggcagcctgtaggtgattcatgccacgagaagcctttcccctgcccccaacaggatgtgccatgggtggccaacctgagacaaggtcagacttgaaccaagagtcttgagaggacttggcctctcctggttaattcagaggactcttctggctattagaatgcgctgtgtatattttttacctgtcttgatttaattcaattcaattgccattcaattcaaacgaaatgtatttgttaaatgattattatgttttccaattaagaaggatgacacaaaaaaactatattggtatatggtaaggatcattatatagatctaaaaaagttttatcaaagatgatgataatcataatagctaatgtattttgagtagttactgtgtcaggcagtgtgctaagcacttcacacatgttatttaatcctaacaaattcatgaattaggtcttattatacctattttgcagatgaagaaactgtgacttagatgcattaattaactttccatgttaacaaaatccttcccaaatcccatattcccctctcgctgtcttttgccccctctcagctaatcttctaggaaaaacttgtctgcctttatcatctctacttctttacctcccatttgtttctcaacccattcagttaggcttctgccactgccatcaaaatgaaaattaaacagggtcatcaattcctccacatgtccaatacagtatttttgtttcactggattgctcaccaccttttcccacaattaaccacttccttctggaaacagtatcttctcttggtttcttgtaccacatattcctgtgtttcctctggaatcatgagctgcttatctccatttgatagcacctcttcctctgcctaatttctcattactggagcattttagtttcggttctgggtcatcttctcttgcccctggattctgccctgtgtaggggattttaaacattgttggtaccacgtacattattggcagtctcatgaagcctatagactcgaagtgcataaaataccctggatatctctcagtatcccaaacgtagttcttacaaatgggaactcttgttttccatctgcaaatttgtttttcctccagtcttgtccatcatcaatccagttgctcaagaaaactagaagtcatctatgattcctcatttatcctaaaacacaaagcttataccatccattagcatgtcttggctattttatcttcccaccgttccagattttcccactttttccttctatccactgccaccctgctgtcaccccttaggtggtgcttaatacatgtttagtgtatgaagaaaggtttggaatggggaaaataaagagacacactgaatcactaggggacatgtaatactctaggcaagacccaagatagaacagggacagtctgaactgaagacaagaaggatgaatttaaaagataagtgtgtccagtggaaaatacagacaaagaattaagagttacaaatgcctgttagtgtaatcgggttgtttgaagctatcttttaaaaatttccatttctttttaagtagccttttacctcatgttctgtgaagtcttttggagacagtaaatcatattgtttgggaaatttaagggtggagatgggaataaaactgaaaagaggaatctttcctagattaagttgacaaagaaacagctttcttcagccatttctctccagacactagtcaaacaaacaggtgagcaccagatagtttgagcagcagctggaacagttcaataagagtctccctctagcctctccttacttctgaataagccaagttaagctacagtcaactagtcggcttctctaatattctgtattgttctgaggtttaaggctttgtttttttcttggctgtctaggctctctgattaactgagattaatctctatcatcctgtgtaagctaaaccctaaattacataatatgttttctatctgtatgccatatgccttccatgtcagggatgactccagagacaacaaaagcaagctgtgtttttactgattttgcaaacttgcattcatcagccttgggcattttggcctccccagtgtcagtatggtgttttaatagctgagaaaaacaacagaaatataaagagaggacactgtgaaaatcactttccaaactgacttgtattgaaactgcctcacatctaagtaatggaaaataacagtgattaggataatgcggtgcattacattcggtgacagttaatcctcttattaacttcatggtcatatttcgctcatttgttaggttggaaggactgtgtgagaatattgtagttcctgtttttctgttcattgggaaagttgggaaaatagttctaaaaataaaagagttccaggttgaaaagcctttgaggttgactgttctctctggagatgcatgtttaccttgtgccctttatccatgctttgagtttgggtacccactctttgaggcctcattctcttccctttagaggattttctttccacctgagcaatcaccagtgagggaaaagtcagtggggtggttcagctgcatgatatgttgcattgacaaatggaggcagagccctgctccagccccgtgagttggaacaacctacaaagcatttctggcagtgagccaaagaggtgatccctcctctagggaaaaaaaaagtcaatggctgagattgcagttctccatccccttgctgggctgattcatacagcagcattgacactgaggtctcagaagaactgttctcttcccagtccatctaaaaatatctaaattcagatttataatgtcaggagctgataaatttgctgaggaaatgcaagcagtgtcactgccatgctaggaaatctattctgatgaattgatgagggaaagaaattccaaacatagcagagtctcagagtgccacttcccctgggatggtgagcaaaatgagcatgttttccttgccatcgaagttcccttcttcaaacatagtagaaagtagaatatactagattgaaaaggaatatggaaaatacctttttgatcaaaagcatgacatgacataaaactaaatcttatggcctgtaaaatattcttggtttacgtcaagcaaggggttcccttttaaaatgctctttcactaagacaaaaattccactcacatagccctggtgacttttgattgaatcaggatcttttaaatttggaactcagcaagaaaccgactgtcttactttcctacagcttttgtttgaactttcagaatctaagttgatattgcggtctgctgctaaccagctctttcctctctttagttggtcagtggattctcaggagtattataggatgtttcctccataccacctggcttgaaatgatttggcataggcttcaactctaatttattcagcatccctttagcgcctactagaaaccaagtatcatgactggaacttttctgaaatgatgaaggtgccatggggacagatgggcgtgtaaagaacttattacaaatcaaatcataacataataattgatactgaacaattgctatgagaattgaacagaggaaatgcttctgctgggaaaagaccaagaaggcttcagagaagaagcaaaatttgtggttggggtgatacaatgaatgagtactagcaatttctcaggggagcagagtatgtctaacaggcagaacagcatggcactaagttaggaaaagtaccacctgccttagggacttcaacaagatatttgaagtgtttaaataatttttttttctcacttggattttggcttttgccaaacaactaacaaacaactgttacatttgatctaattattttagatcattaactttgaaaattgctgtttgtgtgatttcctacattggccttgggcctattatgagctgacatctaatgaacaggtggctggtacattcctggagttttgcccttgtcaaacacttgacccagaccgcaaaatgtcatggtagctttccctgctgaaaccttgtggacttacagctcagtaacgatgttctaatgatctaacatgctatgccatcatttgttgattcataaagtcatgagataaacactaacattattatcactgtctctttgaatgaaaattaaaggctagacttttaattttatgcagtattttcctgactcaattatttgcattaaaaaatgtttaggcatttcattctcatggacctacctcttaatatgctttcttcttaatcaggcaataatttgtaggtttgggcctcaatttcaatagcaagtgagccccaaactcagtaaaaagcaaaaagggttttttttttctgagattcaataggaaacacagcatacaaatatttcatgtaattttaaaaggtaatttagcatagatatgcatactgaagtatttaggggaagtagaaagatgtctgcaatttattttgaaatgcgtcaacaaatatgacggatggatagagggatagataaatgggtggatatgtttgaaagcaaatataataaaaatgttaccatctgagtataaaatacagctattgattataaaattattttaactttgtggaatgtttgaaatttttacaatatgtttggggagaatgataaggtagcaaagaattaaactggtagaggtgcttggataagaatgataagatacttaaagtgaagagaaatttctctgacttatcaaaatgtagacacgaatgtagttgtgtctgtgagtcaaagtacacaatctctcttctccattagcttatgaatctgtcagatgagaaaaaagatcatcctaggagaaagagtagttcactgtaaaggccagaactttagtctacttggcaatatataaatagacttttggggtttatttttaatataaaacactgatatttttcgcaaataaggccatttctgccttctcagtcatttcaacatatattgagcacttcctatattcctggcatggtgctaagcacgggggctttaacttcaaaaagttgaacatcaagaatggagaaagagaacaagaaggtgatgtcgcacacggaaagaaggacttaaaatgtgctgtgagagctctgaagagggagaagtccctggcttgttagctctgatttggggcaggctactaaacctttttgtgccttagtattttcctctataaaatctggccaataataaatgttaaactactgtctgttaaatagctggaccttcataaatggtcactaatatctttaacccagagaggaagatcaaattaggaaaaaaaaataacacagccataaaatttgtttgacagacatccttctttttcccatccctcctctataccccatcttttgttgccctagtagaatgataaaatcacagccctggagctggaacagacctagccctagattttggacagatattccattccaacccccatttagaggtgaagacactgaaataacttgagaaaagtgacttgtctcaggtcccatagctagtcaatggcaaagtgggtgaacatgtaggataataaagcttttactggagagagaggttgaagaaaagttctttggaaatatagtttatgatttcttaggatgtaagagagaaaatgctcagaaactttttttattgttagaagagaatgtgttttagtgtacctaaacacattgcattagtaggttctcaagaggcatttgttgacttgtattgcattaaacctctcctgctaattgtctgtatagcatggttaacccttgttatgtgggtaactgttcctttaattaaattagtttttaagtcttttaattatattttggtgcctgtaattgacagaatctatatctcttaaccccacatagatttatgcagttaggggtagtgaagattgcttctctctttgtgaaaatggaatgagtactcttgtaacatctctatatttgtatcttatttgatctgtgggacatagaacattttcttgacaagatagcgatttcccctagagatctgtcaattcacaactttgaattaaggtctctaggcgttctaattatcagagccaatgacccccgctggctttgacctccaatactttagctggacagttcactcagagcaaagatagaggttctttatactaaaggagaatatttcttatcacagaggagggaaagaaggagaataagagaaatagagggagtggaggggatgagagaagggaaagagaaagagagtaagtgagatgtcactgcaaaatgtttttaaattatttagttgatactattaggttggtgtaaaaatagttgtgcttttttccattaaatagtaatggcattattaaaattggcattattaaaagtaatggcaaaacggcaattacttttgcaccaacctaatattaaatttttaaaaaataaaagtcatataagagactaagcaaatccacaataaaataaataagttgaaaattagtgaatgaaataggatctccacaaacaatgctgcagaatagtttagaaacactgaaagatatttctaacatgcaatacagatcctttcatgcttcatttgagaagctggtataaatagaaaagtgaatgtacagtttcagaatctcagaccagaaaacattctagagcacaagttctaagacaaaagaaagagaggactcacactctacttgggaatgggctgatttttgctccattgagcagattgcactgttgatcaacaaggtagatctggtaagaagttgagacagagacaccacatgctgaagaatctaggctgtcggtgctttttggaatctcagaaagaggtcagggagcccttgtgactccaggaggtaaatgactttcccattgtttgctgttccttcccagcctcaaaaagtagggatgcagacagctgcttctgagggtgattttttttaaatttaaaagttccacctgggcatgatgcagttgctcatggctgtaatcccagcactttgggaggctgaagcacatggatccttgagcccaggagttcgagaccatcctgggcaacatagtgagaccctgtccctacttcaaaaaaaagaaaaaatcagcctggcatggtagtgtctgcctgtagtcccagctaccagggaggctgaggtgtaaggaccactttaatctgggagatcaaggctgcagtgagccatgatcatagcactccactccatcccaggttacagagtgagaacctgtctcaaaaaaaaaaaaacaaaaaaacaaaaaaacaaaaaacaaaccttggaaaagtctatagcttcatcttatgcattattcccccatatactgataaaattcaagtcccttcatagaacccaaacagctgataatgtggcccataattgtgaattccccaagcccagcatttgaaaagacaatttaaaaaatgagagagaaagagagtcagtgctgataagtatgaggtaatgtgaatgtgtaggcacagggtgactttgtaagtgggaagaaaaggagggagaagctaactttcattaagagtcttctaggttgggtgcggtaaatcacagcactttgggaggctgaggtgggcagatcacaaggtcaggagatcgagaccatcccggctaacatggtgaaaccccatctctactaaaaaaatacaaaaaaattagccaggcattgtggcgggtgcccccctgtagtcccagctactcgagaagctgaggcacgggaatggtgtgaacccaggaggcggagcttgcagtgagccgagatcgtgccactgcactccagtctgggcgataaagcgagactccgtctcaaaaaaaaaaagtattctgtgagccaagcgctctacttgattacttgatttaatcctcgcaaatatttttcatataacatgatgagaagatgggggttcttgtaagcagcagaactgggatttgaacccaaatctctatgacataggtccccatacattttctatgacattggttgtgtgccatctggctcatgactttccagcaatttcatggataaaagatgtataataatctgacattcaaaacccatatacttttgcctgtgttagctgctctgggtaaaactattggataaatgaggtttggagaatagatgtgaattttcattattcattcccttctgagaattgtccaaataatattatttctaccagggtgaaatagagggggaaaaaaaacccctaggtttctggaaatattgactatgggatataaggcaaatttagatgttaaaagtgatagttgccaaatttgtcaaatgccgtaatgttctcatgtacaaaaaaagttggggaatttttgtcagaaaattatgagttttgcactggccaattcaaatcaaagagtttttttttttttcttgtctttggcaggttttacaagggggtgtccctgaggggaggtgaaatgagacctagaagcaatttttactgtaacacacacatacccatgcactaacttgctttcatatagttacctgtacatgccacatttcatgattaaaatgcagtccagaaaaatatggtgcactgggctatgtatgagtcccattctctttctttctatttttaagtggattttatgttgcctatttagtctgtaatgaccataagccactccagccaacttgttttaaagctcagagagaagtaggtcactaaacaatagaataataatgtggccacatatttaactttctagtacccacatttccaaaaagtaatttcatccaaaactatcatttcaacatgtcattaatgtaaaacactgttaatgagatattttgaattttttagtggtaggtcttcaaaatctggtgtaaatttgcactgacagcccatcacaattcagtcaagcccacatttcaagtgctcagtaaacacatttgtctagtggctcctgtattggatgacacaggtgtagactaggaaagcattcactcatggtgtttattcaatattttctctatcttctatcatttcttatattaagttgtagagagagagcgcactatttctaccccatcagagaacatgaagggatgcagagaagaatatgttgagttgactacctacctcacagaggacctctgcatgacatttagttgaagggaactgccttctctttttccaggaagattaaatctgtatcctctctgccattcagtttaatacctatgtgcaaggcatcagtagagaccagatagatagatagatagatagatagatagatagatagacagacagatagataggcagagatgtttgtgtgtgtgtttgtgtgtgtgttgtgtgtttgtatctctaagtacatgaagaattggcatacatcccagaacacaacagactgaaactcctgattaaagataacaggtaaatggaatgaacatccaataaaaacctgtttgtgtttttaaacaaaattaaaagactaaaataagaatagaatataggaataggaagaaagccttacatgacaataatcaatttgggtaccattttgttacctcctggccttctgcaacttaaagggaaaaaaaaattaccaccatcaggcaaatgccttatcatgataggacaaaattcttcccattgtgtggctctgttggcatttttaaatgtgtcatatgtggctgggttgtggggtacaagatgtagacttgcttaggagacaaagaccagcataaacttttgaggatccatcctacatggagaatgtagtgaatatgctattgctctaagtggagacagagtcttgcatggcaggaagcttcctaaggtgaccacttgagtcatgaggcttagaagtctttgcagaagagggaaatgagccttcacattaggaaaatatgctttactattacataagttctgggatcaactgatacaaaagttgggagaaatcaaaattttaagtttttcctatgtgtgtacctatgatacaatcaagtttttattcaatttataactcctgaattcattcatcaggagtcctttaggaagctaaacagaactggcaggtctgtcatttggatttgtcatgattgtgagtatttcgttccctgcaattaaaaacgtctgtgggacaacaggatttcaagtcaggagattgttgggtccttgcttctgctacttagctaatctgtgactttggaaatcactctctgaatgtcattttgtttacatctattaaatgtaagctctctctgatagcattatgatgaggaaaaaatgaaagcatgtgtctgaagtatctggtacagaggccagcacatactggttgctcaataaataccagtttctttcccttttactactctaacaatttctcgtttgtattttctgctcctgagctctgtgtcttgaaaagttctgttggcatacacattggacttgattgcttacattaaaattatctattcttgtctctattttgtattaatgaatacaattaatctgattacaagtataaaactatcagtcaggtttctaaaaagttattaaaacatatatgtattacctgcttcccacattccagtgccaggctctgtagaaacaataatgaataatacagctattgccctaaagaggcttcaccaatcctgtctgtggttcagcatcaccaggcaataccaatttgtcatcatcatgctgaatggggagaggtttagaataatcacaggagaacgtaagaccagctcctggccccgtcttgatgggtcatgaaagaacaccgggtactatcctgagttgaaataattctagctcatagttaatctataaagccttatccagagaaattggagattatctttaagcattttgaaatattaagcatagcctgctggccccaaatgacattttttttaatatttacaaattattaataaaactaaaaatttccatcccttccctggaaccccaagcaaccaccgattatttatttatttattatttatttatttatttatttatttatttatttatttatttattatagagatggagtctcactatgctgcccaggccggtcttgaagtcctggccccaagtgatccctccgcctcagcctcccaaaatgctgaggccacaggcacggatgcagagtttgcagatgggcagctaccattttcgagtatgcagtaactgagttttgtgagaagagcaaagtggaaagggagaatgacttaattaggtctgtcctttagaaacaggtctgcaaaggcagtgttgcaaactaatccaagtgaaaaatcatgggagacttaaatgaaagcattcctgggaatgaagaaggcagatttagtaggattactaatgacaggttggatggaagatacaaaagagaagaaatctatattgctgtgatccattaagtctcattgtctacttttaacacttaatggggtggcagtgttgttattctaggctatcctttatgaggttggggttcttccctgacagttgctgaggctgtgggaacaaacgagttcatatagggagtgagtgaggagggagacttcagacgctcagggattctacaccatggaggaggctatgaaggagatccattttcttctaaatcattctgataggcttctggatggctttcggtctctggccaggtgctgatggaaagctctcctctctgatgaagattaatcatcaaacccaggagataattttattctgctcttctgagtcatgttagattccagaacaattaactttattttccccaaatcttgtatctcttgggaatcttccagtaactttggtttccagtctacggagctacttttggcagcttgttgtcaaagaagtgataattcttaaagcttagagtgctaaactgcaactcagttgagaattgaaacctttccagtaaggggctcagccccagacacctgggactcctctttctcctttcaccctcaggtacaggagtgttacataaaatggcactaatccacttttacagtttttgtgttattaagcaatacattaagatttaataaccataacaaaagggttgttttctcaccaagcagttattatttgttgtacttctatttctactcatttaccttaggtttgctttagcgatttcaatttagtaggtgtctaatgatatgcctgtcaatgaaactttagagatgactttcagtccttggaatttttttttcatagtttcaagaagcaagacttgcgaagatgatttgcgttaagaggtttgtgtgagttgagtgtggacttaaattaaaagtaacttaatttactcagagtagtagaatctagtgcatttaaattggttgagaggtgcagacttcgctttggaagtcactgtaaatcgatgccgatagagtaaaaagcattctctgttctcttgctgttcctttttgaagggttcagaaggttggaagagcatccaaatcagtataatcagacctattagatcctagcaaagaattttaaatacatacatctttttgcatattgattctggcaatttaaccctcagcttaaaagcagaaagttggttcaagtgaatacaacatctcactctgcacaatattaagaaatagatctactgaaactaataaaagaattccattgttgtctcctccatttaaaaaaattctacctgaaatacttgttagaatttttataaaagtagtatctcatttatgtacaaaatagtttgtgtaaactataagtagacaaagatgtagggttgtatcacttctttgataagatactgatcttgtatttttaaccaatgctaggcttaataaaagggtcctgtaaaatttactatgaaatctgtatgcctccctccaacttcttttccaactgagattggagtatggcaaaggaaatgaagcatgaagggaaaactaggagctatgataatctaagattcataaacaattataacattatttgctcacttttgattgtgcaaatgactaaatcttttaatgaagcataatgacccatctgacacatatataacaacacataataaaagataaaattaaatttgtcaaagcaatatagaccacccactactagtagattatgtttgggtttggattttcatatattttatccatatctgtttccttctattgggactttatggaggcattactcatgaactttggcagatcttttttggtgtgtctgaaagaaaatcccaaagctggttactaagatgtttgaaagtcatattcttcttcaaaccgtgtagaaataactatcaggaaataagtggttataattttaaaatggcatgtttagggaagagaatatataagtttgaaaaaccgcagtctcctccaatacatttctacctattactaacagggtcaaaattgtctacagaaaacaacctgatctcaatttcctcagacaattcagctagtaaaatggtgtgactgacctagagttacggagataactcctactgctgagctctctcaacaagtgacaccctggttgacaaacaatcacacattatttattaaacttctatttaataacaggagttatggagttagcaatgttaagtgaagagtccttgttttcaaactttgcaaattacagttagtaactaataaactaattaatgtcctttatgaagagatgctcagtgatggcctgaaaaatccctaaaggagatagggagagaattgaagtatggaataaaatgacctatatgggaccttcaaacttggagttttctatattttcaaaaattacttttgctgtcatttaatgtccaaatccaatcccttgtctagggaaccagttcggattaaacaaaatttcaaaaatacacaagcaatcaatatctaattcatttaagtcctgtttcttcccaggactgctgggtataagcctagagttgcctgccatttctcttatattcaaacactttgggaaaggagccatttttttagatctattttctccctgaagcttgggagctatatctatataaaatgagatgacatactagggctagcgtactaaaaccttttctaagagaatcaatatagctttgagaagcctcatttatatttaaaggagaaaagagacataagtagaagtggacataacgtatcatgtagacattgaaaaataccagaaatgatttaaaagtgactgcgtgttctcatattcccagtgccttgtaatttgacttggagggatgttctagatctccattgaatgtgctcactgagatttgtctttgtcgtattgattacaatcatctgtcaatgccctcaatattttctgtactgaccaacagcgacacagatcataggctgtaactagtacaggctgtgccaatgaaacaatagggctaattagcagacatgaaaatgaatcactgatttaattttcctcctggtctaatcaacacaatgtgtcagctaaatattttgatccattatttcaagtgaatagaatgtgcttttatattatcatttcaatttcattaccttgaatattggaatttttgatttttggatacatcagtgtccagtcagtatccagtgatttttagatacattttggatacatcagccttagcatacatcagtgcctacgggtataaggcactgatatgttaataaacatattaacagtttgtaagccaatgaaacctataattattgcataatttaaattaacttgtgtacaaaatgccataatatttccacatacgtggtggctttcaaaatcaaaataaggtgagcctatttcaatttatgacagacaattgtatatctcctctcttttctttgccaaagaagccctttatttcatcctcacaggtgttatacttgtctcctttctgcttggtgaaacaatcacggtttgtaatttcactttctgaccatcaaatacgataaaatgaaacagtttgtgcttttcttgtactttccgctctcaggggttactggttgagagagctcagcagtaggagttatctccgtaactctaggtcagtcatgccattttaataggtgaattgtctgaggaaattgagatcaggctgttttctgtaggcaagtttgatcctgttggtaacaggtagaaaatgtattggaggagactgaggtttttcaaacctacatattctcttccctaaacatgccactggctggctgggatgctaccttataaatgtgaggtagatgacaccagtctgtaactctagacttctgtcatggatagcaggataacttagactgagagctgtctgtcttcccagcccacatggccacaggatcagagcaggtcatggtgaagcagaggagaaacagctgcaaagcagagaagaaagtccaatagggtaggatgtgatgaataatgttgtgaaacagacagctagtgccagtaaggctcctatatcatagaagtctaggaagatacaagcaagtgctgtcatagacagataaatgaagtggacattgttttgagacaaaagcaagctggcaatatcagagaagcttactataaagagcaaaatgctgggtgcactggctcatgcctgtaattccagcagtttgggaggccaaggcaggaagattacttgagctcaggagttctagaccagcctggtgagacctttatctctacaaaaataaaattaaaaactacctgggcatgatggtgcaggcctgtagtcccagctacttgggaggctgaggcaggaggatcgattgagcctgggaggtctaggctgcagtgagccatgacagcaccactgagccttggtgacagagcaagaccctgtatcaaaaacaataacaaaacacagcaaggaccctattactctcaatgggaaaaatcgcagttgcttttgggccagcctaataataacttgacagagagaattttattccctgcaagctacgagttcgttttctttaacagatgaggtaactgagccacataaaaattaagttacttgtctagagacacccagctgataagtaagagagcagacatttctactcaagcaatctgactccaaagctcatggtgatgaagcaggtcatgaaagctctctttatgacacatttgaataaagcagcatgacagtgggacaaaaagtacacaagacaaaagctccatcgttagggccaaagcataggaacaaactcaggccagtgatggagcaacttcagctgagattttagccaagagcttgttaacatctttccagttcccagatagaattagtcctaaggaattacgaacattgtattccatggcatatatatatatactacattttctttatcctctaatcaactggtgatggacactgaggttggtttcatatacaagagcagatgtcttttatttttttttttttgagacagagtctcactctgtcacccaggctgaagtgcagtggtgtgatctcagctcacggcaatgtctgcctcctaggttcaagcgattctcctgcctcagcttcctgaatagctgggattacaggtgcacaccaccatacccaggtaatttttgtattttcagtagagatggagtttcaccatgttggccaggctggtcttgaattcccaacctcatgtgatccacccgccttggcctctcaaagtgctgggattacaggtgtgagccactgcacccagccagatgtcttttttaatatgatgatttattttcttttggataaatacccagtagtggtattgctaggtcaatggtagctctatttttagttccttgagatatcttcatactgttttctatacgggttgaaccaatccatattcccaacagtgtataaatgttctcttttctccacatcaacatctgttgttttttgactttttaataatagctattctgactggtataagaggtatctcatgtggctttaaattgcatttccatgaaaaagaatgaaatcacgtcctttgcagcaacatggatggagctgggaaccattatcctatgtgaaataattaagaagcagaaaatcaaatatctcatgtattcatttataagtgggagctaaacaatgagcacatatgcacataaagatggaaataatagatactggagacaacaaaaatggggagagagagaaagctgaggattgaaagatgatctattggataaaatcttaattatttgagtgtatacggagagcccaatcttcaccattacacaatacacccatgtaacaaacatgcacatgtactccctgaaactaaaaaaaaaagaaacaagcattgtgaactgctggatccccaagaaaggcagatgaccataactaggaagaaaaggagaaaaaatgtgcaatgtcaagaaacatttttgtaacttatggtcaatcttgtgtttctgcaacacctatatcttaccatgtagaaatttagggatacaaaccacaaagattctgagggcctaatcatctctcctagacttgcttttgcattctggagtaataatctggaaaagcaataagagtagggacatatttatgattattcttaaaactgtgtgtagaaaaatacaagaatatctactccaaaaacctgcatgaagacatttgatagttagccaaaattcaagagactcctaatctttgaaagctacacattaggctggtgtatatgtcccattatttgaaattgcacctttaaatatttgagacatttatcctattatccctgattacaatttccccactacaattcactgcacagtgcttccttagggagctgcttaatacatttcaatcttagaaggtcaagattccctcagccaattccaaactgcattgtcccattgaatagatgtggcacattctggatctagtgagaataacctatgtatattactttgaagtaatacaggtaggccattatagcagaaagaagttgagtaaatgttgatatttaagaaggttgataaaatatttgaacacaactgcaatccatacccaattctcagtggttttttttatagaccatgaaatcatagctaaagtcaacttcggttctgccctaacggagagccacaaataaccctaaaccatagataactcaaatgcatttttacttggcttttgactgctttttatgataattttcacagcacattgctcttctaattatgttttgtttgggatcatattaaaattaacttgtatttagtgattatgtgctacctgatgagttaaagaggagccctgggagtgtattgaaaaaccaggctgtggatggccttcagtactttacacaaagaaaagccaaatagttaaaaaggcattaaaaatggaaaggatgtaactagtgggcaaatagctccaggacctcagttgcatgaacttagtatatctctttcctcctccttctcccctccctcctccacgccctctttctcctagtctctatttccccttttccttatcctcttcctccatcttttttattctttcttggaggcatggaaagcaactcaaaagaaaaggagacctctatagtacatccgcactcagccttggatagtgagaagtactcaggtctgagtagcctcagacagtggagtcagaagcaagatgaactgtcagggattataataggaatggtcagggctgaaagcaaggcaataggtcaaaacctggcaacaaggaaagagccctggataagtagtttccataaatccaagcaagacaatttgttaaggcttagcatgcaatcaggcatccaaaattccatgaaaaccagaaggcagggtgaggaaggaacaggaaccaggcagcagttctgtgcagtggcaccaagtgacagcaagaaggcagcagtactaccaaggcaagattacacccagccaaaaaaccaccagtctgcagggcagccaattgatactccaggcagagccattcagagctgaagagaaagcactaaaaaaaagtgcagccacttctgtgattaaagacaatgcccatggtactaaagtaccgtcttggagacactggtcatagttgttaaagcttccagccctcccagagaacatctctatgaaaaaaatactggtacagcagccccaggcccaccttctggaggttcagcttttaattttagttgtttcaagtgctgtggaaaagactagacctgatccctcagttcttcatattgccttatgaacactggccagaagggaagcacatccctcccttttgttaatttcctccaatattgctaagacaaggaatttcaaaatgttcaacaaatattaagaaacaaaaaagaaatgaataaagaaaataagatgggcaaaaataagtatgcatgcaaaaataagtatgcatgaaacataagttttcaaatatcatacactgacattgattaatcatcactagctgtcaggagagagtgctgtattgagaaggatttagcaacccagaatgtcctaactggcttggctcatgtctgctgtgggtaaaggaaaagcagggagtgctgacaagtctgctttgtatttgccaccctttgcaaataggtactcaccctattcccaaagagctaatataaattacatatcactttatttgtgtttgatttattacataattattattagaataattcacataattataaccagaagccccaaaagagcagagaccctgactgatttgttccatggatacctccagcatctagaacaggacatgacatatagtaccccttcaaccagtagttgcctgacttttctgccctcatttaatggatcctgtctctgaacctgcaggcatcatcatatactatcgtaagtgatttccttagcttcctaaacccagaaagaatccacattctatttctcatggtttttttctatctgtatagcagcatcaaagtgggccctggtttttagtttgagggatatgccacttctgcaaccagctggcataaatgtggcaattgacacgataagagaagctgttctcccagccagggaagaggcattaccaattacaggcctatactataactgtgcctttaacatcacttgcatgtaagaatgcaggtctctatgttagaagagtgatatctgctcacagcatctcatctcctcctcagctctcccagcatttgagcgctctctccgcttcgttttcaaccatggtagtctaatcactggcaaaccaccagtgagttgattgcagccctttataattcctgtgtagtgagatgccataatgacttttccaggagtttccacatcatctgtttactccatgtgacattccttccatctgtctactttcagtttattttactttattttttagtaacttcatatcgcagatgaaagtactgtgaagtttcttctcaaaaccataatatttttgttacgttgcatgataacctcaggaaacatgaaattctaagaatttaatactaatatcattttgggatcattttttaaagcagtaaaagactttatgttcatgttgtctcacttttcagaggaattcatagctttttattgatgtaagccatttcataaccctgtcaaggtgctttgaggaagaagttaactgattgaacatcaacaaatcctggaatgtttgatactaatgatctcagaaggggccctgcctgatctacattccacctgagcactccttaccaaatattgctcttgccttcctctgcagtgattggttctgatcactgtagagaaagcatggaagctcattttacaaggctgcatgtgtgtctggctgctacctagatgcatgtccttcttgcacaggtcaatccattctctggtttttctctcctttgctctactcccttacacagaaacctaatttacctgtttctttcttaagctcttcatttcagaaaaactcaataaggaaaattaaaaaacccctcctttaggatgtctctcttatttctgccagctttttgaagtatgtgtgctctgggcaggggtggggacaggaagtgtatgtgacaaagatcagtcagacaaaacactcctggcatgatttccattttagagttgtgaaactgaagaatgggcaggtaaactgatattttctataagttgtgagaccatgattcactgatttgtttaccttaatgaagcatacgtaaaataattgataaattattttatcaataatttggtaatttcctcttggggctaattgaatatagtgagtataattgagtatacggtgggtggctttcaagcgtatctttccaactttcactattttagtaccctggctagaaaatgataatctgatagtgaaaatattaattcatcctctacaaggttctgaagatactaacttctcagtaaattcagatatagattacaaccattttcaggatataataaagaaggactaaaggtatctctttggtatgtggttctttacggccacataaatggcttccaagtcttcatttccttaagttcatttcctgctaccctatggacattgctaccctctccttctctgggttacaaataaatggttgatggcattttaataacaaagattaaccaggttgccatgttaaggatagatgggagaagcagtttgggaaggtagcctagacaaggtgatggtcttttcaggaagttctcaggtgtctacaataggtagcagaattgggcctgagcaaaagtcacatgagcttacagcaccctgtgcagtcaaactctcaacttcacttaagctttttctttgctttgcttctgcccactcacctggcctgttaccacccactgttttaagcagctcttcagctgcacatctactgtcctgctctgccctgaaataggatgataggtaggactgctgtacccacagtttacatgtccttaccctccatgtaaactgtgggtacagcatttgctacctaccgtgcttctcaaataccggaagcatggtttggacagctgaaggcttagcaatcattccaagctgcagcatctccttgggcctcaggctaacacccatatcaaaacaacttgcgcggtggcgggcgcctgtagtcccagctactcgggaggctgaggcaggagaatggcgtgaacccgggaggcggagcttgcagtgagccgagatggcaccaatgcactccagcctgggcaacagagtgagactccgtcccaaaagaaaaaaaaaaaattatgatatttaaagagcatatttaaccattaaaatagtaaatatgttgctttttttttttcttaattgaactgtagtgtccttattgttttaagacttcatcgtatattctggatacaattcctttatcatatatgtgatctgtatgcattttttccaagtctggcttttcattgtctcaactgtgtctttcaaagagcaaaaattcttaattttgatgaagtctgacttatcagttttctttttagtcaattttgcttttgctgtagtagctaggaaatctttgcctaacacagtcataaatattttcattttttacattttgtgtttaggtctcccgtgcattttaagttaatatttttacatggtgcaaggtgtatggattaaggtttgagaacagacagacaggaatgtctttcagatttataaaacgtaaatgctatatagttaagcatttaataatcttttctgaaaaggaaaaaaaaatgcctacatttgaaaccattctggaaaatgtaagataatgtggttttcctaaccaacagtagtcagcttttaaatgcagtactttgactttattatcttatcattgagattcaccatgtttttatgtaccactaagaaagaaaaagaaaaaaactgattaaattgtttaaaaaaaaacaaaaaccttgaagacaattttagttacctccaggctaatcatttcctttttcttttctttcatcgcccctgaaactcccccaagcattatccaaggtgtgggctctttttggttagtaaacttcacttgtcatctcctttgagtgtgcttccccactctcgtcatcttctgctggcttaactcgaagcccaaatttcttacttgtagatggttaacaaatattccacattctctgcattttcttcctgcatttggaacctgggtttcctttaaggacaccaactccttgaagtcacactccccctttctcgcacgcatacacacatgctcagacaatgagggtggctatctggcagcttccacctttcccactagagttttcaaatatttgccacactatgccagtgccaaaatttatataataatctatccttcagaggcttctccccttgagctgctcacaatttacccctccttctaactcacaaggagttacaaggccctggaaatgtgcctccctcgacagccacaagtgaaatagtcaccaggttcatggtcttactcgaatccctgtcatgcagggatttcttcatttgcttggaatgactcatcaaacagcctagctttacagttccttgacctcggctcttcccaggacttttatctccatatgtcgacaggaatctactttcttggcacttgttactaactggaactgtatctattatcctttctcaacaagaacctctcatatctcagcatccttctaaggctcgcttactatttcacctcttctgtacttctaactttgagccttttattcccttcctatttgcaagcttcctaggcttcatttttaggaccccaatgttgatcacttgaatttccctttcaccagctcactgactctcttggcctttcaactcatcctttttacaaacccctggagcaggtctctcatcgcccttcaccactcctgcagccagtcagaacagctggtcaaatgaatacaggaatggactcactcattcataccaacggtgttcacttgacctgccataacagtgtgattctacaggccctgcaagttcatgctgactgtatatctcactcttctgcctcagagctagagaaaacaacactgaaaatgaccaaacctcctaatcaggaactggtaaattaaactgtttaaaaaagttctctttatatgtgtacatacataatatataacttcacagaagtgagcaaaagtgattacactgtatgtataaatttatggggagaaatgtagcatctgaattcttttcctttttggtttagtttccagttcccctcttcccattctccacaccaacatcatccctcacctcataaacctacacctagaaaaactatgtcaataatctagaatgtatctgggattttttcccaagttcatatgcttaaaaatatatacacactcatacatataccatcatatacttataaacacacaagcatactgtggatatacaggcttttgggctttgttttaaaagatgagatcataatatacacatcttctgtttcttgcttttgtcattagatatcttgtagatatcactctagatgaaaaggttctaactatttttagatctaattattaacttgttcctttgtataaactcgtaaatatttattgagcacctaccatatgccacactgaagcctgggatttattcaaatttcagaattgagaagggagtagagagattcatagtccagctctcttacagaatagatggaaaatcaaggctccgtaaatattcgtgatttattcaaagtcatgcagccagttgatgccatgtctcaaatcaaaatctagctcttgctagcccccaagtccagtcctcttttaatcatactattcagagtcccataaattagcatacaattacttacaatttaatgtgaaaacatactacaacataagataaatcttcaggcctggagtagggagaggatagggaggggcaaggattcaggaaatttcctgataatggtttgttgtctgtgtggatagaccaaattgtctttaatgaaccaaatttatcaaccagtgaagactcattaagatgcccagcatttaaagggagatcaataaaagagagaacttagtattgaaaagctatgaaagagctttgaatgaaattcactctccgtcttagcagagcgcttttcaagagtgagaatcatgggtgggctgtgagggaagatattccctggccatctaagcacatctggaaaggtccagatttcaaactgtcgctcttttgtcagtgctgaaaaacttaaccttgagcgctaggaagatgttctccaagatgctgaaacttgtcacgttatatgagtcttcatgttcataggcaaaacaaaacaaaacaacaggcatatacatgacattaccttcttttttgtttgagacagggactcgctgtgtcacccaggctggtgtgccatgatcctatcatggttcatttctgcctccaactcctgggctcaagtggtcctcccacctcagcctcccaagtagctggaactacaggtgcactaccctgcctggctaatttttttctttaaattttctgtagagatagtatttacctatgttgcccaagctgatctcagactcctggcctcaagtgatcctcctcccacctggtatgaagcactgtgcctggccttgaatttcttaatgatgtttttgtgaatctatttgtcaagagtacaactgccagatttttgtgcatttgtgcccctctgctccgaagtaccctgactgtcagtctattcattcagtcatcaaataactttggggcatctattctatgccaggcactactatggtaggccttcaataaagggaggctatgtttacatgggccttccacttcacaggcaagaaccgcactactgaatctcccgtgtctttgtccctccagataatttagtgtgcaccttatgaccttcactgacaaaatagcgaagaatgaacaaatgttccttaaagccagctaattctttggttattttaaagctgattggatcttttgtacacattctaaagactctaaagagagtccttgaaggcataatttcactgaaagacatgcaccacaaaccccctgagacatccaactgcagggaacacctcagctcagtcagtatgtgatgagctttcatgtcgcagggcacctgacagttggatgaaaaattgctttcagtctatgctgggttttctgtggcagttcagaagcaggactaggttctgggtctttactgtgtatgtcatcttttctttcagggttctgtgtttccatgcaaataattataatagtgtagaattatttgatacctactaagtgtcagatttcctgccatgtacttcacagacttttattctgtacaacaacattatgagtcatgtaatatcatccccacttcagaaagaaggttcggagaggtggggtaagttacacaatgacagaactacaagaggcagagcaggggtgaagctcagatccccgtgtctccaaacccaaggctgagaccgctggctgcactaccccacacagttctgaggcagaagagaatcaggaggtgaggatgggaactggggaaggggttatgttctgatgagttagtttttaaaggagagccagattttctgaagcagaattttaaacatgaataggacatgttaacttgatgttagtgaaatatttcctagagttggggtttattgttgaatactaaactcatgggagtactgcataccactgtggaaaggtgaacagaatgactttagggaatgtgacagtttacaaagaaaaaagtaaagaaaggaaggaaaactagaattctcagtcctgaccaaaactatctctaggataattatggtttatctaaaacttgtttctctgggtaatcagataaccctgctctctgtgagtgtagacttctccacatgctgtatgaggatacctctgtgtccctgtagttaacaattttaattataggtgaagtattcaggttaagtggcctaaattgacactttacatggagaaaaaagtctctcatgagactatatgctataaatacataattattcatatttaaactcaacattctattgcttttatatttgttttatattcatttttcacaaagtttcctttgcaattgattcctgggtgatggtattaacatgtcagtattatttattcaagacaagtggaaaatctcaagaaaaggctaaaagacccttgggagcttacctagtgactacaacagaactaggaattaaatggctgtaaagtgacatgttgtatacaacacaacataatttattatgtgttgcattaatataggcgttttgaggatatcaacattagctgaggaatcctgatgtctgccaattaccattgtttggtaaaagattgggagttctggatttaactgcttggtaatgaaatcaacggtttgcttcaagttaatgttatacagtagatgcctagctgatttcttgtttcccctactatctaccttaaacgcattctgggtctcccttcatctttgtaggtttctgagctatttttgtactgtctacatatcttgattagctaatctgtatattaaccatatgttctgacaagagttcagtgacatggaccctcagcccatgacgctcactaccactgacatgttgcatgtgagtggtggggggagatgaaattagtttattataatatgacttttgagaagatatagcaaaataatcctctaatccattctacagaaaaccttttgtttttccaactttattacctttcattattccatctcagctgttttcactttgtgagattgctagggtcaatgggtgaggatctgccatgggtgtgtgtgtgtgtgtgtgtgtgtgtgtgtgtgtgtatgtgtgtgtgtacttttcactgtcaattattctaagaaaagcaaatgctaaagtgaagtgaaacagacaatggttcacagtaaatatcaagctgtgtttgtattgctgccatctctttgggagaatttcttatctgttcctacagaaaaattactggaaatatatatcaatgaaaacgtataaatgaaatcctgaaactatataagattcatatctcttgattatccaaaatagagacatattattacttatgaagatgaaatgtttgtggtttgatgctaaaacatttagtactaataattattccatatagagtgtttgcattaatctcgactacactaattcagagcatgagctctttgcctttgtgcatgaagacagtttcttgggcaaattaccaatgtaatttcctcgttgtcattccgcaaaccatctatgttcaaatattttaaaagcagctgtacagaaccaaataatttatattttaattctatataaatcaacatatacttctttacttggacattaccattttaacttcaaattcaacatgtctattttgaaacccttgatttccaggataaatcagtctcttgctgacttcccttctcttttgtttgtggtagaatgattcccctaatgttggagccttaaagtctaacttagtgactcctctcatgttttccatatctagtctggggcaacatccagaaattcttcctgttctgtttttcaactatctttttagttttatttctagtgccgccatctcagacctctactaattcattggaattatttttcatctctctgtctaccatttttttcttcttccaattcatcctatgcatcaatgtcactctattttttcatatctgcaaaccactcagtggacatccaatatacaagcaaaccaattataggtgaaatttaaaaatatttattgtaatttataaaagaatagtaaactaaaaatgaatggtaataacagcaattataataatggaaaacaactatgatgctaattaggaggaggaagaatgttttcaaagtctttcaccaggtatcgatattcatctcaaagagtttgaacaacagattcaattctgtgtagggaccatttcttcatttattctttattcctactaaatcagaaataccaaattcataagtcatttggaagggtaacaaatgtttgatggtttgtcaactagtcttgacaaacggattctacaatgtacagaaattatggagacagttttcactgatagatgttcagtgcctcaaaggaaactcattaagatgagggaatgccctctcaaatgtaacaggattgttgaatatatcaacacaaaagatcactagcaaatggattcctaatgaattcctggttgaatttgcctctgataattatgtattcatattcagtttgagcattcagatgtgttaaatatggccaataatagcactgatttatttcctcctttaatttagaatatctttaagtagttagaaggaaacccttgttaactaatccattgacatcaaaatttaactttttaaggaacttttgctgtctctcactaaatattagaaatgatgatatgttgttcatgaagtcataaagtcaggcttctccactctctgtttgatttttatgtgtatgtgctgctcataaaaatcatcacactggtagagattcttgttctcacaatgcagattcacagtgtattttctccctgaaaacttgttattttctttggaacctttatgccaaatgatatataatttgcagtactattttcatgtctttctacttttacatctccgatggattaatgttgcagcattaattcattttgtgtgagttggtactctaaaatacaataaggcagacagctttaaacccatgtgatgtttaatatcctacaaagaccaaagagtcatagtggatatttccctcaatctaaaaataagggaaaatactaataagcaaattatataaaaatgaatctgcttaaatagacagcaccctgtttgccagatgttacctgagacaaccaatccatatatcccatgtatgtgagatgtttaaaaatgtaagaattactaaggacatgataaatttttatgagaatcataattaatcatatagttcaaatttcatggtgcctgtctattgccaacccctagtttttcacaggtttcacattggaaagcaatgggttgtcctttggcttattttattttagtaattaactgtcctttaaaaacaataaaactttcagccttcagtgactttgataacctatgtgataaagtcagaactcattagcctgatattcaaggtcttcccagagaggctccatcttacctgctctgacttctgtcttatacctgctgatccacctggggtgtctgctgaaagcaggtcagcacaatgactcagattcttccctttctttccctctcccatgccccaggatttgtttgtacaactggcccaggaatcctgacttcatttattctctatgggttaacccaggttcttgcttgtgaatggaaacaggataatggagctaaacctaaatggcattttctaaccatgtcttcattattcattctctgaaccatcctctctaatcagtttttactgatttcttccccaaatatgcatttgctttctcatttcaacttatatttacactgttctattcatcagaaatgtccctgtcttgtctgcctcgtcaaattcttcaactcccaactcctgtcttacttcctatataaaatcttattaggttaccttagctgaactatcttcttctttctggaattcctattgcaattacttttgttgtaattatttaggcagtggtttctttgatatcatttactgtgttttctggcaattgcactgaaattgtatactgctcttcaattaatgattatctatttccccaaactagattttaagcaccttgaggacaaatattgcctcatatgcctgtatttctgttccaggtctttggcatactgttaataatgaacaaatattatattacagtaaaactgtatcccaagattttctcagactcatctaaaatataggcaagaacttaataacactaatatgcctgttcaatgaagcattctattcaaaatgttttattaattctttacagcttcctcagcatctgattggaatcagtggcattttaatttatatgtctatttaacaaatactaatatagtgtgcactgtgtgttactcattttctatgcactttacaaataataattttatttaactttcaagacaaccatctgaaataggtgctattattatccctgttttatgtatgaggaaatggatttactgagaagtaactcagccaaggtgatggaattagttactaataggttcaggatttgaacctacatttttaaccactgtgctctaggaacttagttaacagctttaatgaatgaaatggttctgctaattgatgtaagaaactacttacatgttttgttggctaggtcacctgtcactctcagttcagaatctttcaggaaatgtcctttagtctctggtgggaggtgtactgcaactaaccgtcctttgaatttatgttgccatgtacagtccctgtaattttatttcctctttctatctttacttttgggatctaagcttccttgaatgtttagcctttttgtctttttagaaaatattgttccctttatgaatatgtctcttaattgctagagtttcctaatagccaaatgaaaattacattttggcttagaaaatgctttcatctgtatccactggctatatatctgcaaccaaagtaaagtgtggaattgggtatttgttgtttgcagcatttgagcagtgtacacatcaaatgtggttaattctattaccagtaatatttctagtttcttctaaaattaccataaaggtttaggtctagattagataattatttccaatcaatctcctttcaagttggaaatgaatgaagtcccatgttttctgtgtgctatttcatatattttggcatgataattattaatagcaatgtattactattgctcttttgcttacttaaaagtatattttgcagtggtttattttattctaggtgggagaataacacgttgatatcttcttgaaataaaaattatatgtcaatgaatgtgacaatgttctatgtaagtagcaatcgaggaatgactgaaaagggattattaaatatttcaatgcatgggaaaatatttcttctacctatttactgcctaaagtaaatgctaacccagaagatatttatgtcttggtttagaaatctgtagagtgacagagcaatctgagctctgtaatgtatgcaaaatttatcaggctcagagagacatgagtatgggactttggccacataccatacctgtgcccagggacaactgttaggaaacattttgttccagactagttgtgtcacctattatcttcatgttcctggaatttgtgatacaaagaacaatgtatagccaatcgatagcttatgtatttgaaagtatattcttggtaaacaacttaggaactgcctcttgtttttttcctaaaaaaacccacttgtaatggctggtagttggagtgtataatcagagcaacttgaatctacgctcctgagtggccatcttcaacaatcaccctggaataaactctttttaaactagaaaacaaaaacaaaggaaacaacaaaaaagaagaaatctatagagtgaactatatttttccaccttgcaaatagaaggggcaaaaatcaaccttgcctatctgatgatttagtgtcatagggattccaaaatgttatttgtaacgtgtaccttgatatgctaatggtgaaatctcctgtttcttgatttggtcttctcatcttacatttcttacctcaaatccattctgcgacttcaccagcagattaatattctttcctggtctcttggaattttaataaaaacagcatggtcatggggtttcatgaagcttgcagccctctgggggatgcagataataatcaatcaatctcataattaaatgtaattttaaataagagcttacaaaaaaaaaggaatatggtgataatagagcctagacaaagggatattacccagttagtagatgtgtatatgctgggcaaagggattgatatttaaataatgtacaggagtcatctaatcaaaatggtagaggtggtgggtgaggaaggatcttttgtgaaaatggaacaacatgtataaatatataccatgatgggcaggagcacagagattttgagaaaataaagctgtggtcgcagtcacagctcaaggagacagtgggagaagggaattcggtgaactggtaaaggtggcaggatcatttggtacctcataggctctgattaagattcttcctatatctttagagctgttgaaactcactggagtcttcaacaactgagtgacaggattagatttgaaaagatcattcttgctatggtgtagagaatagtcattcttagatcattcttgctaagtcttccatgagaaagtgagtaacatagatttgaaaagatcattcttgctataatgtatgaaacagttgggaagaaggtaagttatgggaagaccatttgaaggctatcacaaagagaaattctgatcatttagattaggtgatggagagaaaggatgaggaacccagaagatagtgggaattaccaaggcagagatgtggataatacagtccatgactatagaacaggaagtgctgaaagagcatgtttctgcacatttagaattaagagggatttggagcatctggagcagaatttgtttgttgggaatgatgactcgggagaggcaggtaggggccaaattatgaaggtccatttttgtgatgtgatggcaaaaggaacaactgaataaattgagcagggaatcacagtcagatgtggagtccagagaagtctctgatggtgtggaggatgctccacatctctcatgaaattaattgagaaactgctatttttttcatctaagagttttaattatctttcatttagttcccagaggctattgggcataggcacctagtaagtaactgttaataacaacatgcttattttgggcatggcaatgtggaaatttattcctgccgagtaatcagtgccagttttatgctggcagggttttaaaagaatggagaagggattcttttgcctccattaggagaaagctgtgccttctcttcatcatatagtgactcattcaaggttggcacaaagtaactttaatcaattaatgtgaataatatcatacctttttaagcctaaaatggatattagaggctatcagccccctggaaaaaagtctgcagaatatttttctttcaatgataatgtcatatatatcatagcccttgaatctttccaaaacatttagtcaatactgaaaacatccctagagagacactcatccaatttctcacatgtgaatcttttatctatctttggaaaattttaagaagtgcttaatttcagactgcttttataaaggacataactagtagcatggtaaaagtgcagtccatgaaattaaattcctgatctgaacctcaggtcaattaacttctaaaaatactctttttgagacaggatctcactctgttgcccagactagagtgcagtggtgtgtgattatggctcactgcagcctcaacctcccaggttcaagtgatcctcctacctcagcctccagagtaactgagactacaggagtatgccaccaaacctgtctatttttttaaatttttttgcagaaatgggatcttgctatgtttcccaggctagtctcaaactccagggttcatgtgatgtgctctgctgggtgctatactgggctgacaaaggtgaataacacctaattcttctccaaagagagcgctcttcaactgatgagggaaataaacaggagagcaggcagtgaatgatagagcagtatcagaggtgctaggttgaggatcttcacaagcttctaagtcaggacatcctaattcaaaccaggaaggatcaaagaagacagtaaagataatgaccacaagttgagtcttgctataagctgaatctggaagatagaagtgaaattgtccatgaaaaaggaagaaagaagaatgtcgaagaccaaaggggaaagagagtaagacaaggtaaatcaccttttgatatcgttgctgagttgtgtgaaaggctgtcaaagtgggcagaagtcatgttcagaagagttttacattcaaattaaggagtctctgttagacagctttaaatccatgtgtctaatatcttacaaagaccaaagactcatagtggatatttccctctatctaaaaataataaacttttctttccaaagggaaaaatttttacttatgaaaaatgtggtaaaatatagaataggaaattctgaaagatacaagttcttcttgaacaatgagcaatgtaaaaatgataaaattattgcatgatacaatcttttttaaaaaagagaaaacactgagcatcttttccttaagccccctttcataaaatctcatattttgcccacttctccatcttaatgattgtggatttctttctcaagacctacttaatacatctcagttggaatttcgaaatgctggcaagtctttaaaaatagacagatgatgaccctaagacatttggaacttatcctaaaggctgaggcacagtagagaaaatatattgaataatatacaattttggtcaggaaatgaggaactgctaggttagaggccccattttctgtgtctggacactggagagaatgcttgtgtttggtcctccaattaagagctgcatgatgcctgtgccctgcaatgccaacacttattgggaacccataacctttgcttctccaacttctccagccaagattatgatgaaaaaagaggcaaaccacaattgccaagtctgttctcagcaattcgttcactggtctttcatcattaggcacattgcccctgtgtacctttggtcccaacgcataaagggatcttgcattgtaagcacatcatatgtttatttaaagaattttgaatctttgcagctcttattgactgttcagcagtgaaattagctgttgaaaagcatttgcactgggggtcgtttctggaaagaaaagaagtatttcttaccttcttctctaagactgcacattccttgggggtttacccatttgagactgcaagaagatgaaataactcacttttctctattaaaaggtgatctcaattgctatagagagaagaaataaacaattattaatattcctgtgtcagagagtgtttataaaagcaaactgtgaggttcgtaatctgtttttagacaagaaaaagatttaaagaatgacttaaagtgatgattataagaaaataaggagaaaaaggagagagaggagaggttaataggtaggggaaattgattctagaccaagcacttaagaattctagttctatgtttgatttcctttttatacatcttgcactttgctctaaagcaaaggagttacaaaatttttaggcaaaattttctacccatgattagcgagcatttatagaaagaagcaataagttctttcagttgaatacacccagtacctctaaaaattaatgtaaagagcacatttcatggtcactaaaagaagggtgcaatttaatgtatgatgttaccatttattactaagaggacctgatacacaaaaatataaattactttttccatatcttctttcagcttcaaatgattttgattttttttttactttagatactcagagtagaatttataaagacatttggggagtatttctacctcaaaggaaaacaaaaatataatgacatttaaccatttcagatatttcatgatatgtagttagttttgtgtatgtttctactacattaaaatatccaatttattggttgtcttgaaaggcttttgttttctgcagagattggatttccaaatatattaaaataattgcagtatttatattgtccgttcttaggggctgtacttatattgcatttctttgcagagttattgatgatgtatccttgttctgcagtatggcacttggcaaaacattgcttcctagtttgaactctccaatgtaaccttcagggggaaatggttctagaataccattgcatcaactcttttagcaaattgcattattagacatccatttataacttatcctctaagtgatctcagtcgaatcatttgctgtcttggtttcacttctatgaaatattctagagcaaatgctgcccttgcttgtgtcataggactgcagtgttggatgccttctgtgaagttcatttagcccctcataatatgcattccatgtaactaggagggaattttctttgggtagatttctcagataagttgtaaggggtggtgtgactggctaaagtgcatcagtaagagatcattggcttgtgaggagtgcaaaaggcaggcagacaaggggaagaggaagtggaagaagccctacacatattgagcaccagtccacaccacactccccatgaagcacttttcatacattgcctcatgtagactttgagatgactctgaaatctgggtgttattagaggccagagatctcaaaaaacttgctctagacacttcatacaaccggtaaagggtagaattggcatttgacacaaatttgactgcctcctaaacttaatacattttctgcaaagttattggagacaatggagcatgaaatatttcttagtttcaggggttgaagtatcatctgcacttagttttcttctcaaataagataaactctaaacaacaataagaaaagtagatttgtgagttttgtacgaattggccagctattaatatcatttggcattctaaaggaagaacggctgaagtaaaccacaggtgcagatcaaatcttgatgtctgtttcactgcaggagacaaatagaatctctctttcttgtatgcttctgttatgttgagtctaaatctgaggtaatcatgatcatttcaacctgaggtatggtttactaaattaggagaaacatacaaaagtttgttgacttttaagctaaagaaggcaaaagccataagtgaaacaattcaagtagagtgctataatgtgactgtttctaatgacaacttgaattgattgtaaaataagtctggcagttaaaatgtattagtgttggctgagcatggtggctcacgcctataatcctagcaccttgggaggctgaggcgggcagatcatgaggtcaagagattgagaccatcctggccagcatggtgaaaccccgcctttactacagatacaaaaattagctgggcatggtggaggctgtgcttgtagtcccagctacttgggaggctgaggcagaagaattgcttgaatccaggaggcagaggttgtagtgaggtgagatcacgccactgcactccagtctggtgacagagtgagactgtctcaaaaaaaaaaaaaaaacatatatatgtgtgtgtgtgtgtgtgtgtgtgtgtgtatgtgtgtgaaattatgacagaatttacctgtaaggtgttagtcatggaatactatgcagccataaaaaagaatgaaatcatgtcctttgtagcaacatggacgcagctggaggccattaccctcagtaaattgaggcagaaaaagaaaaccagataccacatgttctcacttacaagtgagagctgaactgagtatgcatgtacacaaagaagagagcaatagacactgaggcctacctgaggatggaggttgggaggaggatgagaatcaaaaaagctacctatccggtactatgctctctacctgcctgatgaaataatttgtataaccaaaccccagcaacatgcaatttacccatgtaacaaacctgcacatgtgcccctgaacctaaaagttggaaggaaaaaaaagggatagatgttagattattccaacctcagcattttaaataacctctatgactttcttagataagtaatagtaataccaaaataattagagagtggtagagttccatcaccaggtctttaccttcattttaggaataggttaaggcatcaagagataaagtaattaataaaggattatgctgtgatctgaaacacaagtacagtatttgtatttctgagctaagactaaagtccagatttctttcatttcggtgcttgttcgtttataccacactgccccaaaggacactaactgtaatagtactttgtcctgacatttaggacgcactcacacccttttgtccagatgtttctgtcttagatttccttactaaacactaggattgtgaaacctttcctttcctttctagggacaaaatggtattcactggcatatctagtttaatgctttgcgtacagggtgtgccacagacaattgggttaatggttgtaactggttaattgattgacacttaattttcagagttcgaccataactaaagagagatgagctccttgaggagcttcccactcccctagtcctcttctgctgaaaactactgggtcctcaatttttcctgaatacaccgctcatgtggccacccctaactgacccagttgaccatggatccaatttcagccactttgtggattggccaaaactctaaaaggaagcttaccatcaaaatttctgtccaaaaaggaatgatgaacaattatctaggccaactgaattcttctttactctggtactgaaaacatataaaagaaaggaggaaatctgagaccacaaggtgggaagggttataagaatttacagaagtcacaatgatgagaaagcagaagatatgaggtggagaaggtaatacatacatagcaaagaagttgatatcgactagatatggcagctgcagtgaggccagagatccactgaattgctgcatatcacaaaagtggagaaataataaacacatgattctgagggaataagttagcctgtatacttgaggtgccttagatcctatgcttttccagttctgcttcccaagttcatgtaccattccagcaaattccggaattcttttcatactattcattctacaataacttgacccctctttttgttgacgatgactttctgttgcttacaataaaaagaccccagtagctgggcacagtggctcatgcctgtaatcccagcactttaggaggctgaggtgggcaggtcgcctgatgtcgggagtttcagaccagcctatccaacatggtaaaaccctgtctctactaaaaatacaaaaattagctggacatggtggtgtgcgcctgtagtcccagactcaggaggctgaggcaggagaatcagttgaacccaggaggcagaggttgcagtgaagccgagattactgttgattactgttacactccaacctgggtgagagagagactctgtctcaaaaaaaaaaaaaaaaaaaagaacaaaacaaaaaaaagcctaaattatacaacaggatccatgggagaacatcttgatagctttttagcaggaacatcacattccaaatgcttgctagctattttctgagtatcagttatatttaccatgatcctgaggagcagaccctttattgtgtcccagttcagtttgcatcgtcttcatacagcataaggcaacagtgatagaaataatctctagagtaatctccaagtacctttccaaagctgctatgcctcaagtacttcctttaacctttaagcgtctgccttgcatacagtcctcttgggccactcttggcaaaatatttggaaggagatctggaacctgattatttctcaatgaaaaaataatttgcttttgcactgggaagcgacagtaatccaatataagcatgccattgaaaaccttcatgccctactatttcttttaggacttttgtgaaccctttctctttgatacattacctttggcaatcatggtattccaggacgtgccaatgaagttggctgaatctgaatggtcttggaagagtggtttgtggttggaatttctcttgcttgttgatatatgtactttccatgttggactttgtgcttatgtgaattctccacgtctcaaaggcattatgtctagcaagcaatttctcataaattcttatccatacagttattctatgagagcattgcaaatatagtcagattaggctttgatttgtttttcattctaatgctatctaacaaggggatgttctgatttgtgtagccctgtgcctccaagaagttaacggtaccagatacacagctcatttattttcattgtgcccatgtggttttctgaagtcacactttgtgttgttttacatatgggaaaatggaaacctggctaacttgtctttagtaagtgattggtggagaaattagtagaaactacatctccaaattcctgatctaggtaatgctgtttcaacaagctaagttgcatttgaattttgaaatacccactctagattgcaattaccaaatagttgttatgtacccaatcacaggatatgcttttgaaatttttttcattagtacatggaagagagagttttatattgtggtaggtagaaatgcccagacaagacaggactgagataaattaatggccagtccatttattttgataaacacaaataggactaatgcaccttgagctttaggaactagcagggcatttctagttgcagcatagtcacactaaggtgcaaagagtcaatggacaagcaaaaatgtgtaagaagaaaataagattctttgtttgttttctttatttgacatatttaaaagaaggcaaaagtgtatcttccaaaaagtacattttgtggtagacacttttcctctgctaaaccatatgacatcaagtggcatcccttttcttcctttgtggtcattctaaccctgatcccagattggacaaggttgaaatatcagcatgaagtgaagttggttctggttaaacttttccaggattgtcccatcttccagtccttgtaaatgagtgtcatgctttgttgccaagtcaatgaggagacaatgttcacatggagacccttgggcacagatgaaactggaattccttctcacccatttcatacagatagtatgaaactcatttcaactgagaagtgaaaattctggttaaggaagaattggtacttgaaagttgttactttaaaaaattatcttgattcatggttttacaagtcagttataaatgttaatagcctccatcactgtcatgttagctgttgtttcagaaaagaaatacatattgtagtagttttaatagaaggagtaggacagtaaatgtaaatgtctgtcctaatggattgttttatacattagagaacaattttttaagtgatcgagtaaacaaagtccccctcctacctccacggtgattgtttctcatagatgaaaacagttttctcatcctgacgacgacaacaacttcttcttcttcttcttcctcctcttcttcttcttctctttttctctttctttcctctttatttttcttctttctttcctcctcctcctcctcttcttctgctgcttcttcttcttctccttcttcatcatcattatctcatcatcattatcatttcagtgaccagttagtgagcaccttcatgtccaagcactgtctggggtcttcacagatgttatcctaatcttcacaccagtttaatacaagtgtgttaatatatttgatatgagtgctaggatatagtatttggagatgagggaagctaagctcaaggtcacattctgctggaactggatttgacaccagagctgtctgattccaacacccacactcttccctctgccatatcctgtgggtgtgtatcaagttttctcccttgcctgtggataggttgcctattttttaaattaagctcactctttatttctttccttctccctcctccttccccaatttcccttttctccttctctttctttcatttttttcccaagatgatatttacctgcaatacactattgaaaatttctctatgcttctgccctgatctaatacaatttttatcaagggaaaaataacatttactaactaatacctttccctgtagaacctgatagaaaataaagcataaaatttaaagtttatgacacactgcaattcatccaagggcgtctaaatgttcaaagaggcacaagagagagataatttgcttttaaaagaaaatgaggccaggctcagtggctcatacctgtaatccaagcactttgagaggctgaggtgagaggattgcttgaggccaggagttcaagaccagcctgagcaacatagtgagatcccatctcttaaaaaaaaataaaaaattagccagctgtctatttaaaacaagaaagaaagaaacagaaaatgggaggaattcaacttttgattagattgtattggatttctgaaaggaaaagggggtaccaaaaaacagagaatttgttgattaagtagtgtttaagagcagaaatgtctgatgttcagtttaaagatgcctgcactgctgtgatgtaacctctgcttgcctgatactgaactctaaccatgtgtatcacatcctagacaggggagggaatggaggataattgacaagaacagcttttgatgttaaaactaggagccaaatgcaggcagggaatactgtgggaagagagcaactagagttgaaaggatggaattttccataagcaatacaaagatttttgatacctgactcctacttaaaattaattcgactagaaagactcatctttttctgaaaaactttctaatcatatatcacttattttagttccacatttgaaagcactgttgccacaaaatcacctattcttttactgattttattaattaataaaagacattgtgtaggacagtatatttgtcataattatgggcagatataagcattagctccattgcaaaataggattaaaactgaatgtacagtgttgtcaagtatgaaatatttttcccagaataaatgagtagagaagcatttaaagtctccaaaaactccaaggggcctaagtgggctctcttccaaaaaaataataataacaagttatgatcatattaccctgaaatagattcaattacccaaacaattagtcagctaacaaatatttatcaaggctcactcttctaactgatctgggatacagaaggattgtaagaattagtatcctccctaatggagttttcattctagtatgagagacaaaagtaacacttaaaagctaaaattgaatgagttagttacaaagtctgtggggttgactcgagtagagggtggttgatcagtgtaggtttaatgaaattaaaatgagtaagattctataaatgcaagactggccagagaaagtggggagctctggggccagaacagcagaggaccaaaggcatcctacacagccaattaaggaattttcctactgaagcatggggtccagggagcttcatttgtaatcccttgttctgctttgtttcattcttggactctaatatggtttgactgtgtcctcacttgaatctcaccttgagttataacaatccccacgtgtcaaggttggtgccaggtggagatgattgaatcatgggggcagtttcccccatactgttctcctggtaagtaaataagtctcattagatttgatggttttataaaaggcagttcccctgcacaagctctcttccccaccactgtgtaagacatcccttttctcttccttcatcttccattttgaatgtgaggcctccccagccaatgtggaactgtgagtccattaagtctctttcctttataaattgcccagtctcaggtgtgtctttatcagcagcatgagaatggactaatacagactccatcacagacctttgggctaaggactttacctctaggcacctgccctattacttctattaaatggtgtaaacacagtttgctcacccatgcaattgccttactgtgattcatcttgaagtctagcctgatgacagggatactatgcaccccacaaccaaccctactgagtaattggctccattaaaacaagagagaattgtgagataatctggatagagttagagttcacaccaaacatagagtttccaatttaatggattagtttcatttttgcaacattcagtactgataggatgggtcaattttggcagggtctagttgccatcttaaagcgaggtacagggtgctatttagagcactttgcagcaacaaagaggacaaggtttgaggataattctaatagctcttatacaaagatattgaaccaagtaaatttataatatgtgggtctgcaaagtattcatgtttcttgagaggagtgcttcagattgagagacgggagcaatctgtaaagaaggaacccaatggatggacactggggaatgaatatcaaggacacagttaggtatgaatttaagctagatgttcacttaggtaactgtagcctggagtggaatgacaggttagaagaagtctcctaggctgggtgcagtggttcatacctgcaattccagcactttgggaagccgaggtgggaggatcacttcaggacaggagttcaagaccagcctgggtaacataataagatcctgtctctacataaaatttaaaaagttagttgggcatggtggcatgtgcctatagtaccagctactcaggaggctgaggcaggaggatctcttgagccaaagaggtcaaggctgtagtgaactatgattgtgccattgtactccagcctgggtgacagagcaatactctgtctcaaaaaaaaaaaaaaaaaaaaaaaaagacttcaaatagcttacctatgaagaagctgcttggtaataccttaaatttcccttctatgcttttacacagaaccctaaccttgcagttgaggacttgagtcatctcacaattcttttgggtaaaaaaaatgtaaactactgtgacccaactttctttacagctgggaaggcctctatttgattgaaaatataaattaagatactaggttttaagttaaaatattaaattacctctagcttttaaaaatcataaagatctttctttaactaacagtagagggatctagtgtttcaagtattgaattggtttaactgagcaatttctgaatgtcaaagcaacagattctctaataacatcttttgtttttctaaagtttattcccatattatgttatattatcagagagccatgtaaggggactatcttactttatatccccatagaatttccttcccagagttacaatttaacattttgtcctcagcttttttatagaggtcaatataagaaatagcacaggaagaatctcttctcccctctgccctttactctgggcagaattaatcctttacttgtctatgtatatactgtgatttatatatactgctatggtagcacttaggtaataatattattgtaaggaattttgctgtctgagataaatcttccctatattctcccctttgttttactccaaaggactataatcctgcagagtttttcactaatgaatttaggcattatttttctctaaaagaaagatcacactgaaaattatataaaataggctgttttcctgggatacccttgtggcttgttagaacacccggagtcagctggactggactgccactcttcttcacttactttataggcagatgctattccttttagagactgtctctgaaagtgaggaccctgggttatgtctgatcgttgggcggggagggggctttaaggttctaatttttgtatgtgtcctatttccatgtcttgtttcccagataaactatttccttctatgtctctgctttcctgaagacaaaggtacctttttctcagcagtggagttggagaggaaacagattcaggaagagtccaatattactaccattattgcaattgcgtagtagtacatgccaaattcaccctgtcttttcattttacttacctttctcttgtcccacatgcttttattcttggcatgcttacctacaaaattatcctttttttctatttccgtattccctatgccctgtagtcttctttcaaagcccctttgaaatgctatcatgaaagacggatttcttttctcagtgctgtgagcacctccatctcctcttctcttctttcacggtgcccatttcttcttcatctcatcaagtatgcagtcctttcttcgtctgcactgttatgtacctccttccacctttgtttcttccaaacttgtatttcttttgtctttccatttaacaggcctcatttcttttatcttaggaatctattcataaaatttatacagtctttaaggtgcaaacaccttgaaggtagagaccatattatttctatgttctttatattggcactccaattaaacaaaagtctatgtccagttgaagtctggaagcctgataagcacactgaagtaaaagtcgcaatacacatgaatgactgaaagtaggttttgttaccagtggaaaagacatttgtgagaacaaaatgacacataaagaggaagcaagtgattactgacttactggaaatcccaggccgggcacggaggttcattcctgtaatcccaacactttgggaggctgagatgaggggcttacctgagctcaggagtctaagaccagcctgagtaacaagtgagaccctcttctctaccaaaaaataatttaaaaaaaattagccaggtatggtagcccatgcccatgcctgtggcctcagctactcaggaggctgaagcaagaaaattgcttgagctggagaggtcttccagcacctgaaagacagagaaagaccctgtcttcaaagaaaagaaaagaaaagaaaacccatacatttagctcaattgactaaaagcctaaatgaaaaatatatatctttcagcttaaagggttggttggattgatttgttgagtaaggtattactatttggacaattgtaaaaaggacctgtgaaagccatattttggcttggacaagctcacccaccccatgccccatctctactaagggggggtgggattcactgtcaaaagagttcttctctttaaattctatacaataggtacagtaattatatctaattgcatttgaaacacaatagttattaaggcaaacgtttctagactagtttcattattaaataaaaattgaaactgagagtttttcccatattggtaaatattgatttaattttttaattgaatgggaataatatgggcatttttttatcatttgcccaaaatattttaagaaaatactatatagtgtaaccttttttttttttttttttactatgaaggcattaattttgttttatttttagtacttgcttccagttcacttttcaaagtgtcctttaggcttgttagtttcaaaggaaataatatatttccttttgacttaaaatgcctatgctatcattagatattaatagtagaagtaacagcaggattgcctggcacaaatttgtcctgtccttcttctggctaggcaatagggtgcaaatgttccttgctgtgcttttgatggtgaaatagaaataacgcttcacattttataacacattatatttcataaagctctttcacattcatcacttcatttaatcatcaaaaacaattctgcaaactgatattatttttcacatttaagtgtgagaatattgatgctcaaggaagcaatgatttggctgaggacccaaagtgagtgtcagtgccaagacttaaatctatttcttctcactcactccagagtccttcccacatcatcacactgtctccttctactgtgctttgctctaacctgctgaactaactagcaagtgtctttagcatactacattagatagctaagacttactgaatgcctactgtatgccaaatcctgtcttaagaacttacatgtgttacctaattcaatccttgcaacccatgtatgataggtaatattattatctccatctcgcaaataaggaaacatagaatttaaataacttgctcaggaaggcatagccaataaatggaataagtaagtctcaaatctggacagtctatcttgagaaatgcatgcttaatcaccatcctctattgcctcttaaataatcaaagcccgtaaagattttataaatgacttttctcatgaataatagggcctggggtgagtttctcaatatcacttatggcaataagaatttcagcaatcataatcttggtgcattttccaaaaaggatggctccccattgggtaacacaaggtgaaatgtgtattctgttagaaatttttgattccagcctagggaggtatcaagaataatgctgttgccataaagatataagtcttgagacaaacactggagaggttcagtcattcaatcaactatacatatattactgaacattttttatgttcaaatgctgtgctaagtatctgaataatattcacatgaagctgaaaatctatcaaaaatacatttgaatacagatacttggtaaaatctctaaaatgcacaaagcttcatggacacatgaaatttctttactatggagaaatcaaggaaggtttaataaaagtagtaacattagagctaatctttgggtaaagaagaggaaaagacaaattgtagtgcatgctgtaactgtatataggttctttggagatagctcattgaatgcaaactttcagaactcacttcatgagtcaataggaactttacacaatggtgagaataaagtgcatcctttcaaagcacactgtccatggcgtgagagtaaccaccacactgacatttgttgaagaaaggttctcctgggttctccccactctaccctccttggatgccaattaggcaccttaggaaggacaagtgtcttccctgtcccaaagaattgatttttatagatatttatatctacttttgtgaacatgcaatgttcattttgattattattaaatcaatgtaaattctgaatgaatttctctgacttttactttgcttattaagttgaagactcaagggcaatgcagatgagaatttcagattcttcctttgagaggatttttggtcagtggctctttaagaagacccaaagcaggttgggtatacttcgtaaaatcagatacttggtatatagttcttttttttttcttttctttttttggtaacatcaccacgaggatttctttgctgaaatgcactgaccttctgtaaaaattaacactggaagtattttccaatggaaattgactaataaagaaatcaataatgaaggaatatttttagactggcaagaatcatgatgacactgttaagaagaaaacattgtacatatttaatatgtttaaattccagatcctcaatattatgattaagaatttaatgatttttgtttataattccttctcattgtgtgcccacatcatacttagcttaaattatgtatctaaatatgtcttctctataaagtttcttgtggtcagaatcaagtggtccactagtttcatttagcagtagatgtatatattttgacacataccaaagaagtgcagctcagtacccaaaagatgtactaactgaaaactttagttcatgtaatatgcccggcattcaccctcgcggaatttagacaggagggattgtggcctgtatgtttgacttctggaacttaccttagtaaaattcaaaaaacaggttcattagtaatttcttcaaagaaatctgcttcaatttattcagatgttttgtagtctctactttgtattaaatataaagcactgagttaaagaggtaaaaatatcaaaatgaacaggatagtctctctcctctgggatcttataatcatgtaaagaaacagatatgtaaaaactgtaaaaaagatatgtacaatataattataatataggaaaattaaaggccatacattttgtaaataaacagctatgggaacaaaaaaatgtgcatttttttttctaattggcaaagtctaaatgggattgtggaggagcagtttgtatttaagcctgcaattgaactacatgtattatttttaaaactggagatttgaagggaacactggtggcaaatagaattgtatgaacaaaggaacagagatttggaaaggcagatggatgtcagcatggctagaggacaggtacacagctgatggggcagaaggtagctatgaaaggtttgcagaagtcagattgtcagtttcttttaaagcctgctaaatgtgtacactttattgtgtaaacagtggcaaacagtaaaggttttgaactgtaatgatgtagtggtctgggctaaactattcagagcaagcattttaggttacagtaactgaactgtgggtttttgtttacatgtatccagagttgttccctacctttgcaaggtcagtgtctcagtgatgtgccttaaataccttgtccttgaaatagaacctcaacatcttcaccttgttctttttttttaaaagaccgtgtcttactctatctacaggcatgcaccaccatgcctggctaatattttatatatttttaaagatgggacctcactctcttgcccaggctgatcccaaactcctggcctcaagcaatcctcccacctcagccccccaaagtactgggattacaggcctgagccaccatgcacagacttatccctctcttaaaaaaatttgttttcaacaaattcatatgagtaagattaagaagaaatggtacaaccagacataagctgaaaagcaaaagtctcctttcctactttgtttattttgcttcccctttcagaggaaactacatttgatcattaaaccaatacatcatttatattcattttttcaaaatatattaggttggtgcaacagtgattgaagttttgtcattgaaagtaatggcaaaaaccacacttttgcacctacctaatataaaacttcatttttgttttgtctttcatattgatgaaccatcatttgtttatttttttggatattggattgccttcattgttttcactattataaatacccctattacacatacaaaatcaaaataccatttttgccttggctttttaagaaaataaacgttgattttaaaaacaatttcagatatacagaaaaattgtgaagatactacagtgaattctcatttccctctaccatgttccccctattatgaacatcttatattagtgtggtagatttgttacaataagtgagtaaatatgaatactaattattttttattgatatctgatattatttggctctgtgtccccactaacatctcaccttgaattgtaataatccccacatatcatgggagggacccagtgggagataatttaaccatgggggtgggtttttcccctgctattctagtgatagtgaataagtctcatgagatctgatggttttataaaggggagttcccctgcacatgctctcttgcctgccaccgtgtaagacatgactttgttccccctttgccttctgccatgattgtgaggcctccagagccatgtggaactgtgagtctattagacctctttcctttataaattacccagtcttaggtaagtctttaatggcagcatgagaaaggactaatacaatatcaatagatattgatatcaattatttttatcataatttattcagattttcttagttttcacctttgtcttccaggagcccatcctggataccacactacatttattcattatggctccttaggttccacttagctgcaatgttttctcagacttcctttgttttggacagccttgtcaactttgagtaatactagcagggatactgatgttttcctaagtaccagactggcgttctaggtttagtaaggaagttcacagaggtaaagtgctatgcatgatatcaagtatacatattatcaacatgactttataccattgatgttgaccttgatcactgggctgaggtagtgttgtcagattactccgcctgaacatcattgacttttcccctttccattctgtactgtttgggaggagctcattatacacagttcacacttaaggagtcaggaattactgtccacccactggagggtgaaatatctacataaattaattgaatttttttttcttgagatgaagtcttactctgtgggccatgctggagtgcagtagcacgatctcagctcactacaacctctgcctcccaggttcaagtgattctcctgcctcagtctcttgagtagctgggattacaagcacatgccaccacgcccagcaaatttttgtatttttagtagagacagggtgtcaccatattggcaaggctggtctctaactcctgacctcaagtgatcctcccacctcagcctcccaaagtgctgggattacaggcgtgagccaccatgcctggatggaattcttttgtatggcagatctatttcttctatcccatttatttatttattaattcatttatttacatcaatataggcttatggatattcattttatactttgggttaccatccaatatgacttcactttgttgcttaaattgttccagctttggccactgacttctgtgcccctctgacgtttcccatcagtgtgggatttttttttttaagcacttccttactttctggaacgacatgattctccaggcttatcttgcatattttctgcttcaacattaggcaaccagttcttcaaggagctatgactcttttaattggggaacagaacaaaagccaagacctgagtgctaagtgtgattgttactattggggtgcccttgcttctagagcttctcagctgataaagtaaagaaatttatgtgtgtatactaacttgtgcctgcgcacctatctataaatatttctatatgtaaacttctgtgtctacattaagctaaacatgagtacattttggtgtttccaagtctaatatattaccacctggttagtctagcctattccccttgtttttttctgtaaaatcctacaccaaagtgagaaacatggcttctaccttcctctatccattcacataattattaaattctattgtatgcttgtagctgaacaaaatttttaacccatattgctgtaggaaagacactttatcaactagagagtttgagtttatgtgcagttcctcttccttttagacttacagactccactcatttccaaaattactgttaaccacttttaccttcagtgaggttgtagtgtacatttgtgatatagttatattcttttggaacagcctgcattccatcctgtgataaatatgtattgcaaactctaaagaaacctttttaaaatgactaaaaagaagattaaagatgcagtgatgcgggaaatcagtaaggatataaaatcagtaatttgacctgaacagcactatcaatcaatttgttctaattgacatgtatagactattccatccaacaacagcagtatacacattctgctcaacctcacctggaacattcatcaagtagaccatattctgggccataacatttatcttaacaaattcaaaagcgtggcaatcactttgaggaacttgtccagagggtataaggaaaggacaaacaaatgaaatatagaaatgatagaaaaagtgaaataaagagaagacattgtaatgttaatgtccataaaatagaaatacaagaagcattaaaaaataaataaatcaaggatagaaaatatttgaagaatattgtattcaaatatatcttataatttttgaaattataaaagcattaagaacccaaatttgagggtttcataaatggttaacaaaataaagaaaataatcctttacctagctacattattgcaaattttaggacataaaaggcaaagagaacaaaacaaaacattcaaggagggaaaaagaaacaagtattcaattgttatatttctcaccagttatggtggatacatgaagataatacgttactaaagaaaaagtgctttaaacctgggaatttatattttattaaaatataaaatattatttaaatgtgaaaatgaaacaaatttatttttagtttgaccacttaagatgtgctttgaaaataccattgaagatgggatatccataaaatggaatattattcagcaataaaaactcatgagttatcaagccacaagaaacatggaagaaccttaaatatacattcctaagtggcagaagccagtctgaaaaggctgtatgattgcagccccacgaccttctgggaaagggaagaccatggagacaataaaaaagatcagtggttgtcaaggattcagggactggttgaggatggagagggcagtggatggggagggaaatgggtagaacacagggcatattgagggcagtgaaactattttgtatgagactgttatggtggatacattgcatcatgcatttgtgaaaactcataaaagtgcacaacaccgagagtgaaatctaatgtaaactatgacctttaattagtaataatgtatcagtgttggttcagcacttgtcacaagtgcaccacactaatgcaagatgtgaataatagggaaaaactcgggagggtgggggctgggggaaggtgtagaaggaatacatgagaactctgtgcttttggttcaacttttctataaatctaatactgtttaaaaaattaaagtctgttgattaaaaaaaattacaccccagaaagaaaatatatccaggagaacccaggaaaatatgggaagtatggatgagaaaactatcaaagctatcagtaaggtatattacttataaataaacaagaaacaaaagagaaaaagcatacacaaaacaatccagactaacaattctcaaagacagaaatgtggtgtggtgggaaaaatgggatggagagtgtgaacaaagtcatgatgagacctcacagaggcaaaaatgtactaggatacttgtcttgggggcaatataaaatcatgtatataatttaagggtaattaatacaagtgttcatttaatacagtgggaataactaaggaaaaataggatttgagaatataattctcaaaccagaagaagaaaatttggtatgaccaatgaaaggaagaaaagaaaagaaggaaaaaaagaaaggaagaaaacatatagagaaggaatagaaagggaaagaggaagaaataaaggaaaaagggaagggaggaagaaagaagggagggaggatggaagagaggaaggaaggagggagggagagagggaaagccaaaacaggcgaggaatgatgagaaggatgggtagctgttctgtggattgtgtgagttaaggggaaggaagtggtgggacttaacatcagctccatatgctacagagtcaagtatcctcacatattcttacattttccctgaagttatatattgagagccagtggaagacatcgtagaaattccctggtctattttgtgaatgtgtcttgtagtacatagataattacatgtgagccattcctataaaaaggtttagattggtcaaggatgaaagaaaaagagacttgcaggtggaaaacaaaaagggcaataaattaaatctttcaaaataataattgctgaaaaatagtcatcttaagaacctcatataactactagtttaaaatattgccatccagttattgaaaaaagcaatttttcacatcaagaatttttatttatcttaaaatatttcagaggcaattggtgttatgctttagacacttgactgacagtaaaagtttactataataattcaaatgcctcttcaaagtggatgaacagaaacaaaacgttcagcgaggtgagtgttaaattattattatttagtgggaaaatgacctgaactattttctttggttgctgttacataatccataatctgatatcagttccattttgttgtttgtatttgtgcttgaactttcaatacaatagaggtcactaatggaagcctaaaaaagaatttttatttgacttttggttcattagaagtttctttgttctagttattttccttagcagagtgaatttctctcactttctcactatttgtccaatttactacctaagcctggatgtttgtcttttcatactctggaaacatggacaaagacaaaacatagggagtttcgaggcattattcaataactacctagagaataatggctctattttatatgatctaacttggtcacttgaatgggtcatatttctccaatattcacagaaccacctaagttgtttttggttgtgtggacatagatcagattgcctttgaatcatgatttgtagatgtaaacactatttattagttgtaaaaactttatattatctttaacagcctggccaaaaggtcattattgtttaggccttctgccttccagaaagagtatgactaaaacagatgtattgggcagaatttccagaaataccccaccacccccaatttcacagggctaatatccagaatctgtgaatgtgatgtcttttcattcccatgattgtcttatgtgatatgacgtagttgaccctgaaagggtagggtattcctggcagacctaatctaatcacagaagctgttcaaagcagagaaatttctcgtgctagtgacagaagacgaaagcatcagggaaagtcagaggaattcaaagtgtataaaggacttgagctgttgctggtttgaatacagaggagccacatgagaaggaaggtggttagccatgggttgctgagagagagattcacagctgagcatcagcaaaggaacctggagctcagacctagagccacaaagaactggattctgccaacaacctgaatgatcttgaaagtggtttcttcccccacattctccagattagagcccagtaagccatcaccttgactttgaccttgtgataacttgaccaaacctagctaagctggccaggacttctgacccacagaactgtgaaataatacatgggtgttgttttaagccattgagctctggtaatcagtaatatagaggcagacaataaatatagcatctaaaaccagtagctgtttattttgagatgtcaaagaggatcccattctggtgtttgatatttcagagtgccaggccatttttcctcacatcccactgacattcctcttgttttgatttaaatgaatagtctcccttagatgtcccagacaggattataagtctctttccttaaaagtttcagttgttaagatatgtagcataaaattgtatactataatggatcttgtaaatctaaccatttgctaaggtaacacaggttgtaggaagcaaatctggtactagaagccaagatgaaggattttcaacctagtgacctttctactcaaaagccatactggctctgaccttcatattttaattgatcaggcaaataatctcaaatcctccaactttgtttgattatttggctaattctgctcagaatcctctctaaatatctactggaggcagggacattaactgaatttgaaaagcaatattatggtaagactctctctaataataccataaaataccatagcaaggttgtttttaacagataattaaatgaagtccaaaggaaataactagcttgcccaaggttactctttgcaattgagaaaactgaggcttgaataggtgtaattattcattcaaatgtcctcggccagttcatggcagagatagaaagtcgatccacatctcttgatttccaattctttttttacactgagctatgtcaatatgtcaattctatagggtttgccctcagattagtttgagaaataaagtatattcacagcctctgtgttttcagtgtactaccagctgggatatctatgacttagttccaagctgtgatattctctgggactacaaatttttaagagccattttaaaattggctagaaggcaaatctagggtgcccataatgactgtacccagccctgctatgagtgactgcactgtgatttattccctactcagtgcccatcccccactccaaagccctacaggatttaggaaaaactgctggaagaaatgctacatcatgaaagcttaaaaaggctcagggaacaccacacttgaatcagtataggtgggactggtatatttcttttgctatttcattatccattttgcagttcttataaaaaatgagtctgttgatgtagtcttctgaagcattaagatatatgctatttctgcagtgaacaggctgcttagtgaagaagagtgtcggctcacttttgttctttcatatatttattagagtacgctttcccagagtgtcgattgcatgactttattgaagctagtttgaactcagactttcccccactgaatctgagatccactgaggcccagacaccaaggagctgttacacatgtataactattccattcacacctcttcaggagtttcaaacaagtttaattataagagaaacaaaagaaagcacttcttctttgccactgctaggaaaaaaaattgctttgcttggaaatcaattcattgtaagctttaatctgcctagttcggtttctcagaatgaatatttcaaatattaaatattttcttgagtagaatgtatagtacatattttatactaatatctatgtgtgtgttagacaattaagaagactggagtgttttccaaaaacttgaaaagttttcggtgactcgtaatacagaagtgacatttttatttgagaacaatttaccagattatgtcaagttcattattggtatgatactaattatccttaggataaattggaaaggggaaccctctgctagttttctgaagagctgcgtaagcctgatgaaatgtcttttctctttctgtgactcaaagctccagaaaaatctgcaaagttgaatatcacttgtgcctgctaatcttgtgtcatagttattttctatcactgtcataatgtcagagaagcactgggaaaatctgcacatcactcatctctccttcttcacccttatccaggtatatccacatatatccaaacatccagaaggtcacaggtgggatatttttgaagatgtactcacttcagcacaggtgaacctgttgatgacttccaggtctaaatatggtgaccttagtcacactggttatttttagggagcttcctctgactctcttataaactcaagatgataaatgcaatctacctgtaagattcttgagaaatttgtgttgtataatatgaccgtatatgatcccagtagttgtgtggaacttgataggaaccacagtaagtatcacctctccttgcttccatcattcccctactccaacagtttcatcttcctcttctgtttctagtgaataaaacatagtctgctgattttaaggtatattccattcccagttgtatacacaatggttaactttacattcgtgcaatcagtcagtcaacatttgagtgtgtactctatgtcagatgctgttttaggtgctaggggcccagcagtgaacaaaacaggccattgctgtgctggaagtaaaattctagttgggggagacataaaataaggaaataaataagtatataatataaggtaatatatacaaatgaaaaaaataaagcaggaaagagggtagggttttggggggaagaggatgttaaaaagttctaatggtctaggtatggctcattgacatagtgacctttgagcaaaatcgtgaaggtgaaggagctttactctttgaatcaggatgtcaggtcttagtttagactcttcagactagatcttagccattgtttatagatttgcttaaatgtctaattctttttcagctgattatgttggagtttattgttcctaatgaccaatatgctctaccaatgtcagaggcctgattgacttttgagggacaatgactgctccagtttatgcactttctctccccccagccctcccatccctcccatcctcctctgcctaccctccccaccccactcactttttggggttcctttgtcagctgtgtattatggcaaggatcgacattttcttgacattcattgtagagaaggtgatgtaatctctccttggagggtggtcacctgctgcttgcaggctgagctaaaagcagattctctcaatgacaggtatgactgcatttcctgggcaccttcagcaaacaaggctcttgcaacaatagcttgcgtcttattcttaattacttcataccccaaattaggtgggctaaatatctttttgttgtcacagaatggaaagcacatcataattagtgtaaaacaaatatcctcatagggtccaacatgcagtatcctaaaagaaaacgaagtaaacaatttatgtattttgtaatatacatggaatatgccattaggttgttttgcaaacccatgtaggtgatcctggtagattagatttacaatatatctttcctttcacttcattctctccatcctctatccattaatttttcttatatctagaaatagggcactaaagaaaactacagtatacagttcctgctttctctgaaatcaactattaacttcaggcaagtggaacacatacttggtacattacttttttttaaatccctgtattgcataatagaagagaatggtaatttttatcatgccattaatgtgattcctttctttattgcttaaagtgtcaatcagtcaaattgaaatgggttattactctgttatcttcttcattttaattatttggctctcccagcattacccttcattacctgttctccagaggatttgttttatctgaaaataatttactgcttaacatcgatgcatttttctgatatcgttaggtgggcctggtgttacatttagagagttaccgtcatcagagtaagaggaaatatatacagtgttttatcttgcagaacttaatgtaccaaatctgatgtcctataatgtttcagagggatgatacaaatcatttgcaactagaagctgaatattcagccttgtcacaagaattctcccttattcaattagattttttaggtgtttgctttaaaaagtaatatcagattagtaatggggaagcaatctttgaaatcattggtgggccaaaccatgataataagatacaaaagagaaatgaatggtgggaaatggcagacacattacacataaacattgttttgttatggcaaatctctacggcttctcaccacgatgtcagtacggaagtttgaaagaaaaatgtatgcgtctcccgtagagcccatgaacttgttttcttttgcatattatagaatctgcaggtatttttcaaatgaggaccacaaacattcaagtattaggttttcttacaatgacagccaatttagcaagcccaaggttttagagcatccttcaagaggctggttccatttgcacgttcatgttcaattcgcaaagcaacagcagcagcctttacgtatcccacgattaacacttcaacctccagcccattttgtaaggttaggcattcatcaaaatgtcagaatgattacagtacagatctaaaatcccttttgtcagacactggactttaatccgctcttttctgtagtcacgtcctgtcacttttgcagctgacaattattgtttttggtcaaaaaattgtaccttgcaatcaaaatggcttgttatccaaattgatctctgatgctacaaaatgttgtttgtggacaattctcctgagcaccactctccctctcctccagagtttacagttgaaatggaagcaatagaaagtcaggagaacagggtggggctgaggcatgcctggtcttttcactgctaggcttggatgcctaggaaatttacctggaggcttctgagtaactgaacctctaaaagatattaaacgagactttttcactattttattcatagtttgtgcttacttttaagtgagcttttgttttggaattaaaccctgacagtcagtggcagctagaatcgccacctgtcaaaagtaaggtttccagtaaacaaaatatttacatatatcaagtgtgagagagactggggaaaaatttaatgggcaaacagaaattcatagaaggctacaaagtctttcttgaccagtctcacttgtaggtcttaagcctaagatgccatattacaggtggatcagcttcgggaggaaagcaagagctttctattggaagcaagcaaacccctctttgtgagtttctttgcatttgaggttctataaattttggagctaaaacagttagtcccttatttttgtttcactgaagctgctgaatgctaataggttattgatgatggttttatttgccagccatgaaaaatgcttggacaacaggacatgcatgacagttaatctttgtagagagaagatgagcatcagtggctgaattaggtgcggagggttgcagatgatatttaggaacacagtgacatcaagggagagggtagcccatggaactgctggccataaatagttttaggcatactaaaaatatcaggagaggataggagagactatgtggaattgctttacaagaatggcagcttcttaagaattataatgagatcagaaggtacaatgcttttcagtacttagaggtttttttctagatggaaataagcaaaagtagagaattaccagggtttacattttgtctccatcatttatagctaattgaacatgggagaaaacgtagcttccttctaaggctcagcttcctcaactggaaaattggactaaaaaagaaccatacttcagagttgttaacaggattaaatgagataatatatgtcaagtgcctagctcaatgtttggcacctcagcacatgctccagaagtggtatcaattattattacataacagagataatatttggtgggctatgtgtatttgtgagtgagagggagaaagataactgttttttttacgcatttttgtgaatgtataactttctcccaactcagctgaagcatccaccatggagagaagtgcttcaggactgttaccagagaaattgaatgagaaagagatgaaaccattttttaacatccctaatgggaattttcagtgaatggctagacagtaggcataaaagccaaactgtcatcagggaagagtctttatacaatcaattatcaagatgcctgatggataaactagaccacaagtcctgcaggaggacttgctgggatggataaagtaaggaggcagtaggtcatcccttctgttctgaggaatgtgagaggaggacaggaaggtaggaagggcaggagagtcttcctttgcagactgtatccaagactggaaagaaattttaaattagtaaaatgagataccagcagcaggaagaggaaccactttgctgaccaaccctatacccactgggtaaagggagacagagcatcaaagtgatcccagtgatgtcatgtagataggcacagagaaaatgttggtgcttagctttcttgagcatgcctgctaataactggcatggatgggactgaaaagttcctgggttgcctaaataaaatacaaaggtgataactgctaagctgtgccagtatgaaatgaaggcaggccaaggcctccacagagaaccaccagccctgattaaactataagagactggccaccagattccagcatcagatcccaggtagggcgccatacaggagagaacctacaccagggactggcatgatctcagactcccatagatttggaaaccctgtctgtccactaccctatcatctcaaaactcactacattctgtacactcagtgcaatctttgaggggaacagagaaaagagagaaaatgggaaatgatgggattaagctaaactgacatgatagactaatcctaatcctattccctccctattcacctctgtcatcaccagtgccacacagaaggtgggagtcatgagaaagacacaatgcattgtacataaaaggaaaaaagctgtgtcttcaccaactcaaaataggaaaaattgtgaccctgtgatgacaactattacagctgtcataataaaatcaagatgatggctgtatttctcaggcctcacatcaccttttcttttacaaattatttgaaatttaaagtagttttttctaattctgtgaagaaagtcaatggtagcttgatggggatagcattgaatctataaattactttgggcagtatggccattttcatgatattgactcttcctatctatgagcatgggatgtttttccatttgtttgtgtcctcttttatttccttgagcagtggtttgtagttctccttgaagaggttcttcacgtcccttgtaagttgtattcctaggtattttattctctttgaagcaattatgaatgggagctcactcatgatttggctctgtttgtctcttattggtatataggaatgcttgtgatttttgcacattgattttgtatcctgagactttgctgaagctgcttatcagcttaaggagattttggtctgagatgaaaaattcatcctgctaaaaatgcttgatctggtaagccaagtgctagagagactagaggagccaaggaacacgtaggtagggtgagataacagaagaatacccaagctgaattgaaaggaggaggtgcaaagaagcttgtgcattggattaggaaaaaatatagactttgaactcacaaggacttgatttttttccaatttgtcgtctcactctctgcataacctctattatgagttgaattttgagccccccaacccccccccaaaaaagatgttgaagtcttaaatcccaacacctgtgaatgtgaccttaattggaaataaggtctttgcagatgatcatcttaagatgaggtgattaggatatatcctaataccacatgaatgtatctgtgtataaaggggaaatctgaacacagagacagacaagtccaaagaggatgaaggcagtgatcaaggtgatccagctacaagccaaggaacaccaaagattgccagcaaatcaacagaagccaggagagaggcctgaacagattctccctcacagcatgcaaaaggaacgaaccctgccaacaccttgatttcagacttctgacctctagagctgcaggatgataaatttctgttgtttaggccacccagtctgtagtgcttgtaatgtcagccccagcaaacaaatacagcctctcaactatgtctcatcggtaaattaattatttctccccaactcataccataaaatattttagacagcttgcacaagcccccaaacaaaaaaactgtgatgaaatggctaaatagtgtagtagccatggtgtatacgaatataaacagaaacatcgtaacaggaaaaaataagaaagtccattagatgcagttgagcttccagcttgtctcttagtttcctggaaaccaaagtgaaaggaggtacctgtttggtcagaaaagttttagtattacaaaggaaatagcattgtatttctttaggggaagcaaaaactttttcttagccctaaattctacaggcagtgctgaattgctcagtaaacaatgcacttaatgatatttccttggcaaatttggtgaattatccatacactggtgtgtatgtataacatggtagtgcaacccccaacctgaaggtgacacttgtgcgcacgtaaatctctatttcttagagatgtcaaatcaaatcttataaacataagaaagctacataagcatcacaaaaaattacaaacagctatgcctcattttcataagtgatgtcctgactctatctgatctagttttcatgtaagtcctttgccactttacatctatcctcaaaagcctaacggaatctggctggataccccaggtgcttcctcaacgtagaagttttctcttgtttgtttttttttttattctgagttattttgaatatatcagtcaattttaatctaaacttgcattatgttttcaaatacaatataagaatttaattaaaaacaatgcttcactgacagcagctctacaattctgtatttgacattgtagtacaacatgcaaaggcatgtattgaggtcagtctgaaatgaaacacttagcctctatattttttggaaaaacaaatccaaaatatgaaacattcagataggtaggcataacattcagatgtccagtgatggaggtcttgctttgaggggcaggctgtttcaggtataaataaatctctcaaagtctatttaggaaaaagatatatatatattcctgcaacttcttttgtttatttttattttttgtagagatggggtcttgctatgttgcccaggctgttctcgaattcctcacctcaagcaaccctcctgcctcagtctgccaaagtgctgggattacaggtctgtgccactgtgactggcctctgtaacttcttaattctgtctgcaggagccacatggaataatttatttagtgctttaaatatatatatatgtcactaagccattttaaggaagataatcagaaaataattatcaagctgttttgaccaatataattcagattctacttcaaaaaattacaagagattgcctgaattattttttatattaaaaacatagcaggcatatgttacacaatgagttttgttctgtctttcatttgttaatactttcttaggatgataatagaaaaaaaatttgagaatttatctttctctgtaccatcaaatctacagttttccgttgtttattctcagtcatttccattcccaatttaaatgttggatataataaccagccatattaaaggcccgattctatgaatagaaaacatgaaaaaaaatttaagcgaggatttgggagatggtggtaggtaactgaacttggtaataacaataaaatgatcccaatcagaggctgttgtgtgagcacagcctgtacaattaatagtgacacttcagcagcaaagccactccaagaatcataccatcgtttgccattttatatttctctccaagattttccagagaaatgccatcaaaagcacaaatactatttctaggattccaaactctaagaaacatattaattcagaagatgttaaagcatcaaaacagagaggaaaatgttggaatggttactatttatgactagcttctgctctctgcactgaagagcgtagctatttccttcattttacagttgacattcagaaaaagtacattaaaagtacccagaaaagccttatctctgcatatttttgcaatttggaaggacaaatagaaacaacattagaacttgatacatttagtcgtactctgtattgtagacttggagtggaaaaactgtattgtagactcggagtggaaaaaacacaaactgttttccctccgctctcacaccacaacaatcaacacagatgacttctgtgaccaaatgtgtagcagcttctccacaccaacaagcaataggcaatcaatcagttctgcagcagacaccagctgggtgtcatccagtttaattccaacacagcctggatggagatatcatcagatcccacagcttaaaggctcagtcccacaagaccaccgttcgcttcacatggcagtcacaggccctgggttgttttacatgcgcttctgaccaattgtctataaatcagggttcccatgaccccttccttgtgttcaatgaatttgctagagtagctaagagaactcagaaaaagacgtgactcagtttgttgtaaaggatattacagagtacagatgaaaagatacgtaaggaaagacatggggcaaaggatgtggagcttccctcctgggcacaccaccctccaggaacctccacacatttggctctccagcagttgtctgaacctagtcttttttgtgtttacagaggcttcattacgaaagcatgactgacaaaaccattggctattggtgagcaacttaactttcagcctgtctcccatccctggaggttgggggtgggactgaaaatcccaaccttctaattctgccttggtcatcttttggtgaccagtctccatcctaaagctacctaggggttgccagtcctcagtcaaatcattagaatatgaaaatatatcattttggaaaccctaagaattttaggattgtgtgccaggaaatgatgtcaaagaccagatacatgttttataatatcacagacacatgcataggttgtccaattttttctaagtgaagttaaaaagtatttcaaccccaattgtcctattcttcccttacatcattccttcctatacttctgtctaatgtaattaagaagaacatcgaggggaaacaacttttacttgatcagagaattaactgaactattcacttcccaagtgttcaactgaaaggtagattattttatctcatcattttaggattccttttcttaactgatttgttgtttatattgagtaaagtacaccaatattaagtagtacatcttgaaaatgttttacatatttaaaggtaatagctattgtattttctattaccctatattaattttgtctgtttatgagccaaaaatagattgttgcagaaaatatgtactctttgtatcttatttctttctctgagtaaaatgctttttattttcatctattttctttcacacagcagtactttatcttcttttatattccactaaatgtatgaaatgtatgttgttttttcactgtcatgttgatggagatatgggatgattccagccaagggctgttacaaataaagttgatataagcattcttgtatatgtcttttggtgggcatgcatactgatagaagtggaattgctataggtagatgtatatttagctttaattgatactgccagactcttgcaaaatagttgaactggtttatattctcactgacaatgtatgagagttccaggtgctccacatttaatattgtcagtatttttaattttagccattctagtggatgtaagttggtatcatattgtggtttttaatttgcatattcttgatgactaatgatgtttgggacattttcataggcctcaactgtttgaatatctttttagtgaagatgttctttcgattttttgccctttgaaaaattggtttgttcatctttcttattgatttggaggagttctgtttttttttgagacggagtctcactctataacccaggctggagtgcagtggtgcaatcttggctcactgcaagctccgtctcccaggttcacaccattctcctgcctcagcctcccgagtagctgggactacaggtgcctgccaccaggcccggctaattttttgtatttttagtacagacgggttttcaccatgttagccaggatggtctcaatctcctgacatcatgatctgctcgccttggcctcccaaacagcagggattacaggcatgagccagcgtgcctggcatggaggaattctttttatattctgcttacaggtactttgtaatgtatgtgtacaggtactgtgtaatatgtttttccactctatggcttgcctattcactttattaataatgtcttttgatgtacaaaatttctttatttggatagagcccaatttataatttccttttttgtgtttagttctttgtgtttgtttgttgaaactttgcttacctgccaaatcacaaagatatttttctactcttctagatggttggtgttttagttctgtgtttagatctgtatccacctggtatttacttttaattatgatatgcaacagggaccaaggtttttatttccacacagttgctatagtaccagataaccagtgctatagtaccatttattgaaaagactatccttttctcccattgatttgcagtggtgactatatcataaaccatatacctgtgggtctccaggtctatttctgtagtttattatgctcgtttggtctattctgttatctttactcattatcaaactcctccagcttcttgtacatgtttaagattgtctttgttattgtacattatttccatttttaaataaatttggaatcagattgacaacctcctccccatgcctaccccccaaaataaatcttctggggttttgaatgctattgcattaaaaccgtggatgagtttaagtttgttggaaattgacatcttaacaatatatcaagttctgcagcctattaacatggaataacatctgcatttagttagttcatttctttcactaatgtgttctattttggaatagatgtattatgcatgtttcattagatttattcctaagtatttgtttttgatgctatgctaaatggtatttttatctcactataattgttattattatatgaaattcatggatatgaaatacaattaatttttgtatgttggcctagccagcaaccttactaatttcccttattagtcattgtttctttagtattgtttatgaccatgttatgtgtaaataatgatagttttattttttcttgccaatttttgtacattttatttcctttccttgctttattgcaatgcttcattccagtataatgtggaatgggtgataatagacatccttgtcttgtccccaccatcagaaatgcactcagtctatggtatcatgttattaattctctagtgaaaccatagtttgtatttagtaaaacaacaatgtacatttggctatttcaagcttaattgaatttctttggcctctacatgattcttccttgctgaaaaggataatttataacaaatatttcattacttataaagcaaacacttgcatttcagaatacctttgtatttcactttcaactctagaaaatatttgttaggaaagtataatttatgaactgttataatgctttagtttctattcatttatttgggatttaccatgtattgctttaaattttaagcaatttttatatgaattgcttctactctacactatgaacacaaattcaaagatagcctgtatttgtattaaatttctttgaatctcttaaggcaactagcataatgccttgtctcaataaatatatgtttattgctttagagaaaacaagtccattactattttcaaagttgaaattgcgttatatgtttaagctgccatttaaacagcactacattttgccataattttgctatagttaacattccaagtatattcaaagttgatttttatttttttcagaaaaaatgccttagtctgtttggtattgctacaaaagaacacctgagactgagtaatttgtaagaaaagaagtttgtttagctcacagttctgcaggctgagaagttcaacggcatgaccctggcttctggcaggggcttttattctgcatcataacatgacagagaaggtcaaagaggatgcagacatgtgtgaagaggggaaagtttgctaggcatcttagccctgtaacaacccactctggtggaaactacccatttcctcaagaactaatttagtttagtcttgcgagagtgagaacttactaccagaagaacaacaccaagccattcatgaaggatctgccctcataacccaaacacctcccaataggccctacctccacactggggatcaaatttcaatatgagttttgatgagaacaaaccaaccatattcaaagcattgcaaaaagttgaaaaagctctactaatgtgtaaccagacatgtgaacatatataactttgagacatagcacaacacttaaaagccttcagaatcataaaaaatgtatctatcaatcttaatattttattaactcaaattatttttacctggctgcatggacatacaacatttaccctaaatttaaaatagaatgcaaattaatattcattggtattattttcattaattgcacaacatagtgaaaataatgttaacatttttttcctttccttcttccttcttctcttttgctttttttcttacctgtaaattaactgagttgccagatatccatagttatcaatggcaatttggaggctctcagaggcagaagtggttggtgtttttctatttattgttctagatttgggtctgagcacttttataagtgaaactttccaggtattttgttgttgttgttgttgttatatcaggtcttaaactatacctttataaattcttagtcatatatactaaagggcatttaatctcacgactgttatttatgggctttaagtcctctatgcaaagggtaaaattgtccctgtgaatttcagaggtagacattaggtaaagagagagttttttgcttgacttattgcttaagtcagagcgttctctgaatcttctaactcttcatttaattcacttgaaagtatttattaatcaatgtgcctaatacatagatgggactgcttccagtgagtctgtcagtcatgttaccagagcctttatttcttcctctatgccaagcttaaaaaatcagatgatttattttacatgagccacacatgcaaatagacctgtaatgctgaaattttgatacttaaaggtaaatctagtatcagagagctctattaagtggtctagagtatattcaaattacaagacatgcaacttattctaaaatctaatgcaatctactaacagcaagggagagggaactattcagagtaaataggacattgtttatctgaaattttattgacacattaattgacaactccattttatatgacgtatacaatcaactggacctgtttaatgttagtccttagataaaaaataattgtagctcaagacctcataattgtatatatttttttcactgtacctggtacaatcatttcatgtatgaaatgaatgagtccacaatacctcaatatttgaacattttgttttaattcacttaatcattgaaccacagagtctgtgctaaatgctattatctctataactcaacaataaggagatttaacagactcaccatttaatgtgcacgggagcacagatttcaaaatttgtttcagcacaaccttttggattatcatatatttgtaccataaaataaatcatctgattttttactctactgagacggatgcatatgcaacatatttatgtgcatatattcagtgttggaaattaattcataatcatgtatatcaagtgatttggatatttacctgcaccccatctcagggaatcattagagcttgcatttggaacatttaactgattttagttatgtaatgtaattttacacacattaccttacatttcccttcaaattccttctgaatcacactgttctgatttcctggaaacgcagttcaagaaatggccaagagtagaaggatgttataagacattgagtttcgaagttttcctttaaaatacaaaaagtgaaaattccacaaaagtggaatgaaacttgatttatagtgccgcaaagaaaaatcctggaatgtgcaggaaaggaagtgaatgaacttgggaacagctgcaagtaagtatgatgaacgactctgcattgggctagcagttcatctgttccacttgcagctgcaggccaaagcgtcaccaggttttctgcagaaactcaacttggcattttaatggctgaggtgaacccactggtggccagctgctgggactgaaaatcagaagcagctccagtccttccagattgtgaggggaaaggttaaggagagggaagtggtgccttgtcccagacagacgcccattggtcctgagatttcaaaaacaccaggagagagaatgcctggcagtggagaaaccaacactcagccttctctggaagaaagaaaaggcttgaggcaggattctcaagcttcatttaattacgatcaaatagggactggcagaagagcgtagctgcagatttgcagtaactctccctaaaagaacatgagctgtgagagagtgaccttgcagccagcactgatttgacattcacctgtttccctgcttgcattggaataccgctgggttagtttggatcccaaacatagaaaagtaactcctagcaggaggcagaagagagcacttaacattatgcggccaagaggttacactggctgctgcctcttatcaatgggtctttcaggtcctttttgggagcaatcctgggcttcattgccctgcctaaactgtagtttccaagcagtttctcaggcagttcctgttacattctgtgatcctgcctaatacagtaatttgattccagttgaaaacttccattacatacatgtcttgaatcgggagagttagagccttatactttgttcctctgcaaaactgtaagagcatcactgctgtattaaagggaagtgagtggaaagttgcaaagtgagcctttgagttcaagaaaacagatgaaaatgagcccaagccttggaactacagttctaagttttgagtggtggacagagtgggaaaccacgtagcatgcaaaggggagcggaagggcagaggaaggaagcaaggctacagtgtttggctgtgttctaatgtgctctggcatggagttatcgtgagtggaactaatattacataacactatgtatattttggaagatggctgggaaatagcctttggagccaatggagatttattaaataaaaattacctcaagcttgatttttcatctttaccaagcaccatagtaaattggcatctctgagactcctgcgggagccagaaagctggaatcaaaaattcagaaacatgaaatcaagaaagaactgaaaatctgaatggaaagccagtcacaaaagaataagaagtaaaatattctttaattatgtattatctcctacagatcaaaaggaactttccaccatttcattgaacctgtgagtgaaaatgatcccaaaagtatagagaaaataaagaacagtaagcaaattaattcagtttatatactgtcttttaacctgtttagaaagaatttgagaattgtttgatcctgattatataaaaaagatatatctgtatctatgtctacgtatatattaatacatacaaataaaatttctagaaggaagagtacacaattaacagtggttacttctgaagaatgggaatgggatgttggaggagacagatctgtcacttttcattttatatttctctggtgagatcaagggagcatcttactttgtaaatattaaaaatgctgaaatatgtaggttaaaatgtaattaatctacattcctatttttcagaattaatctgacttaccatctggtcatttttgcttgcttacattttttcttttgcaaaactcattatgttgttttgctaaaaacaattaaaacaatgcatcaaactagtaagaaaaaaaaagtctcaaaccacagagaaagactcacaattaccattagatacataaaattctatgatatatttctttgtacatttctggatcaaataatggcaagatggatgaactgatggatagatggatatatagacatgcatcgatgtaggcagacagtaagatcatagtataattgatattttaatttaacagaaggttaaaactgaaattttgcttttagaggaactattgacctcaaataaatgttttattttcaccttaagacgtatctttttctaaaagatccaaagttaacttgaaaaacatggaagtcgatttttttttttttttttattttaacctatcaagctcaattgactccctctcataaaagtggaggcacagtggctcacgcctgtaatccccgcactctgggaggccgaggcgggcggatcacgaggtcaggagatcgagaccatcctggctaacaaggtgaaatcccgtctctagtaaaaaatacaaaaaattagccgggcctggtggcgggcgcctgtagtcccagctactcggggctgaggcaggagaatggcgtgaacccgggaggcggagcttgcagtgagccgagatcccgccgctgcattacggcctggccgagagagcgagactccgtctaaaaaaaaaaaaaaaaaaagtgaagatattgccacaggtctcaggtcctctttccctgcttcactttctattagttttatcagttaggtttacatttactaagtttagagcatatacaatctttttttctttttttttttttgagacggagtctcgctctgtcgcccaggctggagtgcagcggcaggatctcgactcactgcaagctccgcctaccagattcacgccattctcctgcctcagaccccggagtagccgggactacaggcgcctgtgcaatctctatggtaaccacatttcccagttgactactaccggtaataaaatcaaatggattcagtgctcacaactcttcagtctttgggctactttccattcttgaatttttagctgaattcatctctttggctggattttgtggtaaagtagttttttgcttattttttcccccaagaagggcttacatgggtctttttctatgaattattttcctacttgacaatatttacttgttacttttttactttcatcatgccttgggcgcatataatactctcccttcacattttctttccttgaatttgtggagaattttccattttattcttgcagtcaactttactgaaaacaaatctgaaataaaattaatgttattctaccgtataggcgattggctttttagtcccaagatgcctaaaaataagttacccttaacacataatagcttaacttagttaggtctagaaattgagggtttgttttgtaccacattttctagaaagagtgctccttcaacctaaagatttacttagctttttttcaggaaatttcttggattagatcttagaataaatatttattttcatttgttaaattctctacttcaggaatatctgttaacattgtgttggatttttttgtttaaagtattcacttttctctaattgcttttatctccttatctgttcatcttccttcactataattatcttaatccccatttctctgtatcagtaacttaattttcaattgcatccattgtttttctaatttatgtattagtttcataaggctattgttttgagttctttcccccttatatcggtactctcctttatcatctaattctgttattctattattttgtctttgaattttgttttagtgaacttacattcctctattatattacattatattagaattagtagttttgagtaggttggttcatgagtttgtgagtagggtagtttcaagtagggttgagtagtatttttatgtttcttgtgataattttgccaaacaatgaatatttctttttagtataaagatgtctcatggaatatttaggacatgtatatgctaaaatttatttgttgcttatatgaatttcaaattgagctgggtgtctctatttttatattttaatttgctaaatctgtatgttttttataaatttccttccttccctccttccttccttccttccttccttccttccttccttccttccttccttccttccctccctccctccctccctaatctaggaggattttatagttgccatagcgttttcttttctttttgctcatgcttgtgtgtccctaagatgccaagttaggtgggatatattgtaggtggcctcttgactctcttctcaccatactgtttgttttctttacttaatatacagtctgagaactgaatttactttcatggattatctgtttgtctgtaatctatgggaatactgggtgatgaaggcagggatctagtcttagatactctgcagccttttctctgtctcctaagatattttttctgtgcaatgggagaggggtttttgtccaatcccctgggaaatactataaatgaataatttctcaaatttgctgtgtattcttgaatcttcactctcttcaaagagacttaagccactatttcattccgggtaggagcagctaaactaaactaacagaaaagctacaaattacagtggcttaaaaaacaaaggacatttttcttgcttgggtaaagtttcatttatttttccctctatttcattgccatgacttttagggagcagtgacttctaaattgtggttcttaatcaactagagtttatagtttgtctaacattttaaaaatataatcagtttctttactactatttttatattactaattcattaattttcacccaaatctttaagaacatggctctcatggttagggaaagaaaattgcgcaaaggacttgtgtccataccgtttttttggcctcactattcctgaatgtggtttctttcttctaatgaccaaactttaggggactaggactgtgcatctcagaattaaactggtatttctgatatgtatggtttatggttcaatggaaaaatataagaatttttcaaataattttctgattgtaaggatgaatgtgacctaatgttaaaatggcaggacagaaatattaaagaactgaatgatggcatcagctcagccatttagtatttgattttggacttagtttcctcatctgtataataagagctttgcctatgtatttttccaagaccatttcagggttttgcattattttatttcatttggaattaacattcaggtcatcttatagtagtgtactgaataactgaatgttaaatgtcttgctaaaataaatattgggttggtgaagttgaagttttggaataatagctaaaattaataactatagattttaattaatgatttcattcactaactttcaaaagttagacattcaaaaactgcaagaagaatattttttcaagattataaattgctagattcttcctgcagtggaaaggggaacatgagatatttgcagtattaaatagatactcactttcaattgatacatttaataacatcactaaccttcctattcatagtgaaatgagtgatgaaaaagttttttagtaaatattttttactggaacagaaataattttgtagcaggattcataatttgtgtatactgatttaagaatatcattacttcctgaaagtggcattcatctctatgggtagtcattttaacaaggtttttgttaaaaccttccccttcattaacacactttaggaaagtgtcttctaagtcattctatcaaagtctgttgctttcaaatttgattaaagaaaacaaagtattatttgcgtacctcatttttctctaacacatttttctttgcatttctcatattctggattatgtggggatcaaatatgatttaaatgttatgcacaattttgtggtttttcctactaatgaaattttgagttgcaaagttaacattctgccattgttaatatattcttattataaaaagacaaaatttcaacacatttcatttaaagatctcaattggcttttacttgcaattccagaatcgggcagccattagaaccaaaacagttctgaggagctcccaggctgcaatgtggtgcgaaatgttttatggacagaaaatggaaatgaggtgcagaaattggaggtgagattcagagatagctgattggttacagctcagcctttgccttgtttgaacatggtttgaacagttgattgactgaagctaggctgctgtgattggctgatactttactatttgttacaaaggcaaattcctaatttaagctttcaaattgtttaagtactaagttaggttttactttgttacttaggactcatatcgaggtttctaaagcccacatctgatacgatttaacattacctatgtgaagaattactaagcagaaacattttgaaagcctcatgacctgaatcgtattaaatacttaacaattgaatttgtctcaataataattatgtttaaaattatgaatgctggtttgtaaaaaaaaaagccacaaattttaaaattctgatataatctaatatctggtattcagctttgtattatcattttaaaatttaatgaacatctctggactctaaatatttttctttttaaagttatataaaacattctctttatattcattataactattaaactatttgcctacttatttatattgaaagtccttaatatttttacaataatttaataggtttcacaatcatcattacttattatagtttatactgtttgaataataaatatatgtctatactatgactcattgatacatttcaaaatacagtgcacataagaagatcttcattctctagatctgtcatactacatatgtgaaagttaacatttgtagtggcagtgaatcctaggggcagccttgcatgttaatgttatgtggttgatttgagaggatggggatctgtgtaatcatatgatgacaatttgggtttgggaatctcagaaatgccatcagtataggaatatggctattctgctcttcctaggctaagaataaacttgaagacaaagagtagattttggccagacactgatgctaaagtcaccccgatgctgtctttgcttctaaggtataaattaccttattttaagcaactttttcaccttttcaactctatccctttcctcagcctctttcatatgtgaaataaaatattcacttactactgaggatgattttttttaaacctattaaagaatactccatagctacagaggggaccatatcctttagagactccgttggggatgatcatatgcagaattattcttgtccctttgcctctgcttaatccccttcacaaagtctgtggctcaaacaaatgagagttggcagtactaaaggaataagttcccagcatacgtctgccatgctttagcatcatttcagattagaagcatggagcaaaggcagggagacgggtcaaacaaaatgctgagagcttccctccttttaaaaaacaaaattctagtcagggaattatttttaaataaaatgcaagcccccaagacataaataaacagccagcatataatactaacaactcaatgaaagatacttccccaggtcaactcatctggtaggatcagttattttgtgttactgcattgcccctctagcgggatcatagaagaccctaaaggctacaagaagaactgctttctggctctcaagtcatttcagtggttccctgatggcagctgtctctttggggaggtggtgccgtggtctgtttggggttaggccatcagcacaggccccttgtgctagcatcacattgtcataagctttctgctaccatggctaccatccatcaccaggctctgtctccatgggcagcagcctctgtgcccaggccaccccaggacctcaggcccatctctctttccaaaggtaggtaggtggccttttcccattctttagtttttgactttgtataactgaagcttctcctgggatgatgcaggcagctgctgcacagtcactccagacttactcttcactttgttgttaggcccctgcagctcgctgcacgtgactggtgccatctgccctccccgcacgggcagctgcccctcccacactgcctatttccccctttctgctttttgtagccacatgtctaaagatggcaggccagtctctgtggtctattttatgggactttcatttataactaggcagcaacccacattagttatttatcctgatgatctccctcctcttgccccccatgacaggccccagtgtgtgttgttcccctccctgtgtccatgtgttcttattgttcagctcctacttataagtgagaacgtgtggtatttggttttctgttcctgcattagtttgctgaggataatggcttccagctccatccatgtccctgcaaaggacatgatctcattccttttaatggctgcatagtattccatggtgtatatgtagcacattttctttatccagcctatcattgatgggcatttgggtggattccatgtctttgctatcgtgactagtgctgcagtgaacatacacgtgcatgtatctttgtaataaaatgatttatatcttggggggtagatacccagtaatgggattgctgggtcaaatgatatttctggttttagatatcacaacaccatcttccacaatgattgaactggtttacattcccaccaacattgtaaaagcattcctatttctccccaacttgccagcacctgtcatttcttgactttttaataatctccattctaattggcatgagatagtatctcattgtggttttgatttgcatttctctagtgatcagtgaggttgaacttttttcatatgtttgttagctgcatgaatgtcttcttttttttttcttttattttcttttttttgagacaaagtctcacagtgtcgttcaggctggagtggtgcagtggcaccatcttagctcaccgcaatctccaccttccagcttcaagcaattctcctgcctcagcctccgaagtagctgggattataggcacctgccactatgcccagatacttttttcgtatttttagtagagatggggtttcaccatattagctaggctgatctcaagctcctgacctcaggtgatccacctgcctcagcctcccaaagtgctggggttacaggcatgagctgcctcactcagccatgaatatcttcttttgagaagtgtctgttcatgtcctttgcccacaattgtattgttagtttttttcttgtgaatgtgtttaagttccttgtagattctgggtgttagacctttgtcagatggatagattgaaaaaattttctcccactgtgtaggttacctgttcactctaatgaaaatttcttttgctgtgcagaagctctttagtttaattagatctcatttttaaatttctgcttttgttgcaactgctgttggcaattttgtcatgaaatctttgtgcccatgtcctaaatggtattgcctagattttctagggtttttatagttttggggtttacatgtaagtctttattccatcttgagttaatttttgtgtaaggtgtaaggaaggggtacagtttcaattttctgcatatggctagccagttcttccagcaccatttattaagtagggtatcctttccccattgcttgtttttgtcaggtttgtcaaagatcagatggttgtggatgtgcagtctattttttttttttttttttttggagacagagtctcgctcttctgcccaggctggagtgcagtggcaggatcttggctcactgcaagctccacctcccgggtttacaccattctcctgcctcagcctcccgagtagatgggactacaggcacccaccaccatgcctggagatgtgcagtcttatttctgagttctctattctgttccattggtctatgtgtctgtttttgtactagtaccatgctgttttggttacagtagctttgtaatatagtttgaagttgtatagcatgatgcctccaggtttgctctttttgcttaggatagtcttggctgtatgagctcttttgtagttttatataaattttaaagtagtttcttctaattctatgaagaatgtcaattgtattttaatggaaatagtattgaatctataaattactttgggtgttatggctattttcacagtattgattcttcctatccatgattatggaatgtttttccatttgtttgtgtcctctcttttttccttgaacattggtttgtagttgtccttgaagaggtccttcacttcccttgttagctgtattcctagatattttattatctttatagcaattgtgaataggagttcatattcattatttggctctctgcttgttattgttggtgtatagaatgcttgtgacttttgcacattgattttgtgtcctgagactttgctgaagttgcctatcagcttaagaagcttttgagctgagacaatggagttttccagatatagggtcatgtcatctacagacaaagacaatttgacttcctttcttcctatttgaatatcacttatttctttctctttgcctgattgctctggccataactttgaatactatgttgaataggagtgttgagagatggcttccttgtcttgtgttggttttcaaggggaatgattccagcttttgcctattcagtatgatattggctgtaggtttgttataaatggctcttattattttgaggtatgttccttcaaaacctagtttattgagagtttttaacatgaagggatgttgaattttattgaaggccttttctgcttctattgaaataatcatgtggtttttgtcattggttctgtttatgtgatgaattatgtttattgatttgcatatgttgaacaagccttgcataccaacaattaagccaactttatcatggtggataagctttttgatgtactgctggattcagtttgccagtattttattgaaaatttttgcatcaatgttcatcagggttattggcctgaagttttctttttttgctgttatctcttccgggtttggtatcaggatgatgctgccctcatgaaatgagttagggaggagtccctctttcaattgtttggaatagtttcagaagaaagtgtatcagtttctctttgtacctctgatagaattcagctgtagaccagtctattcctgggcattatttggttggtaggctatttattactgcctcaatttcagagcttgttattggtctactcaagaattcaacttcttactggttcagtcttgggagggtgtatgtatccaggaatttatgcatttcttctagattttctagtttatttgcatagaggtgttaatagtatcctctgatggttgtttgtatttctgtggggtcagtggtgatatccctttatcatttttcattgtgtctatttgattttctctcttttcttctttattagtctagctagtggtctatttttaattttttttttcaaaaaaacagctcctggattcattgactatttttaaaggttttttgtgtctttattgccttcagttctgctctgagcttggttatttcttgtcttctgctagctttgtggtttgtttactcttggttctctagatcctttagttgtggtgttaggatgtcaatttgagatttttctagcttttcaatgtgggcatttagtggtatacatttccctcttaacactgctttagctgtgtcccagatattctgatatgttgtctgtttgttctcactcatttcaaagaacttcttgatttctgccttaatttcattatctacccaggtgtcattcaggagcaggttgttcaatttcgatgtagttgtgtggttttgagtgagtttcttgagttctgatttgattgtgctgtggtctaagagactgtttgttgttatttcagttcttttgcatttgctgaggagtgatttactttcaattatttgatcatttttagagtaagtgacatgtggcaccgagaagaatgtatattctgttgttttggggtggagagttctatcgatatctatcaagtccacttgatccagagctgagttcaagttctgattatctttgttaattttctgtcttgatgatctgcctaatattgacagtggggtgttaaagtatccccacaattattgtgtgggagtctaagtctctttgtatgtctcaacttgctatatgaatcagggtgctcctgtattgggtgcataaatatttaggatagttaacttttcttgttgtccccttcaccattatgtaatgcctgcccttatttgtcttttttgatctttgttggtttaaagtctgttttgtcagaaactaggatttcaacccctgcttttttctgttttccacttgcttggtaaattttcctccatccctttattttgggtctctgtgcagctttacatgtgagatgggtctctttaatacagcacactgatgaatcttgactctttatccagctttccattcttttagttggggcatttagcccatttacatttaagggtaatattgttatgtgtgaatttgatcctgtcattatgatgctagctggttatttgcagacttttttgatgaagttgcttcatagtgtcattagtctgtgtactccactgtgtttttatagtggctggtaacaggttttcacttccatatttagtgcttccttcaggaactcttgcaaggcaggcctggtggtgacaaactccctcagcatttgcttatctgaaaaggattttatttctcctttacttatgaagcttagtttgaccagatatgacattgtaggttggaaattcttttcttcaagaatgttgactattgccccaatctcttctggctttttgggtttctgctgagaggtctgctgttagtctgatgggcttttcttcataagtgacctggcctttttctctggctacctttgacgtatttttcttcattttgacattgaagaatctaatgactatgtgtcttggggttgttcttctcatggagtatcttactggggttctctggatttcctgagtttaaatgttgccctttcttgctaggttggggaagttctcctgggtgataccctaaagtatattttccaacttgattctgttcttcctgtttctttcaggtaccccagtcagcggtaggttcagtcttttaacataatcccatagttcacagaggttttgttcattccttttcattcttttttctctaatcttggctgcctgctttatttcggcaagatagtcttcaagctctgatatcctttttttccacttggtctattcagttattgatactcgtggttgcattgtgaagttctcatgttatgttttttcagctccatcaggtcatttctgtcctctctgagctggtgattttggttaacagctcctgtaatattttatcatggttcttagcttctttgcaatggattaggacatacttctttagctcagtgaagtttgttattacccatcttctgaagcctacttctgtcaattcatccatctcagcctcagctcagttcagggcccttactggagatatgttatgatcatttgaaggagaagaggcactctggctttttgagttttcaatgtttttgcattgattctttctcatctgcatgggtttatttacctttgatctttgaggctgctgacctttggatgaggtttttatgggttctttttaattgatattgttgtcctggctttctgtttgtttttcttttagcagtcaggaccttcttacatagggctgcagccatttgctgggggtccacttcagaccctattcacctggggtcctcccacacctggaggaatcaccagtggaggctgcacaacagcaaagatggcagagtgctccttttccccaagaggagcaccaacctgatgctggccagagtgctcctgtatgaggtgtatggagacccctgttgggaagtctcaccgactcaggaggaacaggatcagggacccgcttaaataaacagcctggcttcctcttggcggagagggtgtcctgcactcaggagaatccgcctcatcagggctgccctgactctccagagctggcaggcagaaaagagtaagattgttgattcacgataccgcagccgcccctcctcctatgggctcctttcagggagatcagagttctgttcataaacccctggctagggatgctgaaaatcccacagggaggccccacgcaggtaggaggaatgggtcaaggttctgcttaaagaagcagtctggccaggaactgtccacagctgctgtgctgcgctgtggggaattgctcccgttccaaactgcccagtctcgctggcacctgcagcagggaaaaacggctgactggagcagcagtggtggtagccaccccttcccccaccgaactcggtcttcttaggctgtctccaacctgctacactggctgacagggattccaaagtgggtttcagtttgtagggttccaagggagcagggccgctgagcaaggccgcttggctccctagcttcagcccccttcccacaggagtggacggatctcctgcctccttagttttcccagagctagagtatgcaaaaactcttatgtctcagtgtctgcccaagtggtcgcccacctgagcagccgctgtgagcctgcacagctctgtgttttggacccaaggcccttggtggtgtgggctcacaagggcgtgggttgcagagatccatgggaaaagcgtgcttttcagagctgggtagcacaatacctcaccagcttcctcggctcagagagggagcaccttttgccgcacgcaggctccgggtgggccctcgctccaccctgcttttcctcactgtctgtgggttgcgccaaccatctagtcagtcccaattagagaacctgggtacctcaattgaagatgcagaatttacttgctctttttgttcttggtggaagctgcagactggagctgtttctatttggccatcttggctcaaggttcagtttgagtttctgttgcagacactgcaagaaacagaaccgaatgaacaagagatatgaaagtatgtatcatggcaataactgtttctgtttatttcttattttgttttattttgctttctaatagaattggaggaaataggaagtatttaaaaagtgtttaaatttaccatcaattattcctgtatagttctctatttttaaaaatatgcccccaagttttgaaattctgattcaatacggactttgaaaggatgtgaaatttgggagcacgtattgctgttactaagactgggggctgtgagagggcttggtgttcccccaagcagtcaggcttgcagagagaatttgtgtcctgctacggtcttttgtaaaggaagctagccccacctgttgttcaaattcattttgcttgcgtgaaagaggaatgctgtccctggaaacctctgtccaagtgcctgttttttctgttgtgggcagcattgcaaaagtgatctgtatcctctcagaaaaaggaaaaaaaaatcacatctaaaaatgttcaatgtcattacattgaacactgaccggacaagtaagctggaactgtatggttatattcacaaattctgggatgtttgttttggctttgtgttataattgcagctacgaaactaaaagtgaacaaattgctttctcatttaatttctttttatcatgtctaagtctcagtatttttatttgtagaattgtgttaataataatccacaggcttactatgaggaataaatcagatactgtacataaaacaaataggatatttgttgacatatagtattcattcaccagatgcttaatctttccttcctcttgtctatgttagcctgcgattgttattctagtgttggtctcaaataacttaaactgtcattagaattttgctttaattcatagggccaatagaggaggaggcaatggaaaaatcactaggtatgtttgcttagtctctcagatgctatagcacacaactctcagagacttggaaaaatggaaacacagagatgttgttttgtgttttgtttttgagcacagttcttatagtaaatgtgaatgtttactattatttctagggtttatgataaaagatggaaaagagaggctatactgatgaacgttgtcaacatgggggcttgtcagaaattaaacaaacttttaagaaagtaattgaatttaacaaacattattgagtaccttatctggcccaggcatggatcttaacctcaactcctcatcaagggtagaaagtagactcagtcaatgctaggcatggtggttcatgcctgttattccagtgcttttggaagccaaggcaggacgatcgcttgagaccaggagttcgagaccagcctgggccataaaccaagaccttatcgctacaaaatagaaaaaaaaaaaattagccggaaatggtggtgtgtgaatgtagtccaagctacttggggctgaggtgggaggattgcttgaaccgaagagtttgagcctgcagtgagccattatcacaccactgcactccagcctaggtgacagagccagatcctgtctcaaaaccagaaaacaacaaaacaaacagacaaaaaacagactctttctagtcatgactttattccagtgcttaccacctggtccttgccctcagagttcacaataaagggattctggtctgggaagaaagcaactttaaagaatttctatcatcattctcataataccaataaactccaaaaaagagcctaaagattttcaaatgaccttccttagaagttctagatcctagttgattacctgagcaaccatttgcctatgtgtatttcaatttaaattgtcataaacagctactcaaggaattgattaatctgaattcaaaaataacttttatttagtgaaagtcaaagcacattattgtgttttaaaaagtcaaatgttgccaactcatgacttagttaagcctggaatatgaatgtgcaattgaagcagacattggctgtatgcacaatgcctgctgtttttcttgctgttagtcattatatgttatgtcctttgtcaggttggaaacaaaagattaatttcatttggtaggcttttaaaaatgtgtttgtctggttgtgtgtgtgtgtgtatatgtatatatgcatatatacacatatatacacgtatgtatgtatatatatgtatgtatatatgtatatatgtatatacacacacacatatataaatttagttctgaaatttaggcatatatatatatatatatatatatatgaaatttaggcgcatatatatatatatatatgcgcctaaatttcagcactaaatattaaagtttaggcttaaagtaccaagatatttttttcagagatggattattttagcactaaaattcttctgagccttcagtattgctgagctttatttaggaaatactcagtgatagaagatgaatgcaaaaaaaattgattaaaaaccggagccttaaaaattgaattcccttcttactgttgatgttcttatattattttggtatctacataaatgattatttgaaaaaatttctgacatctgatgatgtgtaacatgccaaattaatttccgaatgttaaaaatcattttacttatggataacttcattatgtagaagctgactatctaatttgtaattatttttatagaaaaatggcaagtagaagcttatcatgggtgaagttaacaacaaaaggctaaaatttatttgtctctcttcagtctttttctcttcagtcaaagacaacttacacacaacaagatttctccttcttaattactacatttattatggtatttaccctgttcaaaaagccttagtgaggttccagctttgaataagatagagtaaacatactgtgccctgtctgtcctactgaatacaactatcaaacctggacaaaacacatgaattatattttcaaggactctgaaaagtgaattgtagcagacggactgagaaagaccagacctgaaaataaaacaaaaccaggcgtgagtttaccatgtttatcctctggaggaacccagctttgacttgggaagctcagaagtagacatcaacacaggcaggaagagcttcacctggcagtgacggtgacagcagctgagggtccccaggtttctaaagctctcaggacgagaaagtaggtcccaagataaggagcctaaagggcttttttctttctgtgtattccttcttggcctccaacatgggtacagtcacaagagcatgtaacagagaagaaggaatagacctaccattttctagataaagaattggaaagaggatccacaggtaaccaaaaagtaccagggaaatggcagagaaggaaaacctcaggagaccaacctcataagtggtatttattagtgcctgggctcaaatccaaattgtacatgaatatgtctggtcctagatagggtaccgaagactttgaaagtgaattttggtatatcattgcccagattccagactggctattgtgtgacacaacatacaggatatatctgaatagtgctcagaagagtttgaaaatgcaaatgatattaaaataaagatgaaaaagagaaagctggtcagaacttgtggacataacccttctggatctgttgcctgattaaaaaatagttgatattctcgaatgaattaaaacaagatttagagactgagcatggtagctcattcttgtaatccaagcactttgggagggcaaggcaagagaattgcttgcggccaggagtttgagaccagcttggccaacagtgagaccaggttgctaggaaaaagaaaaaataaaaaaataaaaagctgggcatagtggcatgtgcctgtagtcacagctacttgggaggcttaggcaggaggattacttgagctgaggatgtcgaggctgcagtgagcacatcactgcactccagcttgggtgatagagcaagacctaaaaattaaaaaaaacaaaaaacaagacttagagtctcataatattcagtaagtctagcatataatgaaaaattgctcagcatatgaagaactaggaaaatttcaacttgcatgggaaatccaacctacattaacactgagatgacagatcttggaattacctgactgactctaaagcagctgttattaaaatgttccaatgagtaagggcaaatctctttatatgaattgaaaggaagaaggtctcaacaaagaaataaaagaaatacagacattttatggtaactttagaactaaaaaacacaataactcaattaaaaaaaaactcattggaaggctccatgaaagtgacagaggaagaattggtgaatttgaagatagattgatagaaattatttcatatgaacaacacagagaaacatgatttcaaaaaaaatgaacatagcttcaggaagctgaaggacaacataaaaaggtctgatatgtatggctttgaaaatccagaaaggtagaaagagtgcagtgtgtgtgtgtgtgtgtgtgtgtgtgtatgaacatgtacacaaacgtatataaacacccttatgtttgaagaaataatggctgaaacatcccaaattagccaaatcacataaacctacagattcaaggacctcagaaaactcaaaataaacacaaataaatccatgcccaaagacatcataatgaaactgctgaaaactaaagacaaagagaaaccttgaaaaaagcctgaaaaaaaatgatatgttccttgtggagaaaaatctatttaaataacttcaaatttcttgtcaaatttcacagaagctaaaaagaaatcaaccaacattttttaaatgctggaggaaaagaactgtcaagtaaaaatattatatccaacaaaaacctcctcaggaattaaggcaaaataaagacattctcagattaaaaacaaaataagacaaaacaaaacaaaacaaaaacccaaagataccctctaaaaagtttgctgaagaaattcttcacacacaagaaaataaactgaagagcaagtttcatgaaagaacagcagaaatggtaactatataaataaatatagtacatatcatccttttcttgagttatttaaaacacttgagagtcaaaagcaaaaatatgacattggctgatacagtttttatccagtatgcatatttaatttaaatatctactataatataaaaggacctatatgatggtagtaggattcctgcattctacttgaaaaagtaaagtattgattctaaatataacatgaaaattaagcatgtatatagcaatccctggagcaaccaccaaaatttttttttgtatacacaaagagatacagtaaaaaacctgatatacttcggtggaatgctaaaaataatccaataacacaaaataagacagaaaagctaaaacagaggaataaaaatcagaaacaaccagcagaaaacaaataatgaaatggtagacttaaatccaagcatatctatacttgcattaaatgtaaatggtctaaagggccaatttaaaggctaatgattaccagaataaataaagaaaaatgtatgatgcagcaatatgctatgtacaaaaaatcactttaaaataatgacaaaggtatgcccaaagtaaaaaggtgggaactataaaccatgcaaacattaaataaaacaatactcaggttgctatatcaatattagacaaaatagacttcaaagcaaggaaaatgactgggaataaagatgacattaaataataataaaaagaacaatttactaagaagacataacaaccttaactatgtctgtagcaaacagcatagcatcaaaatacgtgaagtagaaactaacaaaaatgaaaggacaaacagaaatattcacaattatactttgaagattcaacagtactttctagaaaattgacagaactagtaaacagaaaatatgccttgatatagaaaagctgaaggaaaaaaccaactgactgaatatagttgatgtttttctcactctactccaaaacaatagaataggcattcttttcaagtgcacgtggaataatattacatttatgaagatagacctcattctaaataataaaacaaatttatggcaagttcatggaattgaagtcacacaaaatatgttttttgtccatagtgtaattaaattagaaataaatgacagatgccaggggaaaaaaattccgaacagtttgaaattcaacaatacacttctaaatactctacagtcaaagaagaagtgtcaaaaaaaaataaattatttcaaactgcatagaaatgaaagtacagcatatcaaatttgtggaatgtctgcaaagcaatgtttggaataaaatttattatgtaaaatgctcatgttatgagaaaataagttctcaaatcaataatataagcagccaccttaagaacttacataaagaaaagcaaaaaaaaaaaaaaaaaacacacacacacaaagcaatcagaagtaaaaataataaagagcatacatcaataaaactgaaatcagaaaaacagtagaacaaattaatgaaaccaacaggtggttcttgaaagagattaatcaaattgatgaacctcttgcaagactgacaggaacaaagataaaacacacaatatcagaaatggaagaatcaccactactgacaccatagcattaaaagcataagaaggttatgtgtttatttatgtataatagcaataaataattagcaagcacaacttaattagtaatttcacttaaaatagctttcagaatgtgaagcacttagacataaacctaacaaaacatgtacaagatatgtatgctaaaaactacaaaccctcatgaaaaaatcatagatgacctaaatgaatggagacatgtaccttgttcatggattaaaacactaaacttgttaagcatgttaattctactgagttgatctatagatttaatgcaactccagtcaaaatcacagtagaatattttgtagatatagacaagctagtgctaaaattcatatgaaaaggcaaaggaactagaacagccaaagcacttcttgaaagaaatggagaaattatgtgctcaattttaagaattattaaaaagcttcagtaatcaagagtctggtatcagagacgagatcagtgggtcccatagatcaatgggacataaatagacctgcataaatatgccaactcatctttaataaagatgcaaaagcaacttactgcagaaagggtaatgttctaacaaatagtaatggaacaataggaaacaattggtatacagaagaaaatgcaacctaatcctcacatattatgcaaaaagaagctcaaaatggatcgtagatttaaatgtaaaacacaaaattataaaatgtttagaagaaaatcttcatgacctagagttagggagtgagtttgggcatatctaagaagaaaatatatgtatatatttgataatttaaattggactttatacaaatttaaaacttttgctctgtaaaagacactataagagagtgaaaagataagctatagacagaaataaaatcttttcaaatttcatattcttcaaggggtttgcattcaagatatatttgaaaactcttaaaaatcaatggcaaaaatacaaagaacacgatttaaaagtgggcaaaagtcttgaacagattgtcgaccaaagtagatatggggaaggtaatcaaacagaactatgtgcaacatcattagcttaacttagggaaatgcaactaaaatgataatgccatagcactagaatgataattataaaaagaaaacaaaacgaaagaccctttcactaccaactgctggtaaggatgtggagcaactagacttcttatacgttgattatagggatacaaaatggcaaagctgcttgaaaaatgggttggcaatttctcagaaaggtgaacaaatgcttatcatatgacccatacatgccattccttagtatttatgctagcaaactttaaatttatgttcacaaaaaaccatatgtgaatatttatagtagctttgttcatatttgtcaaaaattgacaatcatcaaaatgccattcaacaggtgaatagaaaaacaaactgtggtatctgactacttcttgtcaattaaaaggaatgaattattgatttgtgcaacaacttggatgaatttcaaaggcattatacagaatgaaagaagtcaacctcaaaaagtttacctaccatatcatatagaatttcaacaaggcagagttatggtggaacgaaatcagtgagtgccaggggttggggtgggggaaaagtgtgactacaaggagatagcatgggaggttttgggggaactgatggagctgttccacatcttgattctcatggtgattatataaatctatgcatgtgatataattcataaaactatgatttatatgactataaattaattttaaaaataaaactagaagaaaaaagtcttcccaatgcttgactattgcttttagattatcctctaaactccatagcaggcaatgaatggcttccattctctggctacactcattttcccaacgtatttttttgcccagcattgttgtgaatctgttctcagtgtctcactcactttagtttttctctattccctaaagatccgagttataatatacaacctcaccaatgctgattatttgagaccagcagcatatctggagctggttaactgacagatgtgattggttggaactttacctaattcacccaaggcacatttggttttcaaagacttgaaaagggatcaatgttctcatctgtgaggttttaagacttttgtaggcgaggatgaatttcattctactgacaacctgaacgttttttcatgatttcaatacccctataaaaagataaaggcagctgggaatacttactctagaagaaatatggttgaaaggagaatataaaccattcacataaatggtaaataagtatttgtcatcttaactaaggatacaaaaaaaaggaagtgtgcatcaattataccatgatggattaattgtgctgtatggaaaaatttcctattaaggaaatttgtttaccttcctgaaaagtgtggctgaggttggtcacagagttgttctctagatctctttaaggatagattcctttttattttttaattgacaaaataaattttatttacttactgtgtacaacattgatgttttcaaatatatatacattatgaaatgactaaattttatcaaattaacatatgtattacattagatagttaccatttttgtggtgagaacactttacatttactcttttttttttaagaatacaatgtatcattaatgatagtcaccatggtacaataaatatctgtaatttattcctcctatctaactgaaattatgtatcctttaaccgacatcttcctaacacctccaatcagttcaatccaccattctgttctctcctatgagatcagcttttttagattctgagtatgagtgagatcatgcaatatttgtctttctgtgcctggattatttcacttaatacaatgtcctccaggctcatccatcttaattgcaaatgagaggatttccttctttattacagttgaatagtattttattttgtatatgtaacacatttcctttatccattcatccactgatggacactgaggttaatgtcatatcttgactattgtgaatggtgctgcagtaaacacggtaaacacggaagtgtaaaatatctctttgaaatacttatttcatatatatgtatgtatatatatgtatacatacatgtacatatatattcatacatatatgtatgtatatacatatgtacatgtatgtatgtatgaatatacatatatgcatgtatacatatatatgtatgaatatatatacatgtacatgaatatgaatatatgtacatgcatatgtacacatatatacatacatatatatatatatatatatatatatatatatatatatagtggtgggattgctggatcatatggtagttctgtttttaattttctgagaaaccttcacgctgttttccataatggttacactaatttccattcccaccagcaatgcacaagagtcccctttcctccacatcctcactagcacttgttatgttttgtctttttggtaaaagccattctaataggtgtgaggtgatatcgcattgtgacgttaatttgcgtttatccagtgattagtgatgttgagcatttttcatatgcccgatggccacttgtatgtctttttttgagaagtgtctattcagatattttgcccgttttttaatcgggttgttttgttgctgttgagttgtttgagttccttatatattttggatatgaaccccttatcaaatgtatattttacaaatatgttttcccataggatagatttttaaccgtttgggatggtttaagggaggccaaatggaaagcctaaaaaaagagcattctgtggctccatggtggattctggcatacttttttcaggatgctcttttccaggtcaatatttaaagaacttgaagaccgcaaagcttctgctcttgagatgagaaggagcttctcctccactaatgatctgaatttaacactggatcacttaaagccaggttcatttgcaaaatatttgctcagctttgatgctataaaagcctctccaaagctaaggaaaccctgagaaatggattattcatgtgactctgcagagcttggtatcaggcattgcttgtatttaatctttccctaagcattaacattctaagcttatgaaaaatttgtgacgtatgctaaatatattccatccagttatgatcagagtccagtcacctgagtgtaagatttctgccctttcagtgagaattgagagccctggtgaaggcagatagaaaagcccagaaacacttgttgttttatttatttttcattgagcctctggctaatttttgataaggtgtcacagatttaatcagttttagtttaaatagaagattgagaaatactatcttcttttcattaccattagaaagaaaccttaaagcttaattttgactgcatgaaatgatatctaacagcaaatatttgtaattggtgtattccagatacttgtagtgtaggaaatacaatattgttttctttaaaaggaaattgggtgtgtataaaacatcagaggaaacaaatttaaggcaagattctgaatgacagttctgtattctacaaacctttgctaatgaaagggaagatgatgattttcaatgtaggtcatggcctgaagtggagaatttctgaaattgtcattgcagaccctccaatcagcctgatctgtctctgcaacactcctgatgagctctgagccttctcagtgctatgagtatttacatcaggcagaggtgggttgggatccaaagcttacccaccctaatatgagtaagatgattctattacattcatcctagagagaatatccttcatagaaatagaggaagaaaaagcttgcatttggttaggaatatagattatgaagagcctccttatcctgaaagctgagataatatctgtatcatatgtggtaacaaaaaataaggttatttgtataaagaagttagcatataggaaggtatatagtaaagtgcttcataatggcaggaaggaaagaaatattgaaggaaaaatttaaaagacattgcgtcagttggtatctgtttttggcaagtaaacaaacaaaatatattttctcttttctgccagtagataggttaggaagcagctggaaggtaacatcgtgtctgacttctaggatatcacaccttcaatgagttattgttttattgttccttgggagcttccactgaacgtggtgttctgtcacttctgaaactctggggatttcttttcatgatagaaaattgacaactagtatttttttaatcatagaaggtaagaattgtgcttattgaccaaacatgtgatcaaaagtggttagaaagtctttagcaggtgtaccataaatgcctgccaccttcccatttccacacctccacagacagcttcttgtgaataccccctccacacatacccaaccatacatagtgttctctctgctaagaagaaaactgtatacagaccacatgacctcacctcactttcattctcctccgtacccaaagctgagactatggtggccagtcatttgtaagctgtctaggcacctttgacatggcattgtttgaaaagataagaggttatctttggggaatttggtatgaaggaacaaagcaatgagcagtgaagatgaaagtttatgtgacagaggctgagatagccatcatggggaatgatttaagctgaaattgtgggaaagtagaaagtatgactatgaataagtgtaatgtataacataaagacagatgatttataacacagagaaaatattacagatcagaaaatgaaaaagccaaaggggagagataagagagtggaatcgatttctgcgtaggtagagagtttaatataaagtagaatatggaatccttccatgttctccctcataaaattcacagaaacctcacgacttaccaaagatgccaagaggagcaggagatgctcttgtgtttcacccaaatatttgtttctcattttttttaatgaatgtgtgtattttctagaatgaatataaaggaatgcctcattcgtttatgtatttaaaatacgtcttgactaccaataatgtataacaacctctgctagactcaatgctaggtccagtgcatgcacttggaatccagggacccaacttggaagggctcacagtcttatgttaggagacagataaggaagcatatttatggggcacatgtgagattttgttacatgcatagaatgtgtagtgattaagtcagggtatttgagatgtccactactttgactatctgtcatttctatgtgttacatgctgtgatactgataaagacagggtatgtaaatgtgggagctcaaaggagggacatctaactccaacagtttgccagttgtggggaagaaagggtaaggaagtttcctcaaataattacatctgagcagaattatggcatgccagcaacctcagccaggtgaagggcaaagagaaacatttgcatgagagcctccagggaggtagagaatgcagtgttcaggaactacaacaacaacaacaacaacaaatcaagtattcctgggccacaagatgtgagagggggaatgatgggagatttgctggagggcagggggattcaaataaaagaccagcacacatgagctggtttgtgacctactacatagttttgacttgatccttacaacatagtattttaagttaaagagagagaagttcatatttgcagcggggaggtggataagtggttgttgagacattaaaatagtagagtttactggacttggaagacttagcactggacttggtaacttagtaccttgatttctggcatctcagtgagttgaggccacatgacaagtaggaggaagagcagttattatcaagagaatgcaaatgactgaaatgttgagttggggtttctatgggatatactggtagatagcagagtcagtagtaagatacaaataggtctgagacacaggagagaatctcaaaagggatattaagcttccatctctgtaagagccatatggttgggtagttggtttgctttgtgctatacaactatttgaagttctttacattttctttcctcctgttttttttttttttttttttttgaaacaagatcttgctctgttacccaggctggagtccagtggtgtgatcatagctcactgcagcctcaaactcctaggctcaagcgatcctcccacctcagccaactgagtagctgggactacaggcatgtgccaccatgccccattaattttttatttgtattttttttaaagacaggggtctcacggtgctggccagactggtctcaaactcctggcctcaagttatcctcccacctctacgttttcaaatctaaaaaaatagtttaggacgtattcaccttagagatttaagagtttatattttagcaagctgtaaagtccagaaatcaaattgtgagtgggcaaacaaaatcaaagcaagtttcatctcatttagaaatgtggaagaatgagaacccttagtttaccttgcttttgtgcatgcagagtgctagctgtaatgggttagcacaaaaagacaaaatcctaaatcacagtcactttgccataatttttaatagttatgttctctcatagttctatggatgacatgctcattatagacagtctgaaactgaggagaaccagggttcttcctacatgtttatgttgaatgtggagaaggtgaggttactgcttctgctgcccttttcagctcaacatttgatctggccaatgtggttagctatactgtgtctcctaccaccacacatactcagaaaactgtggtagtaaacatagaatgaacttccttaaaagtagaaaaccattcattggctaaggtacataagaataagaatgaatgatgaaaacattggtagaaatgctgatggaagaactgattgatgcagatctattttggagaccccttaactgccaggggacatgaattgcctggctggttgaattgactctagaaatgatgctctgtggccgctaagtctccatatttgaccaaaaggtgtgtgagggctgtgtccatttcatcacttgccatgagtcctcagggctagtcagaataccaggccgatacacgcttcacaagcatgtattgaatgagtgaatgagaaaatgaatacaataatattttcactagtagccatggattgaggataaaattaataagaagagcccccaggaagtccggattgagctttatgctctgggacactcttctgctcagctttgtggaataatttgcagcactagaaatggacttaacaaccaggatgagggggtcatgttttggggatcaaacctcttttcatcatgaaagctactgggtggcctctgacatgatgtgtttagttatcaaacatgtcagctaataccatggagagaacacatgtattaaaagtgacagacataacaagggtcaaagattaaaggtgaattgcaaagggctttttactgcatctctgttgttataacagtttctagagtaggttgaatacatgagcaaaaagaatgatgaggagtcatggtgagcagaagctctcttctcaggcaaagcaggaatttttttccccacattgagctaaatattctttaaatgctataaatgttactacatatctgtgctgtttgtgggacagcacaaacatatttgaaacattcagcagttctttctcattaacttccatttttctaattttcattggttatattttcctgattacagaagtagtattggctcattatcaaaaataaatgaatgaaaaaatatagacagttaaaatgtgatataatgtaatggcctaaatatgacattgttaactgtacattcctgcagttacaattgaagatggcattttatcccttaatcagatacaaagaactgttagaaaacttcctttttgcccaccactgcattgtatactgtggtatatatggaaattcccaatacagacatggaaatgataaataaacacaaggggaactctcacggcataactctgtgtctagcaggctaagataataccatgttgtgcagtggtggtaattagagcacatcacgtgactctgagtttttgagggcagtggtcaatatctttatctttgtatccccaagggtgttggctaaaatgttcagttagcactttgaatgagggaatgcttattgagtaaaaagtcaattacatgtgacaataaatgcagtaagaattagtcaagagaaagacaagtgtggcctgcagtcaccaacagaagctttaagctccaaggatacccaaatgcgtatgttaatcatgtgttattgttaaagcatttagatgatgatgtttggaagttgtgtgcaaaaccaggaaaaatttgaccaagttttggaagttcctttctgtttgatttatctgctgttatggtgttagggctattgctgttttatagatcagttctacactgtagtaattaactgggtaatgaagacaaaaagtatttagaaacactctgacatatcaagaaattagtgtcaccaacccagaggcttctctgtctcttcagcataatcttccatctcaggtatacctaaacttgggtgtttactgcctcaaaagcaagcatttcccttgaaaagcagatttctttctttctttttttttttttttttttttttttttttttttttttttttttgagatgagtctcgctctgtcacccaggctggagtgcagtggcacaatcttggctcactgcaacctctgcctcccgggttcaagcaattctcctgcctcaacctcccgagttgctgggtctacaggcatatgccaccatgcctggctaatttttttgtatttttagtagagacggggtttcagtatattggccaggctggtctcaaactcctgacctcaggtgatccgcctgccttggcctcccaaagtgctgggattacagagagaagctccagcttttgcactagctgaatgttgttatacttcctcaaacatttgaggataaagacataatatgtgatagttttaggtgactttttgtgtgtaacatttgagctctgaggataataatatatctttctatataacacatttcaatatctatttaatgtgccagttgcaagaattttctgattgacattgatcattttcattcagaattaagtcatttccttctgggaattaatataatagatttattatatgcttatgggccttgtctaagctctcttctccacactgtttcttcaaatgtaattccattgaaaatctagctgctgttttagagattacagtaaggcaaagcatttctcagaagacaaatatagaacctaaagttactataatgacatttggcaaattatataatctgagttcattttttttctcttctctccctcctcccttgtcacaaagcctataggaaggtatactacatattttgacacttttttttttttttgctttcaatagctgtgttcttactcaccactttaaaataacgtctttcttatatcttttaactcagaggtatactcagagactggaagacttgaacggggactggctacccagatagagcccccttggtggtgttttccttggtgatatgatactgggccgtattccctcaggattgcagggtgagaactgtgtctttgctagcagactaggtaggagaggatccattcctcagaatcaggttcatgttaacatagttcacatattgtattaaatacaaaccagaatgccaagttttttatttacaatgagcaatatagctgttaaataggctatggcactcaagtcaacaacaattcacagactcctctccccatagagaagcaacatggggatccaaattgtaatcagaatgccaagttatcaatttataatgagaaatgcatctgtctgacgagaatgttgagttggcctgataaattcattgtctccctgtagattagtgacaggggatgccaaattttcggaaagttgcgagagaatatggctttaaaacaatgggaaggagttgatcttaatttctgtcttccaattaagatggttttaacattcccacctctacctggctggccttgccgagaaaacaatactgctttagtcaaacaatactgctttagtcgctgtgaccagtgtgggcaataaaatgtttattttctgcctttcctttttctttgcttttctcaaccaactacctctctccaaaaatgtgtatgacataattgattgggcttttgtctgtcatagtattgattcatcgagcctcaatcatatttcagccttccagccctagaattactcccatattattttttactggtgtctgggctatgttcatatgtgccaatcaaacatgtatagtttactgacctaacctcacatttgtttaatcatatcctttatttttaaattctgtaaatcaactcactgcagtccttggcactgaaaatacctctatttcttcactacatttcctgaagtggcaaaaatgccaagattatatgagacccagggggaaatatagtgttctctgcccctagtgtttaatgcaaattgaaactaaaataaggcttgctttgaaaaagtacaaaaataaattttaaaaaatgctaaaagctggattcttctcttttggagatggcaaagagatagtaaagttgataaagagatgatttgggaaatgcaggtactttttagcattagtgagtagactcatttctaacatctcctggaagtatttgtgaattggctccagaatcttttgctatcacctaccctacaattaactagggatatgcaatcaccaaatacagtttctgggacaccttcaaagatgtcagcttcttcaccataaagatggcaaaaagtagaataattacattctatctttgacctttgatgagaaatgatcagtttctttttctaatccaatatggcaagcacttctaattcgtgtgaatagatctctttatagacatagtgtgtttatatttaaatactaagataatctggaattctgaagctacaactgtataatgacattatacttggtcagctattgcttttcttttcccatttatttattttgcattgagtcctacactggtgaaaggcctggtgcgttgcattgagttctgcatgtttgaacttcacaaaggttcaaaggtgtgcacatggcctggaacgataaacatttgtcctaaagtcattcttcagcttctgacatagcttgtgatttaattgccacctcattaatatgggccactgggtgtgaatttgtcaaaacaagatacatcaggagagctgagtgaaatgtttcatgttcagaggtttttaccactcctgttccccactgcccatgttttgtaaacttttaacttcaagagactggtttaataaacatgccctgtcttctaggtcattgggttaaggatcatttcagtctttttgaacttttcacttttcctgtgtaagtataagctaagtacttattgggttctaaagctaaaagcctatgaagataaagggccttattgaaatagtgaagtgagcaaaatatctttatggttcctgaccttgtcctcctgggctttgtccttcttttaatgaatgacaccttaccctcaggttcccagtatttacacctttgtagtgtttttgcaattcagaaaaatgtatttgatagatgagtagggtgactgtcgtttacaataatctattttctatctcaaaatagctaaaagagaatagtttgaatgtttctagcattaacaaaagacaaacatttaaggtgatacatattccaattataccgacttgatctttacaagttatacaaatgtattaattcaccacgtgtagcccaaaaatatgtacaactattaagtatcaatttaaatttttttaaaaggacacagtgaaggaccatacttaaacttgattatttaattgctcatcatgaaattttatagggaaagaagaagaaaatcttcaataactcaaactcataagtaaagggacatacatggctgtatataaaggctatttataaagccctctatataaaagttatacatagcctataaaataaataaggatctgactttatattggtacctggcacaacacatgcattgcacacaggaaccactccataattacaattaaaattattatacacacaaatacatatttacttcttatcaaggtatcacatgttaatgctcacatgaagcagtatcaaaataccgccaatgagttgtagaagtctcttgctctattttcctcagtggcattctcactccctagtgaagtgtttttaattatttttatttttttatttttttactggctattttagactttctggtagagcactcaataatttctggatctgtcagagttaggcaatccactctgcaattggcaagatggggattttgctcatttatacttgactctccttcttctattaatcttctccttctatttatataactgtaacatagctgcaagctttaagtaaaacacgtaaagtcattttcttgttctgatgacttgcaatattttctctttattccccacgagatgaaatgaggatcttggtcccatacgctttccccaacttcttctcactcatttcaggccctacttctgtcaatcactctttctgtgtttagattgttgatatttgcacgttctgctaaaaatacaatcatctttgcccaaaggttaactttaaaagtagaacaataaacagtattaacattattatggccacataaaaatcatttaatgttaggtaaaaagtatgttaggattacatttttttaagagaccaatgtcatgacctctaactcactgaaaagaaaagattcctagcatttgagttcaaataaatgtttttttccttatatttagtcaattgcttaaaattaagctgcatttcttttatgtattctattttcctgcatcatatcttcatatatatttttttactctctatcatattatctagtctatttggtctgctttcccccactccaaatatatcccccttctagagtcgtctttctccctactccacactggacttacaactcctagacatcgtgctgcatcgctaatgtcctaagtttggtgttattggtgctatcaatcttcttggttagatctgatattttggtagcttcctattttttgaattatcctcttgttttattataatacatcctaaagtaacttcctaagagaaagcacacaggaggtaaatgttctgtttcttgcatactctcatatttgtgtgaccctttggccgacgatagaattctaggttgaaaagagttttcctttcgaaatttgaaagctctgctccattgttgttgatgagaagtcaagtactagttttattcctcctgtttccctttaaaaacttttaggagcatctcattattttaggtatttacatgttttcgatgacatacttgagaatcctttttgcacttattacaatatacactcaaggaaacttcttggtttatagattaatgtcttccattgagctatgggaaactttatttctatcttttctttaatatgttctcgcctccattttctctcttctctttctctgacttttaatatctggatgttagatcttccagacttatcctttctcatgacttctgtctttatactttagtcaaattagtgagagtccctttactgtgtttactccctctacttttctattttgtttattccaacaactgtgtttttagtttctaagtagtctttcttgctctctattttaattgtccttaccttctgtttttattttttggttataatagtttctccaatttgtgtaagtttattagagtatcttttgtctttgttcatttatttcttacactattcctgttttcatcttgcctgtcttagtctttatccataatattgccagatctcctaatatatttattattcttgctggtctatttgtatttaagggaaacaaaaatggcagactgcttttttttttatctaatagaactatttacacttaaaatctttatccttagtgagaactgtgggaatagaggaaacagagggaggggcaggtgatccaatatattaaagaggtgaaatttggcatcaatgagcctccaccataaaagaatgtgaaaattgctattcccagatgccaacatctaactaaagccttgcttttctactgggaattagttcaatttttttagagaagaacaaacaataatttttgttttgctttgttttggtttttggtttggggggttgcatgattattattttcttggatgattattattatttgcttgtaattgttcctgctgtttgtttcccaatatctcaaacggagatatttggctgcacaggagaacaacatatgtagctgtttcatacatggagcttacattgggttttgttttcagtcatatcttttatttctacccttggactccctgaagtttttgttattctttttatttctgccaaatctcccaccaatttcgtagtcaccttatagcatattttagactctggttttctgcctgttacgttttaaaatggagcagtaaacacaattatgaccacataactaagttaaaattgagtcaaaaagtgtgctaagattaggttttagatttttttttactttcagggaccaatgttgtgaacttcccatcacctatcttcatcttcatcccaaaatagcacaccctttcttggttattatgtacttcttttgtgttctgctaaactattatatactatacttatgctttcaaaataattcatttatatataattaagttttgtgtaaatatttaacatataaatatttagtagaatctctgaaaggagtgaaggcaaaaactttcctgacccataataattacatacctagagcatcacaaaatctattatcaatgaatggattctgaattctttgataacatgtctttaatttttaggatttaaagtacctcctttaaagcaccagaccagtagtcaattattatgatactcacctctgatattgtcttatccctgagtgtgtaataaacttctggtccctggaatttctcttccctcataaaactgtttctcaatgtatcattttgtgatgacttttttttctgagcttcctttacctacccaataggtacacattttttcccaagatgctacaacaataccagacaattccagatattcccgccttccacttgtgatctgtaaaatatatatactggttggttatgtgcaatgttttatgccctatgccctttcactggtgatgttttaaagcaagcattgtagatgaccatgaattatagcagacaggttcccagtcctatgctgtttcctaatgtacattttttctcttgtcacaactaggaaagtcacgtttcagtgttttggttttggtgaatgcccacaacaaggctagtgaaggaaggaggcatagtaggaagctgttggccagacgagcttttagaagacccttgctacatagagaggacgtagaaaatgtctttatcattaggtgagaaacatgaactgcattctttgttgcgtcatattaaaatgtaaatcacaagaataaattataaaaataaaacctaaccaaaacacaaacaggaggaggtaacagaggacagaacagagttcctagaaaattatattacaggacagacatacaagtacccaagagaaagcaaaattctaaaagtctcttagccaagtgtagagcacaaaagttctcctcagttcatgcactttcgaggcatgtcagttggaaaaagagcatgctataggagacagttttattgtgttttgtgcagtgaccttttaaaagggaaaggtcctttctgagatattttgagttcactcatgcatctgtcatagaatttgcttggaacgaagtgtgcctgtcaccccaacctttcttcagagcagagcctgcttcctcatgggaagaatgatgttttaagagtgtcattcagatggaacagaaagaggtcttctccaggtttgtcttgctactgaatcaataggatctcctggattttgaaaagtatattaaattttttttcagacgtcagagttggggggaactagttttgtttagctttatacaaatttctagcattacttgtacggatatgctggagattctgctgcctcttgcaatctgacagcctcatggagagttgaataaatggtcattgcctgggtaagtgagggctctttctaaagtgttcaagagtaggtcacatagagaggagtgccttcttcctgcattttttcaagtacctgttttcccctattttattcttttggaagggattgattttatggtagtccctttcttttctcacctcttgacagaatgtttttctaaatgattccttcagattattctttaggtcccattaaaagaaacatgctggttcttcattctcattctgtctttatgcttaatgcagatataattcatatttgttttatcaaagtcatttgataacctcttcaatgacaaatccctgattacagatgtattctcttttggtaacccacaggggttgaaattgctctaatttttggtactgtgtattaggttgagattaaaaaaaactttgaggacaatcttttccttatttaatatctggagaaaaaatactacatgtgagaaaggtggaaaaaggatgttgcactgtatgtaataaaagctatgaattttggcacttttgtaaactgtaaagatgtaaatgttccttaattattttcagtagtcagacttatgtttcttccagttgtatttccaggctgagacaatacaaaagatggacagctctaagttgattatcaagctttaaatatgtttcacttgattaagaacattgaaggtgagaatggaattatgtaggcttcactgagtatccgtaaagttgggaacaatgatatacaacacagaaaagaagctccataagaaaacagctgcaactaacccatctggaaagagacctcaatcaaaatgatacttagcgaaagaaaaatactttcagtgatcaaattatttgtctgaccaatgcttggtggaaagattccacattactagttatttgtaatgggtaattgcacaatatactgtattgttcaatctggtgtgaatgaaagtggggagatcttgacaattgtcttggaacaatagatgtaaaattgagactattctgggaaaaccaggatgtttgggccccctggtaatagtctaatcattatacatctgtgctataagcacacaaataacatctagtaatgaaagaaacattcagctaagaaaacttgcagtcaaaaacttttgataaagctgtgaagacttgttaggtcatgtattaatttaagatctttaagatggagagcatcccatcaatgattaggagaaacacaaacattttatattgtgtttaatacacttttttatgtttaataaaaaacatatcacctaccctacaactcataattaacttatataaagttttttttgtttaataaacatttcatattgtgtttaataaaacgcaaacattttattacttacaggtcctgggtgggggcagtacgtggcatgcctggagatgacacacaaggagatcaggaagtgtgggcagggagaatgtggacctgggtcacttgtatttattggagtccagggtgagaaacctaagtgtcatgggacgaggggagcaattgggcagtttaaaacaagcaggcacaaaatttcaaacaacccaacattaaaaaccctttctggcaaagaaatgttatctagaaatctagctgacccaaaggctgagtgtgtgggtttggggtaagagctatcttgcctcaccagagcaacaaaaaggagaagtcatcggctaagctagatagccaaacaaaatggatgctgaggcaacattaaattataagaattataaggtcaagatgggatggagattctggacctggtacaaggaagtgctgcaatgaatagcagggagttagggcagactacttccagtgtcctgagttttcaggtttcatttggctgtcaaaaccatttgttccctagactgtgatttgactggtgatgctggctggcagtgcccctactgatgacttagcagatgactctgagctgacaatttgccatccttcagctgtcttggtaggagggattcagttaccagcatgcacagcacagagcagaatccaacctcatagattttcaaaaacttatcgctaaagtctattattaacagcttggtaagaaaagtctttttcattgagaaatgtatagattattgtgaaggaaaagtatttgctaagaccagactggccgaagctaatccttttgggaatagccttaccaatttgggggaaatgactcatttacttataagctatacctgtcagcttccctttactacctttgacagctcttaaaccagcagtataagaactgctagtgaaaaaataaacattagtataaaactttatgtacctattacataacagtcatatattaggtgtccattttaagtacagatactgaaatagcaaaataatttattggagaaactcaaaatgctatagaaaaatttgacttggaaagcaccacaaatgtacatgatacaagtaaacttgaagaaaccaattacattgggggatagtcttgttttctgttattctgtggacttgctttattaatatatggaatttagagtttcttatatttaaaaaatatgaaaatgcacataatcattcccaggctgctcctgatcctttagtgatgattcctacagaaaaaaaaaaagtgcttgggatggggaagaactttgtggccatcgattttttctttctttctttattatttttatttttttattatactttaagttttagggtacatgtgcacaacgtgcaggtttgttacatatgtatacatgtgccatgttggtgtgctgcacccattaactcatcatttaacattaggtatatctcctaatgctatcccttccccctcccaccaccccacaacaggccccagtgtgtgatgttccgcttcccgtgtccatgtgttctcattgttcaattcccacctatgagtgagaacatgtggtgtttggttttttgtccttgtgatagtttgctgagaatgatggtttccagcttcatccatatccctacaaaggacatggctgcatagtattccatggtgtatatatgccacattttcttaatccagtctatcattgttggacatttggcttggttccaagtctttgctattgtgaatagtgccactataaacatacctgtgcatgggtctttatagcagcatgatttataatcctttgggtatatacccagtaatgggattgctgggtcaaatggtatttctagttctagatccctgaggaatcgccaccctgacttccacaatggttgaactagtttacagtcccaccaacagtgcaaaagtgttcctatttctccacatcctctctggcacctgttgtttactgactttttaatgatcaccattctaattggtgtgagacggtatctcattgtggttttgatttgcatttctctgatggccagtgatgatgagcattttttcatgtttcttttggccgcataaatgtcttcttttgagaagtgtctgttcctatcctttgcccactttttgatggggttgtttgtttttttcttgtaaatttgtttgagttcattgtagattctggatattatccctttgtcagatgaatagattgcaaaaattttctcccattctgtaggttgcctgttcattctgatggtagtttcttttgctgtgcagaagctctttagtttaattagatcccatttgtcaattttggcctttgttgccattgcttctggtgttttagacatgaagtccttgtccatgcctatgtcctgaatggtattgcctaggttttcttctagggttttaatggttttaggtctaacatttaagtctttaatccatgttgaattaatttttgtataagatgtaaggaagggatccagtttcagctttttacatatggctagccagttttcccagcaccatttattaaatagggaatcctttccccattttcttgtttttctcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcatgatgcctccagctttgttcttctggcttagtgttgacttggcaatgaggactcttttttggttccataggaactttaaagtagttttttccaattctatgaagaaaggcattggtagcttgatggggatggcattgaatctgtaaattaccttgggcagtatggccattttcatgatattgattcttcctatccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttatgggtggataagaatgcttgtgatttttgctcatcgattttgtatcctgagactttgctgaagttgcctattagcttaaggagagtttgggctgagacgatggggttttctaaatatacaatcatatcatctccaaacagggacaatttgacttcctcttttcctaattgaataccctttatttccttctcctgtctgattgccctggccagaacttccaacactatgttgaataggagtggtgagagagggcatccctgtcttgtgccagttttcaaagggaatgcttccagtttttgcccattcagtatgatattggccgtggatttgtcatagacagcgcttattattttgaggtacgtcccatcaatacctaatttattgagagtttttagcatgaagcgttgttgaagtttgtcaaaggccttttctgcatctactgagataatcatgtggtttttgtctttggttctgtttatatgctggattacatttattgatttttgtatgttgaaccagccttgcatcccagggatgaagcccacttgatcacggtggataagctttttgatgtgctactggatttggtttgccagtattttatggccgtcaatttttgaccctgagagtgaacctcacctttggaagttactaccaagcatttgacttttggaagactctttacacagcaagagatctcctccacctttgaggtgaggacattaaacttggtttaaaaaattacttttccaagtacattaactatgtcttatatattatccatacacgattactaagaaaatataaacattttttcatatactggttaattggctttaaagaaaaaaatcccctttttaatcccatcaggatttagtttgacaaatttttcagaaacttataaagatgaaaacacctggatgtatttctctgtaaactttggctgttagcatcctttttcaatgcttgtgtagtttttcagaacagaacctaaccttcaagatgagtcatttgttcccaaacttgaattgtcatgaaacactccttgggtttccctcccgtgctgaatatgatttctaagaatgggatggcatggttactgtataaagatcatttgttctacaggtcagaaggcctgagttctcatcattaattaactttgtgatgtatgttgggtaaatcacttaacctctacagttttatcttctgtaaaatatgaaagaaagactttgagctaaagtttgtttctactgtaagaacatgagatattttatcttggtgacatcatggcttatgggcaggctgaggtgggattagtaattgcaaaagcagtggtcataaggtgaagaaacctggacatgacttcagacttaacctgggaaataaaatcagggaatgtggacaaagtcagacactactttagcacaggatgagatgccagaagatgatggatccaacaaagacatgcatgaaaggccacggggctgtttctgggcttaaacaagctagtcttaattaggagaaaaagcggagggactggaggagtggaggagaggaagtcaatagtgatgcagtacttccatcctagagggtttcttcgagagccaagagttccaatctgtgcatggcattaccccttctgaggtaaaagaaaaagtcctctacaaaaacctgacagtattctgccctcaagccccttgttaaccaggccaaggtgaggcatgggtttcatgccctactgatagcagtgcaagatgtcttgttatgagtattgatatcgaagtatgcttttaaatcatatttcactctgacaccgttagctacgtaactaagtcttagtgctattgccagtggtccaatctaaatgatgtagtagagaatctagttcattactctgagctgggactctgatgaagatgtagggtgacacactgtctttgtgaagaaggcatgtgtggaatacttggtgtctttggtgagatggcagaacttaaaccgtgaggaggatggcaatcatgaggaatggtatcaggaagtttttccagcttgatagatgggaaggaaagcagaatggcaggaagggggccaggtgctatctccttgaaggagggatgaaccgtcctcagggtctgtctgctcacaggcaggagacttataccagaactgtgtttactggaagtcttttagagttcaaagtgaacttatctgagtttgacaaataatcccctacagcaagacaaagagtagtagatgaattatacatttggatactgttggaaagggagaggtaaaatccaagttggaataaagcatatgttatgggagatcatcaatatcattgagcacgggctttgaggattagagttatgatgaagtataatagtacagaatcagcttgagacacagtcttatgtttgttttggtcatctgcctagaagtaaggtgcagaaaatgcttatactttgaaaagtcgtgaattaaatagaactttctagcaatggttgatgaactgggtgggtgtcaaaaatcaagacttcatgattgggaagctgtggggatggggaattttcttagaaaagagagagactctaaatggtgctagtggggtggcctaagccctgacagtggaatgggacctttttggaagactgcacctcggggtaaggatgcttgtgaccctgagactagcatcaacccatgatagaacccaagggtgcagaaacctatgatagaaagcaagggtaccaaaaccttgagggtgttggcagactgaggggcactcagttcacccagggacatccttcacctgagaatgacttttctagatctccctgcagtggttttgagaacctgagtcctagttgagccttctgtgatgccttccaagtcctagcagtgtggcgtgcccacacatctttctcaacaaaggatgcagaaataggaatgtaattagagcagttcatcctcggtagagagtcctttgtggttcccagctgggcagtagtttaaaggatagccctgtgaatctactcaaatagtatctttatttaagatgtcaataaaaggtagtaaacttgagaatctctgagaagcattgatccatagtggaaattacatgtatttaagtatgaaggtagtaaatatatattaacaacacattatatgccagatactgtcctgggtatgagctatagctggaagtcagagcggtacaaaatctaccatgggggagtttaagaccaagttttcaagccaaacggaactggattctactaatttccagactgatgccttggagaggttacttgaatttttctgaatgtccattttctcatatattaaatgaccattataaccttgctctgtaagactgcttgttagatgatataatatctttcaaatatctgttaaagtgcctaataatagcataatagctactcaataagtagccataattgttttaacaaatgaaatttagactcctaggaaaattagaaagtactgcactggctttcctgttttcctaatggccatgattatttatccagtgactcagtgcagattttgatttattttccttttcatagccaccttatcaaaaagtcctgctactgttatttctacttcaaaatgcatctcaaatctattcacctctctctgttcccatctgtatcaccctagtccaagctctcttactccctagagcaatagccggtaaccatgtgcttacaacacattctctgcaaaggcagcagagtgtattttttacagcatatatcagaccataagggcctcttgcttataaaggaccagtggatttttattgcatttactatccaaatctgaagttgccatcataaccagacttctctcattctcttccatgtcttctggtatcacattcctgcactaacctctacaccctgcgtcctcccacctcacctcagcttcaccgtgttctcagtttccagcacgcaccaagctctgtgccacttcgaggcctcacacctgccgatctctctgcctatgattctcttctctatgctctttgctgaaccacctccttcttatccttctgccctcagccttacctcaaccagcccatcattctctcagcctccaccgtagcacttctcatgactggtgcttgcttatttacatgttttctcttgcgcattggccaccacaaaggtaaattcttatctgttgtgtgttcaccttggaatttcccatccttaactcgataggaggctcttattaaatatctttgtaaataaatgatatttttatgatagataattgcagattacatgattgttcagttgttaactctgtgcagtcgtagagtattctggttttaaagattagcacttggtttatatgtgaatgaactttcaaaattagacacgatcttctcagttttcttgtcaaagactgtttctaaagatttgcatgagctagtctggtcctggctatcttcctatcagggatgcattcctgtattggtagattctgtagattaactttctaaatcattcatggcccttccttctgcgccgttaactaggaagtataaagtactttagaacatttcattattagtattcccaatatgaccgtggaaatgtgggcagtgggatgaggcaatcaaactgaggttttctttcatgataactatttttgaaaactacctgcagtgagaaagaattctcaagcaggtgcagtggtgtttgagagaagcataaatggagtggttgagcccagaccttggagtcaaataaacctaggtttgcatctcagctctgttgcttacaagctatgtatttaaactctctgatctccaaagtggttttggtgattcaattagatcattcatacaatgagagtcttaacaaatggtaagcatttttaacttttagaaaaacacaaggcagttagtagacgaagtgtatgaggacattgctagcttaatataaggttctttaagggtaaaataaagagaaagggaagaaaggcagagttctttcttttttaacttcttaaaccttttcttatgaaaagatatgccacataaccataattcatcctggcaattaggtaaacagtatacagaatatgactctcgccattaaataaacttaagcaaggtatctttatcctgaaggaattcttagagatttcatcatgagtaagcacttttcagtatagaattgccaaaatacaaaagaacaccagagaaccactctaacttctaaaaaaaataagaaacccaaaaccttgtgattgaaaaaaaaaaaaaaagtaagaaaaagaggcccttagtcattctgttcccttttgggcctctatctttcatttcctctggggaaataaagttataaactgtgctggcagtaatctagggtgatgccaagtcagttacccacccccaactccatgtctccaaaagattctttaccaccctttgactctaattaaagaaaacaaatgtttccagttttctgtcatgtacctttccactctgaattatagaatagctttcttgaaattcttttaattgttttttacaaaggattagcattaaattcatagataaaaataaattagtaatagtgatcaaaatgacctaactccactttgtttttacttttcttctgggtaggagggcaaataacataactgcttatatggtgatttattttaaattgaatctgaatttctatttcttaaggcctcattggcttcatggcaaataagagagttttaaagaatttattgtgttaatttctgagaaaccaggagtttactgttgacaataatggcacaaattacaactcctacacagctctaccccctccacttttgagtttcaagacttttgccaaagttttctggtctttgttcacttctattattaacatctcttgtgtgaaggggaattttgaatgaatgggatgaaatcatctaaaccagcttcggtcctaaatatagtgtctggcatcaggtctgggaaaaaaaaaattggtcaaagagatagcctgaggttatttttaggaagttggatgtttagggaaattgatactatgaaagttctggcctctatctctgaagatattccattgagagatacatgcatgcattcaacatctcgtttttttccattcctgccctttgggtgttccgcgtcattcactatcttgtcattacagcattaagcagaagcttgaggcagaagatagctaatgcaacgtttccatttggtcctgtaatttttctgcacagagctttataggatttcatttcgggttaataaggggaagttggaaccgaggagaaagcttatgctctgccaacatatactgaggattactaaacttggaggtagaaaatagaacacaggaataaaaatggaaaagtcctggcagatttctccgtagcagacttcatccttaaaaagcagaattccatccagctcttcttggtggcataattccttatcatggaattataagataaatgctctgtttttatgcgtctctcttttctaaagttgaattgagtgtctgaaagacagatgatgtgtctaataccaccgttgttttacagaagggaaatctaagaaaactatagctaccctcctgggaaaacatatctaggcatttgctaacagtcatttaggctgcatctatgcacttccacacagaaggataaatgtcacatgttcgttgaatgatccagatgtttcaaatatacagttgttttatatttggtaaacaatgcagttaggtcatgtaaattttaatttttcatttggagtttatccctatgcaggcaatcatagattagaaagttatttttttcatgtcctacctctttgaattgtcaggttcttttaaatgctgttatgtagcaataaataatattttatccataatcaaggtggatgacttactggatatcagatattattattaacaaaaagtttactacattgtacaagtatcactagacaaagacaacctctagaaagttaattaaggtaactaaggttctcaactgcaaccacaaaactttcacagttaataataatttcacagttattaacataactttttcaagaggtactatactaaaccaaggatgctaaatataacttattaatttctgtgatggcttctggggatatcaatattggtatactttcctcactgcaatgaagacacttctgcatctacttttgagatttttttggtcatctttctagcagccagctgtcacctcttgctgctgtaacagttcctagtaatagttcccttattcttcaaacctgatgttagcagggaggtcagatactcaagcatgattagaattgtagaagcttgagcctcatatttaaatgtgtgtaaatatatgtttgaaaaagaattaatgagctcttaattgcagatcaaaggatatggtttgatagtgaagtggcccaatgaaagttgtttgaattttccttttgtctttctgtaaatggaactgtgttcttgaaagcctctacgtctttatcttgttcctcaagattcttagggcagtgcgtgtgggtcaggggtaggtgtgtctgggaattaagagtatctagttgatttagtagctatatttctcttctttagcctgtttattgggaaatgaaagacaatttaggctatttcattttcagtcagtgtctgttatgaattcattggaaatagcaatgtgaaaagaggaatgaatattgtagatttctttcattgtcatatttgtaaattactgggtgggatttataaacaaattattgactaattatgaacaaactgttgtttttttcttttcaatcaatatgaacaatcaagtgacctaacaaatttaattttaaaaatagatttgaaaggtatatagtagttaaaacaaggccccttgattcagattgcctgagttcatatctcaaataggctacttttttgtggtgtgcctttaggcaggatgcctcagtttcctcatatgtaaaaaagaaatgttaatagcagcttaccttgtggggttgttgtgagtgggtcaaatgacctactatgtgtaacgcactagagcagtgcttggctggagtaagctccatgtaaatgttagtccttgaatgaaagtagagctctggtagagatattccataaagacaaccttaaacatttttgaaccttttatgcctccaaaatatacacttccaaactcttctatcactgaccatattacttataccctaacaaggaagttattaagaatcataccagagtacaggaataaatcatgccagtcaggaaaaggggtacattggttattctatttataacattacttgagtatttataacaacaagtaaacaaaacgttttttagaaaaagaagagattactgtgttgtacaaatattactagatgggtaatttctctcctttttttccaatgtattccagaacccccatggatatcaaaattaaatgctcaaatcccttacataaaatggcatagtatctgtatactttaagcagattacttataatacctaatataatgtgaatgctatgtaaatagttgccatactgcatttttaaaattaatattattttttaatattttaacctttttttttttttttttttttttttttttttttttttttgagacggagtctcgctctgtcacccaggctggagtgcattggtgcaatctcagctcactgcaacctccacctcccaggttcaagcaattctacctgcctcagcccccaagtagctgggattgcaggcacaggccaccacacccacctaatttttgtgttcatagtagagacggggtttcgccgtcttggccaggctggtctcaaactcttgacctcaagtgatccgcccaccttggcctcccagagtgctgggattacaggcatgaaccaccgcgctcggccacatgtttttaacttttatttttccaatatttttgatctatgattggttgaatttgtggaagccaaacccacagacatggagagccagctgtgtattgttattgtcatgtcttttattctcccctgttcttttctgcctaaatgccttaggtacttctttacagagttagatagcatttaccattgataccacccagagtggtgtggtttgcttctcctgaccctttcatgagcaaagctggtttcaggggaaactcagggatctgaactgttagtaacactgattagaaatgcagcagttttattcaggccttggttttattgaccatttttggttggctcttatctctgtgactgatcatgtatgcgtatttcaaatggataaataaactaaaaagtgtttaatactccaaaatgattagaagtgtattgttaaataccaaaaagaaaataattctggggtgtttcagcatgttattctgttaacatagttcacgttgagtgtttgtattcatttgttgtttgtttgtttgtaagtaacaggttttgactaaaattccacggactgtggaacagcacacactggggtctatcggagggtggaaagtgggtggagggagtgggtcaggaaaaataactaatgtatactaggcttaatacctgggtgataagatagtctttacaacaaacccccatgacacaagtttacctatataacaaacctgccattgtacacctgaacttaagtaaaaaaaaaaaaaattaagtcatgtagatgcgtactttgaggtacaaccacgtgaatgattgtgccaaattattatgacagaaaagtctattgttgatttagaaaaagaattaacactgggcatcatttgaataatgggctttataaagaactgcacatattggttactggtagtaaaattcacagaatgttagatataaaaagtcctaaagggtacaaggaaaacttggtttgtcctaggtcaactagtaagattaatctacaacccaggcttctgactctatttcaacattcttctcataatgtcattgaggttacacttaataaacaacgttaaacactctctcttttaaaaaaaattgttggctatacatgttggctcacgcctgtaatcccagcactttgggaggctgaggcaggtggatcaccagagttcaggagttcgagaccagcctggccaacatggtgaaaccccgtctctactaaaactacaaaaattagctgggcatggttgcaagtgcctataatcccagctacttgggatactgaggcaggagaatcgctggaacccgggaggcagaggttgcagtgagctgaaatcgcacattgccctccagcctgggcgacaagagcaaaacttcatcccctcccccccaaaaaattgttaactactacaagcataaatatgaatatctacttacctgcatttctgaagctagaccataagtattaacagtgcttatatctacagtccctggcagatagtcggtgtaagaaatatagattaattgaatgaatcatatgatcatggttaaggttcttcttttgtgcgttttagcatttttaaatttttacattgatcatgtattgcttttgaaattttaaaaaacctggcaaaatgtaattacgatagaaactgacatcaaaaagctttgtagctgaaatagtgtaattttacactgagtttgaaacttctgatatcaggaactttgatgagcctaatacaggtgctatacgggatgaagtgaatatgcttagaatttttgatgaaaacaaatctgactactcaggtttctctatgagaagggtaggcagtttgatttgtaattatgggaagctgaatgtgaggcttggatgaggctttgtcagtatcagaccagctccttcctattgggggctgaattcccttgggctctccatcagagagaccaacaggaagcaatcatgtagttcttccaacacactcagaagtcagtaggtccactccacaaataaattgtaattggccatatagtaaaatatttggtagtgttattcttgtccttttccatatgtacaagagagaaaaataaaacaacttcacatcctcctaagcaagtgatcgagtttagatatttgtcccctccaaatctcatgttgaaatgcgacctcctcatgttggaggtggggcctcactggaggtgattgggtcataggttccctcccagtggtaatgagtgagttcttactctgttagttcatgcaagaattgatggtttaaaagagtctggtgattctctcccctctctcctgcctgtgctctcaccatgtgacatgtctattcctccttcaccttccagcatgattgcaagcttcctgagttcctgaccagaagcagatgctggcaccacactttgtgtatagcctttagaaccatgagccaaatcaaccacttttctttatgaattattcagtcccaggtattcctttatagcaacacaaaacaggcaaataccggagcaacagatcagaataaataacgctgagaggacctgacctgatttgctataggtattgttctagggtagcccctggtatccattgaagactctgaccgtgagctctgcctgcattaatataactggaccaaaggaaacagaactttagttttatgaatgggtgtctctccaaacaatttttcctggctgagctttgttcattaacatttttcaatttctaaagaacaaataatctccatttctctttttatgtccggcccactctcctgatagatataacctccctcctgtttagttccatgaattgtactccagctgcccaaacctgagaaaaggaattaatgactcattctctctgttgagtgagggcttattccagctggctcgcgctattctgtgtgtatggattctgtcagcagggttgaaataagatgttaactggcagttattcattaatttacagcaagaacaatgacttgactctatgtcaaccatttctgaaacattttgactaacatttttcctgttgcttagaactgaacttaaaagctgggacaggcatatggaaagaagcaaggatccccagttatgctgattggaactaggactaatggttttaacacagaatgtttatgcatgtagaatgaaatacacacacacacacacacacacacacacacacatacacgcacatacaaggggtcatactttatgtttgcattttcctctaaaagtatccctaagagtatttgtggttagtactacatttttttcatcatagtttgtttaaaagataaagcagatattataattattttctttacaggtgggaatgagttaaacaataattaactgaacaaaagcaatgtccaggtactgcaaaactttacataaattactcctattcattttcacagcaaccctctgaagtaaatggtattatcccaacttacagatgtggaaactaatactaattaacttacctagaatcgaggtggcagagccaagacacgaattcaagtttctcttcctcaaatttaacattctttcttgtacaaatgtaaatgttctttaaaaatgaatacataatggcaggattcatatcaattttctgccagaattaccatgtttacctgaagtaaaatatgctcataaacaaagcagaaagtgcagctggtgcttacatctaggatgattaactggcatgtacagaatttttttttccttcaattgcaaagtgaatgcagtaaaattacagggcaatgggtttcttcccacacaagacaaggtgatctgaatgatatagaagagaaatgccacatgtggaaataatatatcaaggatttattatgtgtctgtggtcattcttaaggtcatttttgatgtctacacatttcagcatttgagaagttgtatattacatgcatacaaacccatattcaaatatacaattggctaaacaagtatttgttttaataaagtagtagtaataaaatatttatagcaaaggggacaagactcaggactgagaggaaaaactcaattaaaaaaaagacaacaatacttaaatctcttgatgcatctacttagcaatgtctacaatagcttttttaacactatcagaatatagagcataaattataatgtttatcctgcttttaaaggaaaatttttctcttatgcaatcatggtgggagaaaagaattcttaacgtgattatttgtctcatattttattttaggattctgttagtgtttttaggattctatcaatgcaaggtgtaagaacatgtcctggcagttgaaggaaaggctaaggaaaaagatgaaagagaagtgtcgcatcccttaccctccttttaaagaaatgctgaagttgctgagcagaaggtgccacagtcatgtcccttaatttatccctcaaccttttccagaagtaaagtgactacacctaagctcagacagtgacagtcgtgggagaaaagctttatagaaacagtgataggaataaaagtgtgtgcactgggatagatgtattttttaattacagaagtaactactaatctatataagagaggctccttccactctcagagcttccaacttaaccatctgtgaagagtaggtccttcaaaaccaactgtagcggcaaagttctgagatgatatttccagactcagcagataggaacaggcatgctaggtgagatatggcagggaatattagtcagggttctccagagggacagaaccaatttgtgtgtgtgcgtgtgtgtgtgtgtgtgtgtgtgtgtgtgtgtgtgtgtgtgtgtgacagagacagacagaaagagagtgctttagtttaaggaattggctcacaattatggagactggcaaatctaaaatcttcaggctgggttggcagtctagagactcaggaaaagctgatgttgcagtttaagttcataagatttctgttgtcagaattctctcttgtttggggagaggtcagtcttttgttctattcagatcttcaaccgattgaatcagccccactcaccttatggaggacaatttgcttgactcgaagttcattgatttaaatgtaaatcttgtctgaaaacaccctcctagaaatattcagaataacgtttgacaaaatatccagggaccagggaccatggcccagccaagttgacacactgaactgaccattacaagtctagttggcacccatatacatctccttaagccattcttaatctccaaatgtggtcacattctgaggaactggtggttagagcttcaacatatgcattttgaggagatacagtgtagtccacatcatggaggtagccctagaatttttttgtttccattcctattggcagagacaattgaggaaaagggaaagttccctttcatttattttactctcctgcacatctaatctttaaggagagaatagaatgagagttggggcacaaaacaaggattgaagggcagctgacttgagtccacgtagccccagaacaaagcaaaggaacattagattagtggggtagtagagattaaagaagtaaacagaattgaaactggcagaagatagggtcattgtagagtggaaaaacatatctgaaacatggttgttaagtcataagctaatatttggaaagacagactccacttacttttttccaatagatatatatttactaaaatcttgggaaagctaagcttatgatcaggtgtaaccaggccatatcccttgggtcccaaagtcaataagcagggagagcttggtgtttaagtccttaggaatgggtcatgccactcagaaaagagaagagatgtttcgatctgtggattgttatcatctgcaacccaggaggctctttgattcttcatatcacgttatttttacctgaggattgtagataccctacagtcttaaagcctctggccaatctgccttggaaccacaggatacattaggcaaggtctggggctggctttgacaaaggacacagtattgctggcagaagaaatcactcttaaagggaatatagatgctactgtgagagactgatcaactaattaagatcttgttgaagattctcaaattgagtttgagcttgttgacaaaaaccaggcttaggcagagggatgatgatcctgagagcatcctatctccatcaataggagtatgttttcaacctagtggtttttttttttaatttttattttaggttccagggtacatatgcagatttgttatataggtaaactaatgtcataggggtttgtaatacaggttacttcatcacccagggattaagcctgttacccaataggtattttttctgatcctctccctcctcctaccctccaccctccaccctcaagtaggccccagtgtctctttttcacctctatgtgtccatgagttttcatcctttagctcccgcttattagtgagaacatgtagtatttggttttctgttcatgtgtcagtttgctaaggatgttggcctccattcttgccatgaaaaacaacaggaaaataaagcactacccttgagcatgcctctagaacttgaggttcaagaacaacagaagagtggcagaaaactatatcttaaatatattctttatcttttgtcagtcctcaatctggcaagaacattgctgctacctgacctcatagacatgcatttgaactcctacttttagtatctgctctaagatctgatttaagaacagatagtagaatagaataagcttggttctctaggtatcaattttcccaaatttcacagtagttctatgtacagtcacattgtatattataaaatatatgtttaactgtcacatgcaagtatatttcagtttttaaaagctcaaggtgcatgctgatagtcactataaataaataaatacatatgtcaacatctccctatccccaattcctccctcatcaaaaactaaataaagggcaaatgaataaataaataaaaatgtttaaactgctgaccttcctgtcaacaaaggtgatgtgagttacaagaatctgttttctagctggagatgtgggcgcagtcatgagtatgcctccaccattaacagcactaaacccaacgtactcacaaacaacagctgcatgaaaaggccaagcttagtatcatgtgtaatttatgagagcttgttaaaacacatacatgcacacaaagttgaatgaataataccaggtgatggttaggaaacagaaaattcctgaagcatctcttctttttaatgaagtatcaaaaatactgttttattaaaatcgggagaaaaaaggctttaggccaagtgtgttgggttggccttgcaactctacttcggttacaaatttaaaggccaaagagttagagattgtgtatatgggtatgtgtgttgcaggttggggtgtgggacatatcaatacaataggtaaaatgaatggtggattgtgtctgggataatgtggcatattttatctcaaatcccaaccttatctcccaataggagatttggatcatgagcaagatttggcttaggctagttttcaattcccaggattccagctccttcatagcaccacccttatgcttactaatcccttcatctttaagacacctggataatgagctatctgcatggttggaaatagtctgggtttgttctaaattttacattagataacaggtcagcaacaaaataatgggagggggaaattagaaaacattaagtcttatttcatgtcatgtgatacagtatatatgtatttttttaataaaagaaagtgacatatattgtagttcaattggatatttacatttcatgtagaccataatggtagcggtaattatagaaatcttagcaactttcaaaggaaatttttcccagcaagatgactgacaaaatttttgaaagtaatagagagaaactgaggcataaaatttacctgaaagcagtcctgtttaaattggacaaaataattaccttttcttacatccctcttttagagttttcctaatatcatttaatacatagatagtactagaaagaaaaagacattttaaattaagaccaatgtgaagcattatacccatttagtatcattttgcccattacccttatagaaactaaaaatagaatgagtgctcagagtttgtactgtaactgcctgccacttacatgggataactatttttagttccatcgtccttattaaaggctttcattatgagttcatttatggaaatgttatctcacagagttttttttggagacttttctgagatctcaaaatgaggtctcagaaacatgattagaacatagtcatttagtttcccagcaaatgctgatcctttccaggaaagttctataaataaggaaccaaagctggttgtcagtaatttgaagtagctgggttggaccgtgaatattaatatgtaaattatagcttgtgccatctatacacaaccaggattgtatgcatatcttcccatggtttattttaagtctgaatttgcatacaaacactggtctaattgagtttttaaaaaaaattcttaagagatgccatgtgttacttaaagatgttttgttttgaaactttgtgataggtaagatccactaatgtttgtaaaatttaccatttgtaggaaatattctattctcagtaattcctggtgaaagtggtaggtgggttagagatcataaaatccagtcttcacgggaccaagctggaacatggctgggtagctggtggggtagtgacagccctgcttcaaggagagatcagaaatgagggatgagactgagtgcaaagtcaaggtcaacacaggctaatcttggcttttggctacttttctgtaaagagtaatgtttctctatttgaaggagtgattttaattcagaagtatattggaaaagtgaaagaattcctagagaaaagttaatcccagacaagatagtgaatgacatatagtttattatccagtgacctttagcacaacaactacacatatgcgcaagcgtaactgctgggctgctctggagttcgccagaaaccccttgcccttagtttgaaggagggaaagaaatatctgtaattattgctctatatcctttgcttttgacataattgattctctggcatttaaaatttatatccactcgcccataggattcttttaactctttcattgtttatttccttgtataagaacaggtctgctagtcagagagaatgttgagtatctttcataatccttgtctttatgggaccaaacatttctgccttgtgctagaaagatttttcagcccagccccaggcaaccaccattcattctactctctgcttctatgagtttgactattttagttacctcacaaatgcttttgctgcatttgttttgtattttaattacaccgtttgatggcaatgctagaaatttaggagctacagctcctctctaacatgaatgctatcttgtcaatgccttcagaagaataaagatcataattctttcttttacattgtgatttctataagaatagtttcctatcttcctggatctagatggaagatattaactttcagactaactgttcactggacaatttttctttcattattcctaaggtctttattgtacatatgatggtgtctccaatagttaaatatgcctctaactacaacatataatttaaactcatacctcacctgggattatattgatgatttttggttcaactatttctcaaatttgagatgctattcagaatttaagtgaggtctaataccataggcagggattagaagtccaggccagaagtctgaagtcatcagcttgggttctgttgatgtgaagtgaattggatcacacagagatagacatggccacagtcaggtgtgatacttgatgtgcctatgctttgcctcttagccagttcttagtcattccatgcaccgtgctccttagtagaagagagaacccttcaggtagacttctgtgaaatcctcacaaggcacagaaatttaatggcatttctgagagtcacaagggttctgtgaagtagaaattatgctctcattacattagcttaatgctgagtatattgggactcttgtaaatggacattttgttcatggatattttgttttagcaatttaaagaatgttaactagcttaatattttagagtgaacattttaaagtgataaagaaaaataagaaactttcttatctcaattaaaaatatatatgtatttttggtccacacaaatcacatcacccaaataattcagagcactttgctagaaaaggcaagacaaggtgtttctgagagtgtctccgcatttagatagactatttagttccatacttagagatcatccactagggtttctttgagcttggtgaagaatattcagcaacttgcctaagctctgggaatgtgagcatcagttatgaatataggtcatctcagtttgtgcacagcacactttctgtcagtccaatataaacttgtatgagtagatctgtttattgtgataactacaacttatattaacttgttgacatgctttttctaacttattttcttgggtctgcatttttcaaagatcaaaatttctgcatcttcagcacaagtagattgaagaacacataatacggatagtgattaggaacattcaggcatggggaacgggtgacatattgtttactgtgtttaaaagatgtgttataaatttcacttagtcaaactaacttgatgaaatcaagatagcctatgaggaagaataagctctgcaacttacatttttatatgggaagaaataatgagtcagtcttcttgaagttttttacattattatagtaagaacatttaagatgagatatacccttttaacactttacattttaagtgttcaatatagcattgttaactctagataggacgtttcatagaagatcttagcatctgacgtaactgaaactacatgcatcgaatagcatctccccatttctcccacttcccagccccaggcaaccaccattcattttactctctgcttctgtgagtttgactattttacatacctcattgataatggtttggatgtttgtcctctccaaatcgcatgtagaaacatgattcccattgttggagatggggtctaatgggaggagattggatcgtgggggcagatccctcatgaatggcttagtaccatctgcttggtgataagtaagtttttgctctgagttcatgtgagatctggttgtttaaaagtgtgtagcacctccccaaccgatctcttccccttttgccttccaccatgattatgagcttcctgaggccctcactagaaatagatgctggagccgtggtggtacagcatgcaggactgtgaatcaattaaacctcttttatttcttaaattacccagcctcaggtatttcttttctttctttttttttttttttttgagatggactgtcactctgtcactcaggctggagtggagtggctcactgcaaccttcgcctcccgggttcaagcaattcttctgcctctgcctcctgagtagctgggactacaggtgcgtgtgcccacgcccagctaatttttgtatttttggtagagacagggtttcaccatattagccaggctgctcttgaacttctgaccttgtgatctgcccgcctcaggctcccaaagtgctgggattacaggcgtgaggcgctgcgcctaaccatatttctttatagtaatgcaaatggcctaacacacttatgtaagtgaaatcatgcagcatttgtcgttcttgactgggttatttcctttagtgtgatgtcttccaggcacatccacattgtcgcatataatgaagttttaataactgttctaagacttagctgaagtcaaatggaatgcttctggtacttccctcatagcttatctcctggccttgactatggccatttcctattcccaccctgctctccaaggtggtattctagccatccttcaaggtcctgtgcgaataccatctcctctaggaaggcttcctttggtttcaaggcagagttcaatcgtaccccatctgaaaaccaatgacactttggagtacctcatgatagcccttcacaaacccctttaatgtgactgtgtgtgtatcgtctctctacagtgagaataaaagctccaaagccaggaactatatcttcctcacttcctcattctccacgggaccttgcgtttaataatttaacgaaaattcaacaagtatctgttgatggataaataatcatggaaaataaattccagacgaggtcagataaagtggattatatgggtaaacattgtggaaagtaagcttttcgaaatattgtaactggtgaaaagttgtccatcatagttaatgggctacctgagcaaatacctttcctgagctttttcttgaattcatagaaacttgggtctgaaagaaaacttacaagtcatcactttttttttttttttgagacaaagtctcagtctgttgccaggctggagtgcagtggtgcgatctgggctcattgcaacctccgcctcctgggttcaagcgatttttctgcctcagccttctgagtacctgggactacaggtgcacgccaccatgcccagctaatttttttgtatttttagtagagatggggtttcaccacgttggccaggatggtctcaatctcttgacctcatgatcctcctgcctcggcgtccaaaagtgctgggattacaggcgtgagccactgcgcctggcccaggtcatcacgtttagcctctcagtcctctatgttagaaaacagtaatccaaaaaaaaatgatttctttaatgctagatagtggctgaagtaggactagaactcaagtattttaaagcctgcttcacatttcttgttactaagctgcactgcctcccacacatggcctattttggtctctaaactgtcatgaaaacagatgctaggtccctgtcaaaatgtttgtgtatttctgggtgtgaaaaggtatgtgtgtgtatgtgtgtgtttgtgtctgtgctcatgtgcatggatccctggtggaggggagagaaaggcaatttgtagctgcagacttctgtcattgcacgcagcgcactctgccatggtgagttcatactccacagcaacagaacagctgctgcaaagggttggtgtgctattttcatcttgggtgtgtgttttgcatcaggctcttggcaatggcaagagtaaacctctgtaaagaacaccttcttaaccttttactgttacccacacttagtcaacagaaacaatatgtttaacaggagtttttcctgctggacagttaaatatgcagttcttgcatatgaaacatgaatattttgttcccttctgtggaatagcaataataataacactactagtaataccagctaaaatattttaagtgcttatttcaaacggaaaattttttttttaaatgccagattttttctctctagggcaacagtcatcttgtataactttgaattcacactaaaatcctctgtagcaacataaagatagaaaaatcctcctttcagcaatatggcactgtgtgcaatgagcaaatgcaatgatatagaaggaagattgagtttaagagtatcagcagcaaagtgacagaaacgctcatacattaaaaactaaaaattagacttaattggttataggtgggaggagcctattacttttggtgaggacacatataggtgggaaaaagagaaagaaaaaaagaacatatctatgacaggaagcttcacagatttcattttcataatactttttgagactaaaggaaatagaacattttctgtcatatgtgttccaagtaatgtcattctgtttctcatttgtcttttgacctggctgtataatgtatgtggtgaaacagaactcctttattattaattttttagtggctacattagtaactcttttcctgacaattatgaggaagctcttgtatattgacaagagcataaatctatcaacagccaggttcatacatagagtccacctcttaaaggttataagatactgggcaagtcatttcatttctttaaacctgtttcctcatctgtgaaatgctgatagaatcataccttacatagatcagatgtaaataaaatagtcgtaagttagcgctcaggaaattacagtattctgtgcaaatcttattaactttgattttgtttcatatattgataaatttacatctagctgaaaatacattgaatcattgtcatggactaaattttaatatgtcttaggaaaagagtccgggttgaagtgcagtggtgcgacgttggccccctgcagcctccgcctcacaggttcaagtgattctcctgcctcagcctcccgagaagctgggattataggtgcatgccatcagacccagctaatttttgtatttttagtagagatggggttttatcatgttgaccaggttgttctcgaactcttgacctcaggtgttctgccggcctcagcctcccaaagtgctgagattacaggcgtgagccactgcaccggtccaggacaagaatatttttgaaactatgagctttatcatcagagacattaaaacttcagaaggaaagagacctttgagttcttctgagccaactccttccttttatcactaccaacaacatgaagtcagagggaaatgacttgcctacagtaagatgagcaggaagaagtgaaagcagattaggggctgaggtcttcttagtttatgtccagagatctttccacttcacccaccatactctacattagtcactaccacgaccatcatcatcattatgaccaaaattaaatctaaacaacttttcaccaagtaattccattttcatgctaaagatcaggcagttcacttccatttcctcttttgtcagatgaaggaattgggccgggcgcggtggctcacacctgtaatcccagaactctgggaggccgaggtgggcggatcacgaggtcaggagatcgagaccatcctggctaacacggtgaaacctgtctctactaaaaatacaaaaaattagccaggcatagtggcgggtgcctgtagtcccagctactcaggtggctgaggcaggagaatggcgtgaacccgggaggcagagcttgcagtgagctgagatcacgccactgcactccagcctaggcgacagagcgagacttggtctcaaaaaaaaaaaaaaagaagtaattggatgaggtgatttatgtaattcctacaacctctcagtgctaacaaagcaacattcaatgacatttacaatgatcatggtggcaagttgggagagagaaagggcatttctgaagtaataataaaatgagtaaaataagatggtagtgccgtgtgttgatattgtgaactttacatttttactttctctcatccaaatcacagtaaaggagctgaaataagattttagttaattggtagccacacatgcccacaggctggtatgccaggctttgtttttctcacactgctgtaccatatccaaggccagagtgaatttcaggtgtcatgggctctacaagggcaagactggagtaggagctaaagtcaagttcccattggagaggattgaccaactgatagaggatggaaacgaagagccaaaggggagaagggacaggaagtactgagatctgaaagcaaattgcctaacatttagaggtgagaatgtgaaatgaggccaaccagggctggtgcagagccagaacaagggaggtcagaaagctaaggtgaaattctggaaataaatatgatgagagcttattgtaggggagacttttgggggactatggcctcgatctgatgtgtctgcttgtccccagtgctccttcaaacatgctccttgaagcttcatgcctgccttagacagccagagattgaaaatgaacatatattttgaaaacaaagacactaagaccattcacaaaaattcaagaagtaattttttaaaaaaaatacagtaacatttaaaaaatatatgttatttcacaacatatgtaaaaccattaaaatacattgacatcccaacacatattttggggtgtcaaaaaagaaatatggcagggtgcagtggctcgtggctgtaatcccagcactctgggaagctgaagcaagaggatcgcttgagcccagttctagactaacctgggcaacatggcaaaaccttgtctctacaaaaaatagaaaaacttagctgggcctggtggtgtgtgcttgtagtaacagctgctcaagaggctgaggcaagaggattgcttgagcccaagagtttaaggctgcagtaaactaagctatgatcatgacactgcattccagcctgggtgacagagcaagaccctgtctcaaaaaaaaaaaaaaaaaagaaaaagaaaaaaaatagaaatagtatatgttgataggaagcttagtgaagaacattaaaaagatttgcttgagctcttggttgccatggcagagctgcgggagctccgggctcagaagatggtggactctataaagaagcctcttgagggagttacatctgggagttgtaatttttcatgttcagcaccagatgttttgaggacaggcaggtgtttatgcagcaggtgtggcagtgcacagaggactgccacatgcctctggctcaagaccaagccttgaggaccacggagataaagaagttccaatgccacctgtcccagtgcaccatgcattgcaacgacaaagccagagattcactagatgcagggagtgaggatctttaggcgaagtgacagctggacagttgtgtgaccaagtgttgatcacatgcatgtcaccctgacaatgaccaaggagatgaaggagatgttctcatccactgggatacgtatcttggccagtaaccatcagggctgaggacaggaatctgtttaacaaaaggaaggagaattttagtctttaaggatgtggggaaaagaaagagagatcagactgttattgtgtctatgtagaaagaagtagacgtgagagactccattttgttttgtactaagaaaaattcttctgccttgagatgctgttaatctgtaaccctagccccaaccgtgtgctcgcagagacatgtgctgtgttgactcaaagtttaatggatttagggctatgcaggatgtgcatagcccgagaaacacccacaggtgtggaggggcaggccaccccttcaaaggcaagtgtcatgaatgaagaaattaaggatagcaacaagtataaggcctatgtcacttgcctttggacaaaggtccctttatatttcaatcctggaaagtgaaatgaaaaaactagtgctaaaattaggatcaaagatagtacaggaaagtgtatttaagtcaaaatttcatgtggcaagtgcttctcctggcagcaggaatatccttgtaccaagccagagccttccaaggtacaagttctttttcactatataggaaccgacagactggcagggtcctctaatctggctgtgatctggtggagtttgaggagaggtgtttctgtttggtgtgaggctcctgtttaccagaagtgttgctgcaccattttccataaacaataaaacaaaatccatgagataattcatttagtggggcaaaaaacgtttgttggtctttgttttgcttggttttgttttatatgtacaagggcataaagttgacttaggatgtggagttgggaaggagagtagtttggataagatctttgaaaggttgcttatgggtatcctttcctggtcatcaagatgtggatgtacctctcttgaaattcttactcactgcatctttcagcctggatatgatgcaaaaacatgagcggtgacttcacatttaggtttgaaagcagagcttccctcttattggctgatggttcctgaggatgtctgcagcagagtggcaggacaatctagcagaaatattttccacttaaagagatagggggtttgtgtttggatttggttctgatatatacctgtatccaggaataaacagtgaaagaggaaccgttggctacataattatgagagttgtgaagtgctgaatttggaaaaacccggctttcatagaacagaatggaatgaaagcccaaacccagcattgcttacgtagcccctgaattaacagaaccctattgagataataccctgccaacagcaaggtcaaagaagaagaagtaagcgacttggctaggatgagctgtgacttccttagagcaaaggaggggcagccccattaccaaataccacttttgcccaggcttttgtgacatgcagtgctcctgcccagcatggcaccttattttgacaaggaccttgttatctttccaccaagttatcacttgaaatgataatatagcttgtatgttgttcccaagctgtcgtatattttcctggttgtttgaatttaacaatgagaataataaggtttaatactcctccctaagaaaagatttgcttatttcccaatttgaaattactttgctaagagggatataatgagttctatagtgaaacaagtatgtgttttatcctaatttctgaaattattcctgaaaattcaagtccattgtttgtctcccaccctatcctttggttctgtcacctcagaactaacaccttgacaaagtgtttcttttttgtccttctaccctccccgcaaaagtttattttttaataaatcgtttctggcaccaacccaaaccacaattacttaaaaagaaaaaaaaaatagcccaggattccatttacttataaacttgctttctgaactttatttttaatttcagcatttttttttttttttttgagatggggtctcgctctgtcgccaggctggagtgcactggcgtgatctcggctcactgcaacctctgtctccctggttcaagcgattctcctgccttagcctcccaagtagctgggattacaggcacacgccatcatgcccagctaatttttgtatttttagtagagacagggtttcaccatgttggccaggatggtcttaatctcctgacctcgtgatccacctgcctccgcctcccaaagtgctgggattacaggcgtgagcctctgcgccgtgccattttcagcattttttgatgtcagttatgggttcattgttttcaatataagataacatgagcagagactgtgtaggtgggattgagagtgaagactgggctcattgacaacctctcatcatctcgtcaagcagagtttcccatatcctctgaatctatgcctgtgtaactccaaatattagcataaatataaaaaattcatccatttggatattttatctacatgatattaattattgaaatgaatctaaattcttttcacaatgattttggcaagaagcactggcttggagtaaagtcagaaaacatgacacatagcaaacatttatagaccatctttttaattgtccatatgaaaagaataacatctagctgattagatgtattttaggggaatttgggaaagaataaataactctatgccttatgactgtcctgatatctgctatttatatctctgttctgggcaaagaacaccaaaaccgaatgaattaattgttgtgcatgctattatgtcttggatatagtaatatcaacatttatacaaatatcgactcagtacagataaaaaatagaaagtaattttcatcttttgtttttaaagaaggaaaaatattattatagaccctgaaccttcttcttcactgaatgggaggaaataaaagatatagaagcctgaggaatataaaataataagaaggtaatgtgatagaaagtggctgaggctatgtagtttgaatctccagaaaaggcctctctgagaaggagactttgagcttggagatctgagtaacaagaagaagccaaccatgcagggaacagtatttcaggcagagggaatagcaagcacaaatgctcaggtgtgaatgattccagctgtggtagccagagtctatgatgcaagggctaggaggggtggtagtgaaaggagtttgcattgtatttgaacaccaggaggaaaccaacacgtagcattaagcaaaaagtggtatgatatgatttatagtttcaaaagattacaatggttgttctgtaagaagataccagaagaagcaaggagaccagatgtggctattttaaaaatttttcgttgatacataataactatacatatttatgggatacatgtgatattttgatatacacatacaatgtgtaatgatcaaatcacacacttaacatatctgtcacctcaaacattatcatttctttgtgttgggaacatttcagatctgttcttctagctatctggaaatataaaatatattattgttaattatatgtcttaggctgtttgtgttgttataaaattaatttataaagaaaaatatttatttggttcacgtttgtgatgtctggaaaaattcaaaattgggcatctgtatttggtgaaggccacaggccacttcccctcatggaggaaggtatagagagcccgtatgtgcagagattacatggtgagagaggaaacaagaagggaacaggaggaaactagcagaggaagaactcactcttagtttctgcaagaggaattaactcactcccgatctccccactccctgggtaaggcattaatctatttatgaaggtttcacatctatgacccaaacaccttccattaagccccaccttcaacactgggaatcaaatttcaacatgaggtgtatagaggcaaacatccaaactgtagcactatagtcactcgaatgtgctgttgcacactaggacttatttattccttctatctaactgtatgtttttgcacattaaccaaactgtcttcattcctcactccctcatccttccctgccttcagtactatatttctactctttatcttcataagattcacttttcagcttccacatatgaatgagaacatgcaatatttgtgcttttgtgtcaggcttatttcatgtaacataatgacctccaattccatctatgttgctgcaaatgacaggatttcattctttcttgtggctaaataatattctgttgtacacatttaccacattttctttatccatttactcattgatggatatttaggttactttcatatactgttattgtgattagtgcaacaataaacataggtgtgaagttatccctttgatgtgcttttttccttttctttggatcagtccccaaattgagattgctggatcatatggtagttctatttttagttctttgaggagtctccagactgttttccttaatggctatgcaaatttccattcaacagcgtataaaagttccattttctcggcatctttgtcagcatttgtaaaattttttttgtctttttgataataaccatactaactagggtaagataatacctcattgtggttttgatttgcatttcccaaataattccaggaaagagatgacattgggttagattagaggggaaccaggggatgagtacaaaagatgaggagaagttagaatctattttagaaacagagtcaacagaactcaccaaatagatgcagttaaggaagcaaggaaagtaactaagggtaacacctgtttgtggcttaagtaactgaataaatgggggtaagacaatatgagacagcaaatatttggggaatattttatgtggtatttttggaaaaaggtgaaaatgttattaatttaaaatctattatgcttccaattgaagatgaaaagaattgcctagaaaagtctggaactcaaggaagaggtcagggctggagatataaatttagaagacattggaatataggtttaattaaagccagttggccagatgagatcctccatgtaaagattatagatagagaagataagagggatcaaaaccaagccttggggaattccagtattaagagttgccagagaaagaaaccaacaaagacagaaaaagcaatcagtacggtgggaagaaaccaagagggcctgatgtcataaaggcatttcaggctagagaaagtgtttaattaaagagaagaaagaagaacttccattgcatttggcaatggaggtcacatttgtgatctggacaggatagttgcagagagtaatgagtttaagttgtacatcaaagtaaaagacacacactctggccaaaggaacagccacagaaggctggcatatgatgtgcctggcacgcaagttttggttttgtcctttggattctcctgttagatatatgtggctgttaaacaaggtctcagaaataacggcttggtaatggatgattctgacaggatacaagaaatcccagagtgttaagctcatcaggtttattgttagttcttgtttcctggaagtgtttgaagccttgactctattaggtgaaatatgactccattaaattgtctgacattttaatactttaatttagtgccagggaccacttttagtgtaaaatgtttcacagagggttctattttaaactgcctggcttttgtaactctcagttttttcttccaagcctttcaccagtgtaaccatcccaaatttgcatcttgtctgatgctaactgaggaagaagggcacctggagtttgaccagcaggaacaaaacatgttaaaattgttgcagaagatgatgaggtaaaaacacatagcactggggcacaaaaccctggagcctggagcctgttgcaggtgtttagcactgaccttccacataaccatgggtagccataggacctctttaaccctcagttttcacatttgtaaaggcagtgagcaggaattgcattttaaatatacaattgttgtcactggtagcatctatctggggccagtggcacaggagtaaagagaatttacccagacagttgtgaggaaagaaagccatattgattagagaaagcatgaaaatacgttgcaagggtgcaatgggcaaatcagcaagataggagctgactgcaaggagacaaaggcttgctggggattttatgggatggcgcttgtgctggggagggctatgtgctttactgataatgccaaagttgtagtaagctaacttgcagttttctattgtctgagggtctgatagtaagttgggcatgagaagattgttagtaatttgcacagaagggctatgtgtcctggaccatgaagaaaggcagacttgtagcttatctgctttttctttttggtttctcctgctcccaacaacctgactccttttctctaattaggacttcacaagtgtggcatctcatgtattctaaagtatatggtgaccatctaaggaagttggtttgaatgtgcaggtctagcaaagaacatgccctggatataaaacctaggaatcaccatctgatcgaagatggagatgaatgacttcaccctagggcaagaaggacttaagaagaataggaaggatggcaggaatggaggaaaacattttggatggaaagatgagacactgaaacaatttgaagattggaaggtgagagtctgaggtccaaagctttacaccagttgttgaagaaccttgatcacaggccagccaggacctcaaaggctcaagagaaatgatgacaaggtttgcttggcttatttagagctgggctatagagcgggaagattgtggttaaatcttagcagaactgataaaaagcatgaagttgtactgagagatttttcaactgtacatagttgcagaaagaaacaacctgctaccatagtaaatatttgtgttagaactcagtggatgaaggtggaggggggaacatggactggaggggctaacagagtatatgtagtaggcaagtgggattggagtacaagggaaggatagctgggggtgacgaggttgagtctgtgaatgagaagggcttaggtcaatttctctttctacccttcttccagctcttctcctccctctttattcctcccctcttccccttccccctcttttcctccttccctctgcctcctctcttcttcctcctttctgcctttactttatcctttaaagtcttaaaaaacaaaacaaaacaaaacaaaacaaaaactgtgatgatagaacccaaagtgtactgagagatttcttaactgtgggcaggattgttaagtggtagtaaactcaagacaacatttatattgcactttacaatacataaagcactttcacgtaattaactcctttgatttgatcatcacaacaatgcctgaggctaatagttataaaccttgttactgatgaagaagctgaaattcttatcagttaaatgtgttgctttgggcttagtaattggcagagcaagccaagtctgtctccagaccccgtggtcttctggttccaaattccatgctcttctcattatacagcacaatactttttttttttataaaatgggaaagtctttttttttaatgtatttacagacagttcatggctttagacacacacacaataaagccatttttattaaatataagaaagtggagcaaatttgcgtccttttttattttctaatgacaatgctaaaagctaaaaggcaattggccattgacgggagaacaaaggaacctgaataattgataaaatgtattctaaatccagaaactgtcaaagtaggcgatgtcagagatgctgcagttgcttggttgttcgtgatatctgatgacgctgcatctcagtcataaaaacttcagggaatctgaaagaaataataatgcgccatggtattttgagcttatcaccacaagaaatactctgtaattgcatcaaatgattataaatggcatattttagggacataataagcaatgcaaaggacaggtctgcttattagtgccaaaatttgtatttattcccatattgctttttttttcctaggcattttccggcatctcatttctgactattaaattataccccaaatagaatatgtaactacatgtaaccaacctattttggtctacattaagtgcagcagcataaatagaaactgaaaataatcagaagcatttagaatttcgtttttattcatctgatttacttggccttttgtctgggatgtaagtgattctgagcccctctccagactcacactttccccaggtttcagtacctggggctcacaatctcagtggaagagtttcaaggcaatcttccactcaggactccttatgccttgcatgcacacaaagcagcgttgctcaaaacataggaaacaactatgaggaataaaaaggaaaagcttgttccttaaagaacgagaaggaggccagcagtctttttcataccttcttgtttatagaaagcagatttttttttttttttttttttagtaaaagcatatttggagcaggaaagaaatatgacctagactgtgttgttttcttttattgtatctacaaatagtttagctgaagtgagcttttcagttattgattttaaatcataagtttaattcgtcatcaaggcaacaacaaatgtgatgtttggggcagatgcaaagttgaagtatgtctaaagaaatagcacgctagttgcgtttaatgtggaaggtaaattataacaaaacaaactaaaaccccacaaactctaaagattttcccttatagttatagaaattaggaaatgccctattgtgcatctttccttcccaactgtaccgagattttgaattttttataatttgtactaatatgtaactagaccagatataatctgttgaggctttcttgtgatggaaagcaggtgaaatcaattttcagttgaaatatgcttttcagttcactatatgatgtttgtagggcttttttagagaagggctttgcatttagacttgagcagtttagcaggcttcgtcggagggtaaatctggctgctggatctagttggaatgttttcctttcataagaagagttggagataaagtgattcttgctttcaaatacacttttaacaatacaaaagaataattgaagactttttcttttgagacagagtctcactctgttgcccaggatggaatgcagcggaacaatttcgactcattgtagcctcgacctctcaggctcaggtgatcctcctacctcagcctcccaagtagctgggactacaggcgtgtgccaccacatctggctaatttttgtatgttttgtagagttggggttttgctatgttgcccaggctggtcttgaactcctgggctcaagctttcctccctccttggcatcccagagtgctgggattacaggtgtaagccactgatcccagcctaattgaagacttttgtatgttaggtgctaagtaatacaaaagtaaaagtgccactgtttctgtcctcaaggaatttacagtctggagaaggagacaaaatataaacaaacacactgataagtaaatgattacaaattgtgccaagtgccatgatagaaaagaattgatgtgcattatctctgtgctccctgttaggggcacctgacccatcaggaaggccattgatcatacccatcagtcttccaggtataccaaggacattggattgaatgtcacaggacctggattcaagccctgccatcgaatccagctgggtgtttctgggcttcagtttctgtatattcagtaatagtatcgaatattagtgggagtaatagcattgaatgccctccatgctcactggaacttcatccacaattacaatgtcttggtggctttctaagtttttttttaatttttaatttctaatttttgtaggtacacagtaggtgtctatatttatggggtatgtgagatattttgataaaggcatgcaatgcataataatcacatcatggaaaatggggtatccatctcctcaagcatttatcctttgtgttacaaacaattcaattatgttttttaagttattttaaaatgtacaaatacattattttggctatagtcacactgtcatgctattaaatgctaggtcttctaattattttttgtaccctttaaccatctctacctctccctgatcccccagtacccttcctatcctctggtaaccatccttccattctctatctccatgggttcagttgttttgatttttacattcagtaaatgagtaagaatacacaatgtttgtctttctgttcctggcttatttcacttaacatgatgaccacagttccatccatattgttgcaaataacaggatctcattgttttcatgaataaatagtactccattgtttatatgtaccacaatttctttgtccattcatgtgttgatggatacttaggttgcttccaaatattggctattgtgaacagtgctgcaacaaacatggatgtgcaggtatctctttgacatgctgatttcctttcttttgggaatatacccagcagtgggattgctggatcatatggtagctctgtatttagttttttggggaaatcccaaactgctcttcattgtggttgtactcatttacattcctagtggctttctagaacctcctcttggggagccatatggaaattttgctgaaggtgagaatatggcagcttgatgcaatgcagtgttttttcaagcttcttaatttgttgttgttttgagacctaagtctcaggagagatgcaccgaggctgctgcagagctgtagagaggagatgaggagcgagcaaaggaggtagggttggaggcgcagggcatctcccaccctgacttgtctcagacatgcccctcctttatctgttgattataccaggcttacagggaggattttatccaaagaattcacctgctaaaagaggaaaacattttaaaattactgttgtagtccaaatagtctctggaactagacgattctggattccaaatatagacatgtggtgcttaacgacagggatactttgataaatgcattattagactattttgtacttgtgtgaacatcacagagtgcacttacatgaaccctgatggcaaaacatactacagacatactacatactaggcttatgtggtctagcctcttactcctaggctacaaatctgtacggcatgttactgtacttaatactgtaggcaattgttaatacagtggtatttgtttatctaaactatcaaaacctagaaaaggcacagtaaaatatggtataaaagattttatttaaagtacacctatataaggcacttcccatgaatggagcttgcaggactgcgtgttgctctgggtgggtcagtgagtgagtggtgagagagtgtgaaggcctaagacattactgtacactactgtagactttataaacactatatttaggctacctatatttatagaaaaatcttctttcttcaataataaattaatgttagcttactgtaactttctgacttaataaatgttttaatttttcaaaactttttgactctttttcaataatagcttgaaatacaaacacattgtacagctgtataaaaataatttctttttatcctcattctacaaacttttttgaatttttaaattttttaatataatttttaaaattttgttaaaaacaaagacacaaacacacacattagcctaggcccacacagggtcaggattgtcagtatcactgtcttccacctccacatcttgtcctactggaaggtcttcagggtaaataacaagcacgaagctgtcatctcctataacaatgccttcttctggaattcctcctgaaggacctgcctgaggctgtttcacagttaactttttttttttttaataaaaaatacatgtagaagcagtacactctaaaataacaataaaagtgcagtatagtaaatacataagcgaataacagtttttctaatcattatcaggtaatatgtactccatataattgcatgtgctagactcatacaagtggtagtgcagtaggtatgtttacgctagcatcaccgcagacacatgagtaatactgtgacattatgagggctatgatgtcactaagtgatagaaattttttagctctgttataaccttataggtccacatcatataggcaatccatcagtgaccaaaatgtcattatgtagagcatgactgtattagttcgttttcacgctgctgataaagatatacctgacactgggcaatttacaaaagaaagaggcttaatggactcacagttccgcatggctagagaggcctcacaatcatggcagaaggtggaaggcacctctcacatggcagcagacaagagaagagaacttgtgcagggaaactcccctttatgaaaccatcagatctcgtgagacttactcactatcacaagaatagcatggcaaagacccgccaccatgattcaattacctcccaccaggtgtctcccacaacacatgggaattgtgggagctacaattcaagatgagatttgggtggggacacagctaaaccatatcagtgactacagtactatagcagttgaatagttttttttaaatcccttgagtatcttatgatctataaaatggcagtcaagcctatcctgtggatatttgcaaggcttataaatattgtctggaagagaaagatgacttaggagtatattataactcttgatgtttttattatatttgtcattaatgtgcacaaattataaatgtattatcattaataataatttatttaaaaaagtgatgggatatcataaaacccttgggtgaattcaaacatggccactttgtatgacaaattacatgcttctatttctgttccacccagggtttcttttgagcagtggaaattcatctggaaacttaatgttatcccactatagagagccattcttgatgtgccactaattctgccaaataggctgacttgactactctcttaggatacagaattatatgaagaaaaatagagttgagaaggaaaaagtacaaacgttgtgtgtgcatataacaaacagatgactgctttagacatatttggtctgtaaacacctgtggaatcttgcctgtgtctctaatttttccagattttgctcatgggagagacacaatttgttctttgaatgtagccattatattttaacatacatgctgatttaatcatgctggtcaaaattttctttttatagcatccagacagcttgtgcatataactacatgcagttttattttgtggccaactggcaaccatatggaagtcagttaaaatgtattttgattatatgactctgtgcacataggcacatcatctcaggaaggctcaggtagcatagaggcaagtgaattcagcctgagattacagtaaagacatgaatctgatagtctggcatttctggactcacactgatttcttgaagaaaagcccatacagttggaatcagtgccttaaattaggtttcttaatatgatgagctcataaaatatgtgttgtcctgccttcttcagatgtgagagttgatgttacagagatctctttggtaatatgactattttaataaaatattcacaattaaaaatatatagaagaaagcagcaaggaaagactagaactaatgattagagttgttgaaaatgcatacataatttactccctttttaaaaaaaatggaactgggctattctgttgtacatagacttttgtcaaaatcaaattaagaatactttactcagttttctttttcttcctttattcatctctgtaaatatgattttaaaggcccttgaaaacaaaataattatcttattaaaatttagttacatgttgtgtttaaaatgctaaagttttggccagccgcagtggctcacgcctgtaatcccagtactttgcccgagatgggcagatcatgaggtcaggagttcaagaccagcctgaccaacatggtgaaaccctgtctctactaaaaatacaacaacaacaacaacaacaacaaattagccaggagtggtggtgcgtgcctgtaatcccagctactcaggaggctgaggcaggagtatcgcttgaacccaggaggcggaggtcgcagtgagccgagattgcgcaacagagtgtgactcagtcttaaaagaaaaaaaaaaattctgaaatttatcggagaaaacaattgggatctatttttagtctcaaatgtaggcatatacaaaaataatacatagtagttttctaagtactattagacatttgtttcccattttgccatttgctttcagtttacctgacatgaagataaaaatgatagctatttctcacttggcatttgaaagacaagagcaataagaaacccagcaaaactcctagagaattttcatggggaaaataagcatattgacattctttgacttttgtaaattgattttttggctccagctgctctaaagccattaagagttagagttaatcattcttgatttttttattgttagtcagttcccttattcataacactgaataatagcaatactactgagttttatttgtgttcacattcagtgctatgttaaaaaattcacaaagtaacatactgaaattcttgcaggtaactggtaaaatatgtagtctttagtagactgttgattgatattctagtaaaagagtaaatcttgtgaatttcagaggtggtcccaagatggtcttaaccctactgtgttaaaaaatatcagcatctttttcctataaagacaacctgaaggctcttttgaaatatgtataagtgcttctttttaaaaaacttattgatcaaatcagcttaattagctatgaaaggaatgatccttcacccctatgttaatgtctgtttacactgtgagtttgtaaaagcttctgatagagattgatgccatatctaataaattatcccactatatattcataaagtactatgattatatctatatgaatatatatataggtgaatgtagattcatatcaaaaattgaaacccagagaaaaaacttggaatttggtaggcagaaccatgaccctcctcaaagaagtcctcaccctcatccccgaaacctgtcagtatgctctgtaacatgattaagggcaattaacattgcaggtagaattaaagttactattttagtccatttgtgctgctataacaaaatgcctgagactgggtatgtataaagaacagaaatttgttttctgttctggagcctaggaagtccaagatcaaagtgccagcaggttccatcatctggtgagtactgcatcttcagaggggaggggaaaggaacagtatgttctcacctggcagaagaacaaaagagcaagctaccaaacactgccaagcctcttttatagaggccttaatcgcattcgtgagggagcagccctcatggcctaattacctcttaaaggctctatctcttaaaactactaggttggcaacacctgaatttaagagggggcataatcaaaccatattattactaatcagttgaccttaaaatagataatcctggatgatctcggtgggccccttgtaattacaagtttccttaaaagtggaagagggtgacacaagagaagtgagagtgacgtaatgcgaacaggactcaacacaccattgctgactttgaagaaggaggcctgaatttcaatagccacggaaggggacaacctttagaagctggaaatggcaaataatactacccaaaagccctcagaaaggagttcaaccctgacagtacctttattttagctctgtgcaacctgtttcagactgctgcagaaccgtaagataataaattcatgttgttttaaggcactacatttgtaataatttgtcaaggcagcaataaaaaaccaatgcagcaaaagacaataacgtctgtttaaccacacagtcacggaacatctattaactagcaacttattaaatacagcttactgctgcaacatctttggtgtaattaaaacatcctccatgaatcagagtgagaattatacttaagtgtctgccaattgccatgataatagaaaagcttatgatctctctactaagtaccttaggaagacaagggcccaatgatatgagcagtgtggtggaaccccaaacatcttcccactttcatgcacacatatcattcattctcctttttcccaaggttcgctgttagtatagaggcacaatagatcatgattagctctgggcatgttcacagtttagctgcctgagcagattaatttgagagtccaggaaaagcttattaaacagattatgagaactagacaagacttttgagaccatctgtccaaaactttggttttaccagtaagcaaattcagacccagcatcactcagctggtaggtggtaaaactgagaagagaatccatgtattttgttttttcctagttctgtgttgttgcactgcataatgaattccagccagaaccacacattcagttcctgactagtccacaattagaatcaccatcaagtcaaacacaagtgaggcattacatccaggaggtcatagttagttgtgtgtgtgttccctagatagattccctgaagctttctcatcaacaccaagaagctgaaggggaaaatgaaagttccccttcagttcccctcaattcaagagtaattgagaccaacatcattcatggatattaataatatgaccttttttaaagaatcaccaaatcattacatcataaagaacaatgatcttatattttactaggtttattagttgcagtctcagcctctaggttgctagaaagctctgggctcctttggatatggacatggccaaatctctttaactttctagttatggcactttaggcaaattcaacttctctgagtctaggttttctcctctgttcaatggaactgacaattctatgtcagagagctattgtaaggattaaaggaactaatatttgcaaaccccatactgttgcttggaataaaacaggtgctgaataaatggtagctatttgattgttagttttaaaaaatcttgctagaaatcattaagagtgtatttatctaagtgggggaaaagaaaaacctaagtaagacccttggatcttgaaagaaagaaaaagagagaaatgattgtcaacacaaacagaaatgcttgaggaacttcaagggctcaagagtcaaaggacaggctagaaaaaaatgtcagagaagaaagagctaagagaagaaagtcaaaggaaaggagagaaggggagaatggaaggagaactgagaaaccagcagtgtttttttaaaggtgataactgaagaaggtgagcagaggaagaaagaacacagtgagtaattgaaatcaccagttattttcttctgattcatctcttaaaggaaataccttctaagagagatctttgctcttttgtgtgctggtgaatgtaaggtgagaatctctcctttctttttctaatgatgaccctgaacaaggccgtgctcttcttttaaacatctcttctgtttgaagctctgttacaatagaatcaaatagggtctccttggtttatgtcactgatctaaggttgaatgatgtacttgacagatccttttgaactgccccatctgggaactgaaccaaagactggatcgccagtcatggtactcacaattacctttccctttccgcacagtccccacattcactacccgaaagtataaaatccatctcataagatgcagatgaagtagaatgatgcggtttcccaaacttgcctgattatacaaaagcccagaagcattgctgtctggagattcggattcttacctcaaggtgattcttatcattagaaagtgaaaggtacagaaatgaagaaactttcgagtaagcaacgtttcctaccaagggactgggtggttctgaatataacaccatctttctcctaacaatagaaggtgacattttgacaaataagcttaggattcgtattcttccctaaggtatcattttgctgagctatcattttttttctttctttttatttttgagacagagtctcactctgtcacccaggctggagtgccgcggtgtgctcttggctcactgcaacctctgcctcccgggttcaagcaattttcgttcctcagcttccagagttgctgggattacaggggcccgccagagtttctggctaatttttgtatttttagtagagacggggtttcactatgttggccaggctggtctcaaactcctgacctcaagtgatgagcttaccttggcctcccaaagtgctgggattacaggcatgagccactgctcccggacttgctgtaagctatctttttgccactcatgatgatgattgtatggatgactctctggtctgtgttgtcagtattcaagtggtacctccactctgtcacatcttcattttgcttgtctagcagacttgctagtcccttctgtcttgttccatgtcaggcttggacatatgaattgcaatcacattgtgagacaattaattgtccaatatttctcaagactccctgtcctttagaaactattttgcattcatctttgagtcctcagtattttgcctagtaaacagggtttgtcaagtgaatatccaatatagactcaggaagatccacatggggagtgagaaaattgagcgaatcccaggaaaagaacaggaaatggaggtaaaagactcacgtaagtttacccttctatccaggcatgcctccagacaccagcttccacttccttatctgtctggaattggtgttgaattgatcttcgaggtcagtttgaggtttcttactctctatatgagtctctgatacttagaatgttattttgtgctcagattgccagaaatcatgaagaaatgaaaggggaaaaatggtggcaataatgatgactaacaatgttttattgtgtgacatgaagttaaacagtaataatttattgttatattgaatgctgcagcattaaactgctgcctccagtgttaaaagcaatgctcacaagacagatcttatgagaaactctatgtaacagcaaaggatcactgaaatattcagatacagaatttacaatagttgcattagggcttcctttgaattaattaatatttcctctgagatgactcctgccaagtggttttgcttcattcctgatttaattgctaggaaaatcagaattattccagaaagtgaggctatgaaggtttcattgtaggaaaatcttgtgtctgaagccgtgaggctggacaaagggaaatgagttgaatgctgttgtgaatgggcagaagtcagcaccagcaacttccattcatttcgaagtaagagttgataagagaattgactgttgaagtcaaatctccgtatattttcttatttccttctttgcatccatcttgcaaagcaaatttttaagagaaaacgagtgtttcattcttgatagtgaattgctctgcttcttcagcaggaggtgcaggagaaatcctatttgcatcctttccactgctcttaacaagcccctaaaggctgagttaatgtttatttgtggcctggagtggccaaaagggaatagcaggaattattttcttcatagaagtggtggagaatatgagtgcctccctctataaactggagaagatttacctgcacaattctcctctctgctttttagtactgcttgggggatgaaagggacccatggactttggcctcagacacaccaggctggtttcaaattttccttttttctgaaatccacagtaagccacttaaactctctaagccacagtattctgttctgtacaattggaataacaatgctgtgtactggaacagcttcataatttgtaggcccagtactaaatgaaaattgggacccttttgttcaaagaacatgaacttcaagacagtaatggcagagcatcaaataggtgtgtggcccttctgagcatgggggctgtaccactgggcaggccacataccacgaagttgacctcactgtgcagctggattggctgttggatgtcagatatctttccctttgtatctctgtatctcagagagtggatccctgaaaatggcatttgcactggctgctagctagatttagccatggaaggcagtagtaggagactgatggtgagaggcacggggaagccaagttatttccctcttttctcctttcccctgtctctatttccctttgaaacgtatctccaatagtaactgctctcctctttcagttccagcatacctaggacagcccaccttctggggtcccacctttcctgatcccactcactgctagtcagttctctgcaggcagcccagctcctcatgctctaaaaccaccatttccttggttcctccagcctgacaggtgctagctgcttcctgatataactaatatcttgactacctccctgttccctatgaggcatttcagctcttccaagcctctttaactagttccccttattaactattctttattcttcatagaatctgatataagtgtctaccttgaaaggttattacaaggaacaaatttgtctaaggcagtggttttaactgtacattgcaattcatttgtgagtaatacaatcagtttgatgggtcaagaccggtagtttagaacacaaaataacttagagcagaataagaaaacatggtagtgcattgtatgtattaaggtacatatgatttaataaagcttttagttgtctctgtgtgtatgtgtgatgtgtaccatttcatgctgtaaaaatgtattactttctagcaggtgggagaaggaaagaaaggccaatggtctaagacttctggtacataattagcactcaataaattgtagaaactattgttgccatccaagaccatgccatttaaacaaaaggcagtcagacagcccaaagagtttaccattccaactcactttagctcattagaatagtttcatgtagttgggccaacttgtactaaaatggccaaagcgtttacttacatttgtttgtttacacctagacaggcccagcttgagtcaccagccttggctgaaagagaagccagccaggttcaaagtaaagaaacagttttaaaataacattttatttttctgtgagtcatagcaaatctgtccctgcaacatctttctcctgcagctaaatgctttaaaatggtcaggtctcacccaggaaagtgggactgggaggaagtgatgcgataaaacagcttcccaatcagtgcattagtaggagtgcaacctctggcattcctcttttttcagaagtatcaaaaagctctgcagagataactgtgtctccagatggccatgagattggtaaatgacaaatgtttatcagcctttcagcacctgctgatggaagaactaaaaaaaaaatcgcaagtgactttatgagcccacagccaccccagctgtaatgggtgctagtagctctgtgttgctgacctcacatgggtaaaggaagagcagaagaatttttagtcccttggctacttcttatctatttcatcaggtaaggaaactcaacttgaatcctttcaactctgaagaatggtagatctgaggaacaacaaagagctataggtcatgtggatttctctgctcagtcagagagcccagaactctccctggagctgaagatagcccttgcaagctatctcatgatggttttatagcacagtgggctcactcatactggtgctggttttgagcatctatgttgacaagacaaatgtctgtttctactactgcagaggatagagtttaaccaaagtcaggtgacagagaaaaagaacagaaactgataacacttacacagtatccttatatagcaggctcttgaataatgcaggcattggggtgacaaccacccttacagtcaaaaatctgtttataacttttttttttttcagatggagtcttgctctgttgcccaggctggagtgcagtggcatgatcttcgctcactgcaacctttgcctcccgggttaaagagattctcctgcctcagcctcccaagtagctggaattacaggcatataccaccatgcctggctaaattttgtatttttagcagagatggagtttcatcacgttggccaggctgatctcaaactcctgacttcaggtgatccacccgcctcagcctccccagctgtgtagataacttttgacgccccacagccttaactattaatagcctatcattgactagaaatcttactgataacagtcttttaatgcatatgttatatatatacattacactatattattacaataaagttggaaaataaaatgttattaagaaaatcacaaaaaaagagaaaatatatttactattcattaagaagtggaaattgatcatcataaagtcttcctcgttgtcattgtcttcaggttgagtagctgaggaggaggaggaagggaatgggttagtcttgctgtctcaaggatggcaaaggcagaaggaaatccgcatgtaagtggacccacgcagttcaaacctgtgttgttcaagggtactttatgttgtccgggatgctatattgagtactttatacatataaatttacttaatcctcacaacatgcctacaaggtggatactactattgtcctcatttccagctgagaaaacagatagagaaggcaaataatgtgctcaaatctgcacagttaattaatcatagagcccaaattcaaacaaaatagtgtggctgccaagtcaatgctcttgacctctacccagactgggagccagagggtttgcattctaattttatcattaaccaatctgactgatggggcaaatcaaccctactgcaatctcctcttttcatctgtaatataaggttattgcttgagatattttcaagtcttagtgccacctcccatttagagctttagtgttgagaaagatgatattaatgtattccgttgtcctaaatatttcaaacacgtcagtttctacttttccagacaactccaatggggatatttttttattcctccacttcctaattaaggctgaaagggccccatattcagctgctgagtctctgtctcccgccttcttttcctcctgtacgacctaaaactgtcttttgtctttcagcacttggggagaaactctgggaagctttctaaatccctaaatttgtcacacccatccttaaagcagtgctgaattaaaaagtgggattcgtctaagcagaggagatacttaaggaaggagaggggctacagcactaaatgatgtttccaattaagagaagtgtaaggtcagagagaaactccctcctggatggagctcttcaccacctgatgagctgattaaatatcatgccgcaaaaagtaaatgtttactccaagccaggtgcttggactctaaagaactctattaggcaagagtaagtggtttaattggctcaccttcattcaactgttagtatgttcctcataagtgcctgtcagagagaatcttttgtgtttcccttctaacagctggctcataaaaacataaactcatcttacaatgttaagtaaggatcttttaattcctgttttctttcctccaatttgtattaatatgataggagagaaagaaagtgaaagcatgcttctatagctggctacttcatcaaacttaatggaaccatattttgtaattcattctataatttaagttttggtcattttatctcttaaagatgaattccaggccaggtgcagtggtttgtgcctgtaatctcaacccttgagaagccgaggtaggatgattgttagagcccaggagtttgaaaccaaccaatatagagaccctgtctctacaaaaaaaaaaaaaaaaaaaaaaaagtcaggtgtgatggtatatgcctgtagtcctagctactcaggaggctgaagtgggaggattgcttgagcccaggaggtccaggttgcagagagccatgatgatgccattgcactccagcctaggcaacagagcgagacactgtctcaaaagacacacaaacaaaaaaatatgaaaccctagctaaacactgtggactcaaaataacctgtgaaatcacccaaccgtagtatttatctatgagaatgtttcaaagggagatatgtagttgtatgactatttcacgcagatatttgttattaataaaagactttgtggtcagcatgacgtgttagctacagttgaatccatgcttctttacattttgtggtttggttgttgtcgaatttactttccatgcattatttccaaatatatacttattatttcatcagcttagaatggtttggatagaaaaatatatcaaggtctcagaaatgccccccattaacataagggtagccatgacttgaacccaccccactggtttcctttgtctttctccatttctgattctctttctctgtggttacctaggatatataaattacttgactttgaaattcatgattaactcagaaagttatagctagtgattcacaatatttgttttaaaaacagtatgaagaatgtagaagcttggtttttaattataataatataaattagtatcattttatgtactcaaatgccacacacatatgtataaggcattcctatggaataatcttaacctggttctttgacaatttttgtaattcattctctagtgaaatatttccccaaagtgtatccacagattactatctcaccaatatgcttccggaaaaaaagtgccatggtctaataagtttaggaaaccttgcacattctttttccttgggatcaatcattagtattagcagatttagcactaagaaatcctgtagtagagaaattcatttacttttaattcagtatttctcaaaatcattttaccctattactcaaatccctgcttttattctgggaattgttacctctcctttcctttgcatacacttgagaaattgactctagaaatactagccttatgaaatattgatagtaattgctatggtttgttagactcctccaaatctcttgttgaactttgatccctagcattggaggtgggcttaatgggaggtgtttgggtcatgagggcagatccttcatgaatacattaatgccctccctggggtgggtaggaactgagtgacttgttgctctattagtttctgtgagagttgtcccccgactcgccgcagagctggttgttaaaaagagcctggttcctcttccccctctctctcttgcttcctctctctccatgtgatctctgcacacaccagctccccttcaccttctaccatgagtgcaaacagcctgaggccctcacagatgcagatgccagatcattgcttcttacacattgtgtagaaccatgagccaaataaacgtcttttctttataagtaactgagcctcaggtattcttttatagcaatacaaatggacgaagacagtactgattatttgttgggcatttcctatgtgcgaggaactgttacaggtattttggcagttgtaatagcgaggtatttattttggtgctttaacagagactaaaatggctgctttaaataagattgattatttctctctcacatgaaagcctaaaatggtgagcagtgtagcaacttagggcagcaatctttgggtcatccaaggcatcagataccttctgtggtgttgtttcaccgtcctttgaagtgttcctttcttcataggttgaaaccagctccttgtacctcatctggtcccatccctaagaaaagagaccaaagagccatccttgagaaaagagaccaaagagacatccctgagaaaagagaaaataaagggcaaacagcttcttgttaagaatctggtctggattatgctcatagctcattgtccaactgaataaattgctcaatttattgagctcataaattgctcaatatgacatggccatacccagcttacaaggaagtccaagaaatagtctcttattggggaacatttgctctcctgaaacatagaaggttctattatttaataggtagaaggaaagaatgagtattacaaggcaattagctttctctgctgtgtttttacctcattaaatcctacctacaacccatgaaatcagtactttgtcttcattttaatatgagaaaactaagatacagagaaagtaaaactaaagtcacgtagcgactattcgcttttggttttgataccatgctacctaattccatagcctgggttcttagctgatacacacagttgcaatgcctttccagaaaatttctagtagtttccaccattcctggacctattcttttctaactttaaaggcaatccatcttctaagtcagtgtggcagagactctagtttcttcacccaaaccatgttctcctgtctttcttgggctcatgtttaaactatatttctcatcttctcttaggtattaccatatgactaaggtctagtaaatgcaatgtgagaagatctgttgtataccacctccaggcttggcctgtaaaaacttcccatggacatgagctcctccatgccctttcccctccagctagatgaattggaaatgacacccaggacaactggaaggccatatgtcaaaatggacaaggcttgctcaccctgaattctagaataattttgtggaggagaactaccctaacaatctgttttcccacctagcaaaaaaaaatgtgaccacaaaaataaacttctgctgtgtttgatccatttgaaagtttttgatctattagttctagcagttagcttcctctaaaaaatacaattgattaccatgatgtcatggataacaagttggcaacctgggtcaaagtcctattcttgtttttttctagtgataagaccttgggcaatttattaaatctctccaagtctcagttttctcagctttaaaataatcttcaatcatagtgttgttctaagaagtaaattagtttatcttaaaaatcctattccctgttaattattccattctagcaatcaatttgtgcttattctagttgtcccactgtttaaaacacacatgccttagtattatgaaaacatttcaaaagaaatatgtcttagatttctacatttatattagaaaactttcaaatttatacttcatgccttttaaaaaaataatactagtaaaatgaaagaatatcagttttggaatcattccacagtcctggataaaaatacctgttagaccacttactagtggtatcatctatgtgagactcaaattcagcatcagtaattttggaagaatggtagtcctactttcagaattgttaggattaaataaagtgctaaaagtctgtgaaatctccttgcacactgatgatttcccttctctccccaaatagatttccatatggagcacttttagtcatttttgctggactgcaatcacctttctttcttcaaatgttaaaactgaacagtagtagctagcaatttggaatctctagaaagaagttttttttattattatagtgctgaagctcagctcattctctcaaggagcctatggatttggagtgcatcataagggaagaagttaacctcctgctgtattaccagagaccaaggacaaatgttggttgtcacctgcctaaccaggcaagtgatagtcacagactgtccatctcacaacaaaacaatgctaattttgttgagggatagaaatgttgtagttgatctcattttctctagcacagtgtccctttttgaatgttccttctcaaatagggcatggtataaactctgcaagaggggagttccatttggaagacatgtaggcaaacaacattcaggctccacacccacttcgcctgctgagatttgacttattacacaactgcagatgctggtcaattagtttctcatactcattcgtatcacagaagggatgcagtggttataaattgcactgattatgcacaccttggcttaccctattgttgcataaaaataggcaaggcatgttagtcattgcatagtcttttcagtagaaaggaaaagtgattgagaaacagcaaggaaaattgtgtttacagctaaggtttttgttttgttttgttttgtttccactccgttcagtgtgtatataaagttaatgcatttttaacttaacagcaaccaacaacagcttcactttgagtgcatgaaaaacactggggcttaagtgttgatttgttgccaggcatttcctttgggaatccatgtaggctgatcatttacctgggaaatcgtgtgtgtgtgtgtgtgtgtgtgtgttacctttacctttgtaagggacatcataaaacctcaatttcctggtgtgttccagttaattttctgctttattgaatgtcactctgaattccctatttcctttaacttttgtgttgaaaaatcattcaaaagactactgagccattttcttcttcattaagaaaaatattgggttagacttaattcttgatagctgaaaattttggagcattgttttgtttgtttgttttacatttttgaaacaaactattttgagaccgtaataagaacaatggataatcttcccagaaatcagagagagaaagagagagaattctgcataaatttatagatccttgcagcccacatttgaggccccagcaatagaccccaggttaagaattcctgccatagagtgttttgacattatcattctaaatatttaattttgtccaaataaaaatatagacagagaaaagggaacttagcaaaaatcttcatttacattcaaaacaattcaaggtgcattaaaatcatgaaaaactttgttcctctataggccagggaagtttcttgctacttatttcctttattaaagtatattttattgatttgtctttttcttttaaaaacagaatatccaatgggtaagactgaccaaagatttggggaagttgattctaaataggtgagctgtgttttaagagttcttcttagtactcttcaactcagcatgtggaaataaatttcaaaagcttttcttaatttcacaaaaacaaatataaatagttatggggggaaataaacaacaggccaaataccagatggcaactcaaagcacattgtctgctctcttgctctaagctactggttctcagtaggggtgggacagctcccaaaagggggtctttgggaatttgtggtgggtttttggtagtcacaatgttaagaggtactataatagctatttagatggcagagttaggatttcctgtttctttttctttttggtatccctcatgactatatagtctccccaatatattcacatgggtgaaaatcctattcgtaatgattgaactcaattataactccatttacagataaacatgcacaaaattttcatggttttaatacactgaattttccaagggtgtgtgaaattgctgtacatattgacagaagattgttgtttgatttggttaagaactttttattattattattattattattatactttaagttttagggtacatgtgcacaatgtgcaggttacttacatatgtatacatgtgccatgctggtgtgctgcacccattaactcgtcatttagcattaggtatatctcccaatgctatccctccccgctccccccaccccacaacagtccccagagtgtgatgttccccttcctgtgtccatgtgttctcattgttcaattcccacctgtgagtgagaacacacggtgtttggttttttgtctttgcgatagtttactgagaatgatgatttccattttcatccatgtccctacaaaggacataaggaaatgtggcacatatacaccatggaatactatgcagccgtaaaaaatgaagaacttttttaagagttatttttcactttagaaaatcagctagagaccacaatgctgtttatggtattgaagtccccatgagaatgcacctggatcagtgtacatttgtaatgatcagattcacagtgattccatgtgtaggtataagcttttctctacttcaccatgtgtccttgtatagttattgataggggttggctgtggccccctcccaaatctcatcttgaactgtagctctcataattcccatttgtcatgggagggacccaatgggaagtaattgaatcatgggagcaggtctttcccctgctgttctcatgatagtaagtctcatgagatctgatgattttataaaggggagttcccctacacaagttctctcttgcctgccaccatgtaagatgtgactttgctcctcatttgccttctgccatgaatttgaggcctccccagccatgtagaactgtgagtcaattaaacctctttcctttataaattacccagtcttgggtatgtcttcattagcagcgtgagaacagactataacagttatcctgcatcttaacatatttcaatattatttattatatacttatatataataatataaaaatattcattgtgcatttatatatcataatatatatattatgtaatttttcattctgtcttataatttattctaaaaattatatttttaagttaatttataacttattaagtcagtgtttctttaggaaatgtgccctccgtcaaaattttattctttttggtctctttgctagtatgctactagctaaagaaaattcattcccactaattctggattcttatagttattcacagccatgctgttaaagagacaagtgaattactaccttctcagagttgaactcaagggggaagtttgactattggctggcaaaataaagtagtggaaatttatttcttttgttctcaataaaataacctgtgaaccatcctaaaactaaaaaaaggaaattatttatgaagagaagttgtatcatttaaattcgttttctctcttttccctttatttcagaaaccttccataataaaaacttggatataatgaaattttgcataaatgacatgtgacaacctaatttagtggaagccagggaacctgctaatactttaacttcaaagctcttccattttattccttcattacttttcctcctttcaaagcattctttagccatgcaccaagttcgaacaatgacgaatcaaatcctcagagccaagaacaatgttctaatatttccatgcaattaattgctacttcttggtgagcatccagtatacttgattctctcatagaagattctccaagcctgacactcggttgaagtctgaggacttcactgaggacaaagagggatcaaatcttcccaacaaacagtgaactcaccatgcaaagtgaatagaatcccctaatcaataaatcactaaatatttatggagccccgaaatcatattgtgacaagatttttcaaaaaaaaatgtagaaactaagttatgatacaatcacatgtcaggaaggtatattggagtactacttgtccaggactccactgacacccccttgtgctccctatgtcattttgatgtaccaggccattcactgtatctataacgtgaatttttgcccctattttcaatgtcccccatcctattagcttttcctttccagtaaacttctccaaacccttcctcagtgtttcaaaggcaacaaaagttatcacaacaaaagtaactagtatttcttgagtgttcacagtgggctggacaagcaaagtgctttacctgcattgcctcagttaattctcttaataacctatgacatcagctctattattaacctcattatacacatgggaaaatagacactactatgggctgaatatgccccctccaaaattatgttgaaactaaatccccattttgcagtattaagaggcagggcctttttgagtggccagccttcatgagtggattagggccttatgaaggggctggagaaaactaacttaggccctttttgcctttctatcttccaacatgtgaggacatagcatttgcaccttctaccatgtgagaacacagcaagaaggccctcaccagacaccaaatgtgctggtgccttgatctttgacttcttagtctcagaactgtgagaagtaaatgtatattatttgtagttacccagtctatggtattgtgttatagcaacatgaagccagacagaaaaatttacagttttcatcacttggcagaggtcacataacaggtcgatttgattctcaagccgtctttactattatgcttacttggcttttatctctgtagactttaattgctgagttatctttccctgagtcattgctgcttcaaatctcagtctttaggaatcacttctgtaatctgctgattaattatgcatagatcataaaagttatttaatccagctgctgtccagagtcaatatcactatcctactcaaaaatctgcaacaatctaccacgaaaaatcaattctaaactccttagtctgacattaaacagcctgataatctgatccaatccagcctctctgcttctacctatcttgtttacctgtttgttgattcttattcaattgcttccttgatggaggactttcccacccactccatcactacctcttgtttctgcctgcacacatcatttccccaagtcttttgataagaaagatctcctttttacaactatttctctgctctctcctctccaacatatcttcctgacatgtgattgtatcataacttagtttctacatttttttgaaaaaccttgtcacaatatgattttggggctccataaatattttgtgatttattgagtaggggattctattcagtttgcatgtggagttcactgtttgttgggaagatgtgatccctcttttctctatgcttccatcatgacctggatatacttctagtatggccctttctaattcttcacatgcatgccttcactggactgcagactccaagacaggggccatgcagtattcatctttgtgtctttccagttactccacaacaatttattgagtgaataaagaaaatgctgagaaacgaactcaagaggttttgtagatttaataccattgctctgggtatcgcaaaagataatggctattaatgaattagtaccccacttcccaccacctcaccctgttgacatagtatgatagaatgtgtaaccacttaatctaccttaagatgctattgggcaacaacaatgtcttgactttaggggctggaaagcaaatagtatataatgtccaattgctcttgtttggggcagagagcacagatttaagaaacaaggatacaataaaatgaaatttggctgcagtacaaggttaatgtctctcctcacctcccaaagagtaccaagggatcattcattgtcacagctgttggggtttagagctctcttctcatccaaatgccagtactttccacaaaaagctcttccccagggatgccctaataagccagtgtgtcctgtataggtgagacttgccctggctgtctctatccaagtggtgacataagctcatctaaagcctttcattaatgcaaacaatgacccagcccatggtggcactgattcttgaagctgaagacttggagaaggagcctgattttccatcacactgattgttgttttcagtaagatgtttagcttttcaattttctctctgccaaatacaaattagtgtatttccaacatcccagagtcttagctgtgcattgccagcttccactgcttctccttaattaacaaacagctgtagaagagcttctcaactgacatggggggaagagctctaaggaagatatggactatgtctcatatcttcaaatcctccacagtcatctcctgttagatcaccaagaagaaatgcccagtggagacacttcagttcaatgaaaagtttatgactagttgggtttggtctccattttgtattaatgtagttgggttcagtctccaatctgtatgtatgtagtttcctatcccagagagcaggacaagaccatataagctctatttatgtttcctttgactctttagctgaaagcctaggatgtaggacaagtggctaacctgttttagaactttcttcctaggctaacattctgaacttggccttgtggattttacctcttaaactgcaccaaaaaccatggaaacaaagggcttacagcagtgttagcctaatctgagccctctataccttcctatactgtggccacagcagtaaagctacgtggtcttgcaaaagaccttccaagagaaggttggctacagaccttgcttatcacaccatgaacctgaggaggaaagaaaatactcacaaatagtttagcccctttcataaattgttggtccttaatccatttttgaaccctactctgttgggtggaatgtgtgtgtatctgcacgtgtgtgtgtgtgtgtgtgtgtgtgtgtgtttagaaattcaaaaaaaatgaggagatcttggtcttccatagagggaagactgcattatcaatagagtctttcttagcagaggatgaaggctcctgtagctcctaatcttcccatttgtgcacaaatacgtgaattctgattaggttgaaatcaggaagacactcttttgctgcttagtggccacatctagagctaacaacattatcagtgggatggtgattcatggtttaagaacataccctcgccattccagctactcgggaagctgaggtaaaaggatcgcttgagcccagagtttaaggctgtagtgtgccatggtaacacataactagccactgtactctagcctgagcaacatagttagaccccatttcttaaaaacaaaacaaaaacatccttctcctcttctcctcccccagcaattctggatggctcatctaataaagtacatatattttacctaatctagtcaaatgtaatgacacaataagattattattattctccaatccctgctctgcaacatatttggctgaacatttttggctgcaacatttttggctgaagagaatgaggtttcttcctccctgaacctgggaactaacatgaggtgttttcttccacttggtggagctgtgcacatgtgtgcttgcggagaaaaagaagagtcccagcaggccctctactccagctgttggagattgagctttccagtgcattatcctggctttatgcagtgatgccttccccctgatggcagtaaaattttaattagagggcaatgtgcattcctatataatggagtgcacacatggcaggaagttaacaggacacgtttgcagttccagtttcattgtcaaccagctgtgtgattcctggcaatttgctttattttgttgtgtcacagttcttgactaggtaaactggagagtcatctctggtctactttcctcttcagtttggtggaagtttcacgtaaaattacatgtgaaagtccttgagaattgaaacaatgggcaaatctatagcagaatgcttgttgaattctatcagctttcccaaggtgcaggctgcccatgtttagtctttctcactttccaatccattttccacactgcagccagcgtgttttttctcaatggaaatctgatcatatcaacctcttttttaaaaaaaatcctaaatatcttctccctctcacagaataaaaatcacaattccttaagaaactgtcaaagccttctcaatctgtgcctttcatctctgaccattggtatctttcttctgataggataaaagttcattgaatgttcaagccttctcttttgcttttcagagcttggccatgtggttttctctgtctgaaacaagcttcccccattcctttctaggctaactcctactcatcctccaaatttcagcacaaagtcacttacagtgggaatgcttccatggccctctattagcagcctctgatttatgctcccacaatagtcggttctgcctctggaccatgttttatcctattgtttttcctccataagagcacagtcataatctgtataactcagtgttgtaactctggcagctagcacaatctcaggttcataaaaagagctcaagaaatatttgttgaatgaccaattagatggcatattcatttcctagggctcctataactaacgctagcgtggtgccttagaacaacagaaatttatcctgtcgtacttctagagggtgggggtctgaaatcaaggtgttgtcagggctgtgcttcctctcagattctacacagaatcttcccttgcttctttggtggcgatcagtcctttgcatgctgtggcttgctgctacatcactctaatctctgcctttgttgtcatatagcattcctcctgcatgtctctctttgcacatggcattttcctcttataaggaaaccaatcacattggattagagcctatcctaatggcctcatcttaacttgattacatctgcaaagactctatttccaaataacgctacattcacagatactggaggttaggactttaacatatcttttggaggaggatacaggtcaataacagattgctaaaccaattaactaattactaattaatataaattatgggtggaaaaagcttccccagatcacgataaaaagctgtgtcgatctaatcaacgtgcttgcttaaataaggcatgtgtataatatatatgcatgcatctgtgtatatatacatatgtacacatgcattaattatgttgtgcaaaaaccccaaaggctatttatcccaaatagaaaatattgtgtcgtttgtctaaagcactttaaagacatctgcctttttcatatgtaaatttcttggatgacaagaaattactgctttgctagcttttaaaacactaaattatgataatccatcaccaaataaactataagcttctatcatttaaaaaatgtaagaactctgaggttagtagtagtttttagttgccattgaaagacggcagtttaacgtcatcgtttattcagatttccaaattaaggagatctctgtggttagacattcctttcgttatcactctccttttcttcaggcctgtcatttgtccattgatgtcttttccttccaaatgattcatgtacacattaggtcttttccctaagcctcatattatgaaaagcaaagctacatgaaaaaaagcaaatgattgctaaattatgtcctaatttctagcattcagcagtgctaaaatgaagcagagaatttcacaaaattctcagataaagtatatttttaccaactaacattgggtaaaagggactgagatagagatttatttttattattattaataactttgaaaatggtgcatttgggaaactacttactaatgttcattggaattggtggtaatactgaggtcaggatttaattccaggcattacccaaaaagtccatgtttgccttgtttcaagcctagagttcttaaaacaatccctgcaaggaaccaggcataaattatctttcagattggtgggcgtaggaatctatactgcgagctaactgtgctgaaatagacattttagaggatgtgaatgtctatctcagacaaaggagattacaggttattaaccaaggcacttttcaaatgccatccctttgggctttcttacttagagtttcagattcatttagccaaataccagccttatcccttccctaattttcctaaatatttgtggctgaatatacttttagctttaggagtgcagaagactttgagggaaagaaggcagggttgaaaaaggatgagtttcaggtcattacattgcttcaaggcagtttgcagcttgcattcatatttttaaagtctaaattagagccctttaacaccaactatcttgggcacacatgtatgtagaagcataccaccatatggcaaaaggcagagttgctaaaactataaataacaaagaggaaggttaattagcaaattaattagctgaattctatacaaggtactaacaataccttaatttccagatacatttgttatcaaaaatgtctaccttaataaagctgtggggacttactaagtgtatttgctgggcatggttcccagttatgaaatattaataccttgaaaaataaaacatgcttatgaaaatgcagttatgctctcattttcagaggaatatgtaagtgaggaataatatagaaatcctaaaacaactggaaattcagactaaaatgaagtagactgtagttttgtcattgcatgttctgctcatactaaagcacctatcctcccactttaccttctttaaactgcagggcagagagttatatttttcatcttcatgttgagtagagaatccatgaaaatctaatacccagttatcactcaagtgtgacaaatagaaaggagcttcagaataggatcttcagttctaccaaatgtctctgcctaattacatcaatatccatgttgatgagtgtacaaacctgtggctaattatattttcacttcttctaagggtaggtacactaatgtgtgatcccacagaaaagggcatgaaagtaaattaaaggtgtgtgccatgtatattaatgcctttgtggttattattgctattgtcttactcccatggatattggaggattgttgataagacacttaaatgttgataaggcacctaatgagtatcctgtgtgataggagtagtacacaatgataatcatttccttctttgtgcattagtattgacatagccactaatcaggaactgtaaactctaaacttgtatctgcagccctcttattaaaaagattcctggatttttttccctaagctagaaacagacagacaaacaaaaacaatgattaaagggcactaaaagatatatttaaaggcagaggtttttttcctatgtgtataagattcaaattaaattcctctttttggctatttggacagttttggcaattgggctgaagccactatgtttttgtcataacaggtcaaggattgcttactcatgtttgagaagcaataatgatatggcaagagagaggtaagggactacaatgggaggcttattaggaattgtgcatgcctctttcatgtgtgttgtctccaagctaaccttgtgaggtacgaattatgacttcttcctgaaggagaaaagcaagttttagattaagtgcctgacattctgatgtcataaaaagactgaaataagcaacattttagcacaacatttgaacagcccttttcttaaggataagctctttgctctacaccatactaatttccaaaaaggtgtgagattgacatatgaaacttgtacgtttatataaatgtgaatgcagcaagccagagaacagaatgttctgtagcccaggcaagaggcagaggaaatacccagtgacagatctacttggccctcgactaaaggggcgctgtaactttaaaatactaataaatatttagcttggctttttctttcctatttgctaagtcctgtcttgattctctggctaaggggtgtaagaaagtggctgtttgtgataaatagttgtgtttgtgtgtgaatgcatggaagaacacatctgagataatatagtgtttactgctttgccattagcacaatgggctgtctttacagaatatgatgtttaaatctatgcaccagtgcactttcaaatagagaattcgcttcctgttttcacttaaaactctctttttattttaattaacgaaaaagcagtttaatcatccatctttgcagctaaggaagttttacaggcttataatactgtcagattctgcggtatataaatgagaaatagacacttttggggaagaaattggccagtcttccttccttccttcctttcttcctttcttctttccttcccactcctcccccctttccccccactctctctctctttcttcctatgaagagactgttctaaaagctaggaagtttcattgatggtgtgtgatttcacaagctggattttatttcagaacacctgtcaaattcagagctgtctgaagcttctccaacatcattaccccagggctcccagttctatgcacatgtttttataatggcaggaaaaagaattcatatacgcatttgtgtgttagaatcagtggtgtgctggtgtaacaatcagctcctagagggtgaggcagggtgggtaggggatgtttagaaaaagtgggtatggagaagtccctgaattctagtttttgccaaattctgtgatgcaaatactcccaccacagccaatttcaaggttatttttcccagttacatttaatcagggccatacaagatgttacaagaaagaaaatgacaggaacccatgtggttcaactgatactcactcaggagctgagatagcatttcatttatgcaattcaaatagctattggtttggataccttagtattgtttcttccaagaaatattttcattctttcctaaagggataataatagacattcatgacctaatttaggagataatcattttttattttatcactcattattaatgcttcatacgaaaactagatttatgaaaaggcccatggattttacatctattatatcatctcctgttggtttgagaatgaaatgtttgttttgctaatatgtttttctgattaagaagtggaggcagcaggctattaaaagtttttctcaaggcagtaaattggtagactagatatcttcaaattaaaaagtagtgatttcttaggcctgttcatagattattcaaaaatgggttaaagcacaggttgaaaatacttttatgggccacaggataatttaagtgattatttttcagccacttttttttggaaaacatatattagctaatgtctgtaactttattaacttaaaaacaaaagtccagataaaagaattttacactctgccaagcagtggtgcccagcttataggtggttggttctgcatcttacattttgttacttgtaaggtctatgaagaaaggactcccttttctgccctgctcactgtcaaaatttcagtctctacagcatgaagactctacatatagaagacactaaaattttttttaaatatatgaatgaagcagttaatttaaggcagcaaagtcacgcctatacattatttctgtaatgtttaattttaagtataattgcttattaagtagataggatgcttagaaactatatttacctggaagtggcttaaaaatttccctatagacaaaaaatataatttgaagtagttcgtcttcaaaataaaggcctccagatggccagatacctttcatgtacatgcatcaattagactgtaccagaagataataaaaagaatcctattgttttaattatctcttttattctccaaggaacccctattcctgccaattcttacagacgttattaaggcattcagttagtttttcattcatttatttaaaaaatatttatcatgccaagtactatttaaatggtggagataccaaagtgaatgagatacatacaaggggccctagttctcaaggagctcacattcatgagaaattaagttcacacatgcaagatataccagatattaataagtattactcagatcattaaactagaatgaggccaggcacagtggctcatggctgtaatcctagtgccttttagaggctaaggtgggaggatagcttgagcccaggagttccaggatacagtgagctatgatcactccactgcactccagcctgggtgatagagtgagaccctgtctctaaagaaacaaacaaacaaaaagtagaaagatttgacctgagaataactagatagctattttagatcaggtattcatgaataaaataacacttaaagtgagatctgaatgacagaaagaaaagccatgcaaaaatcaaggagtagggtgtgcagatttcacagatggcaaatacctaacatggtgatgctaaagtcagcatgaacctccttctgtttcttgaacagaccacaggctggagaagaaaaggtaggaagaaggctggtataagatgagggtgaagagagaaccaaggccagatcatgggagctttatagccaggctaaggtgtttatgtttaattctaaatatagcagaatacattggagaagactatgctgaggaataatgtgacttgacttaaatttttaaaagactacctaactgtgtatggaaaatgaattgcatgggacaaggatggaaactagttgggagatgagttagaagattattataggagtccttgtgggaagtgttggtgactgttggagggtagtggtggtagtgaagatgcataggagtttctgagcttgttttggaggtagaggaggcaagatttgttaaagaactggcttagcagggtgggcacaaaggaaatacagaattaaaggataattccaaaggttccaacctgagcaactaagtagaggctggcatttactaagatgggtgagattgagagaaggggagtatcaggaggcaagattacttgttattttttagccatgtttacatttttttgagatatcttctgagtatctgagaagaaatttcaagtgggcaatttgttggacaagtttttggttcatgggagaaattaggacatggatgcaattttgtgagcctgtaacacacagctagtatttagagctaagggtctatatgaaatcacctaaatagtacttatagatatgaaagagaaggacagagcccaggggtactcttacatttacaggtgagcataaaaaagaaatcaaaagaaactctaaaggatcaaaagcaaagtagaagaaaaccaaacagccatgcgggagtgattgttgagatgttttgaaaaagagaaggttgacagtcatttaggaaggtgaggaatcaaacacagtgcagatgagggtggtgtagggagatcattctctaggtgccctttgcatttttgctcatcttacgatcagagtcactaactctcttggttcaggagttggaagatacagtggcctgttccagagcaaaggcaggttcagttgctgttcaggataatgaagataatgcctcccactgaggcaaagatcaacagagcttactgcccattataaaatattcagattccttaagcgcatggttcctctcctataatacaaacctcttgcaggtactgttgtcacctggcccttttcatatcaccctgtgaggagtggggcccagagaacctacacaaatgcaaacacttcaaccactgctattgtcataaagtccgtggtctctgacccaaagtctcatgtcccctgctagcatccatgaaacagtggcaggtgaactttgaaaacaggataggctaaaatctcagatccttcactactcttcacagatagtaggccattgtgatggtctacttgagctctgttgttgtggtggcatatctttctgtaccgatattcagttggtttgatgcaagcatggtacaggtagatgggtttatgccttagatatttaataagaatgccttaacacatgatcatatgtcttctttcttcactgacaatggcaccccactaatggagtgtgcaaatccaggaagaccagtgtttgaacgttgtggggtaaagtgccgataggtaagcccgcatatttagatatttctaagaggttctaaaatgatgaatactttcctcaatcatttgtcacaaccaaagtctatattcttatgcttagatgtcataattcatattaaagaattgggccttatataacaccttaatattaatagtacttggctaagcacagacgatcaacaacacttaattaatgaaactagttctgaatacattatatactttcagggtatataaggaggtaattacattttacagaggcatatactctatatctggtttattcgattgtgaatcaataaacatgggggttttttttaaaacatgatttctatgatgaatttttaatttaattgtaggaagctcctttaccgctgagtcaccagtgtcttcttgtataatataaagacattatggcctggcatggtggctcatgcctgtagtcccagcactttgggaggccgaggcgggtggatcatttgaggtcacgagttcaagaccagcctggccaacatggcgaaaccctgtctctactaaaaatacaaaaattaggcctggtggtgcatgcctgtagtcctagctacttgggaggttgaggcaggagaattgcttgaacccgagaggccaaggttgcaatgagccgagattgcaccactgtactctagcctgggagacagagtgagaccccatctcaaaagaaaaaaaataaaataaaagacattagccatctggagcagttaagtatatatttttctataaagcaatttaatgtagatgatattttctctctgtgtgtgcacaattgcatgcatatgtcaagtgtcgtgagattccaagtatttgacgatctgcttcttctatagacagttgggtacataaaaggagagccatgtgcaaatccagtctctggttctaggtttatacctcctcttctccacctccgctttccttgataacccctgatgcacacagccagccatcctcatccctcgagatgtggttgatttctctctatttgggtttcaggaaattgtttttcctcccttctgagagtctatgcgctgctgcaggccagtcagtattgattcaattctgggtgaatcctctctcactctttcctaagtgtatattgtatatgtagttcttctgccaaaagcagctttgtattaagattgtattaagatttaagttttcttaaatttgcaagtcacctaaaatatatcctgtgtctgctgggatccttttgatgttgaagcgtcttggagtagacaatagaggattttcatatggtggaagaatgttaggtgtccttgttggagaagagaggaagagtagagaacccctttaaagccctcttactgcctgttccttgcatctcatctctacatatttagcaatcacatctgctgatttggcaaacactaacagcagctacacagcgtcagtgaggacaatagtgagtggatttaaacatcaggggcgatgtaccagtgcaataaatagaatatatcattgtttcactgcggacagaatgtctgtgctctctatgaggatctgcatttaagcccaacacccaaggaaggcaaacatctaaagctcagcatggggtccttcaagcaggggaatacaaacaaagcatttttctcccaaaacacaagttttaggatttcatgtcaaagacatgctgccaatcagaagacagcattcccccttcttagagctggaaatggtaaccaggacacattggtatgcacaattctgctggctcagagcacacgcaagctcctaggctgtgactggcaggaggctcacagcgatttctttttttttgagacagggtctcactctgtcgcccagactggagtgcgcagtggtgcagtcttggctcactgcaacctcagcttcccaggttcaagcaattattctgcctcagcctcccaagtagctgagtttataggcgcccaccaccaagcgcagctaactttcttgtattttttttagtagaaacagggtttcaccatattggccaggctgttttcaatgtttttgaactcctgacctcaagtgatccacccacctcggcctccctaggattataggcatgagccaccatgcccagcaagctcacagcaatttttaatgcaatatgatcagacctaattttggctttttgatttcctcccttaaacctcaggcaggcactttttcaaaagagaaatcaatcagtcaatcaatcagtcaatcaacagtgagtgaatgaatgactaaattgtttgtttttagcatggcataaaataatccttaatattttgacctcaagcaaccattctgaccatatcttcttccatgcgcctttgactgagtacccagatacatgcagagtcaagttttctagatcacagccttgtcctctaattcagtgccttggtatgaaatctttcttcttctatgtcctttttttgccagatgaaatttcagtctttattcaagatcaagtgcaactgtctctttgaggaaagtcctttgaccgccatttctccccttcagaaggcaaacacctgggggagaagatctgcttaaggacctggtaactgacaaagaatggaatgggagcgagaaccgcctagccatcccttctccttgcacagtcatgaaacaaaagttgaaaaggagcctggttttacttgaccagtcataaattaccataaaataaaatgagatattaggaacctttgatctctgaaaaagtaatatgtgttgaaaagaaatatcactgttacatatagacaaataatagaaatatttgaggcatgcatttaaaatgtagaggccacttatagcaggcatattaacatgtgcatttgctttttaagaagtatacacacgtgtacctttagctttgaaagggtaagattcaatgcttgggtgatggatgcactaaagtctcagaagccaccactaaaggacttacccacgtaaccgaaaacaacctgtactccaaaatcaatgaaataaaataaaaaggtaagattcataaatagcaagttgagaatgcatgtttataccatgtagacaatgcatgataaattgttggcaataagacccatgtagctgactttggggatacaaagtagcttctgaaagaggttcctaattagccctgcctgaggtgactgcttaaggtatttatctgtagctggaatgcattgcctcagagacttgaggattcaggagctatgagtttcaaggccacagatgcagtggaatagtaaggcttcttcccctgcctggcacattgacctaactgatgagaggtgccttagggacccagcagctatggccatttatgtctagtccctcactctagaaaggaattgcttgaataccacggtgctggagtttgtagccacaatgctgaaggtcagggcagtccttcatgatgatgcatttctgtcagccatacttgcacatctctttaatgtctgcaatgtcattaagcagtggtgtatcatttttttttaatgcagaaactaaactgatactcaaaacctatgacaatttgaatccttcctgcctatccaaccttagtttttctgctcgataatataaattctccctttcagtcaggtagatagtcttcctgtcttcctgtcattcttggtttctctttgttgctcttgtcttccccacctgctgaaatgcttttcttctttctttcttttttttttttctgagaaaagacctcactctgttgcccatcctggagtgcagtggcataatgacaactcaatgcagtctcaagctcctgggtcaagtgatcatccttcctcagcctactgagtagctgggactacaggcatgtgccaccacatctggctaatttcttcatttttttgtagagactgggtcttgctatgctgcccaagctggtcttgaactcctgggctcaagtgatcttcccacttcagcctccaaaagtgcagggattacagacatgagccacccatgtacctggtttctctcttcttttctaactaatcaagtactttaagtcacaactcagggtgacaacctccacctccattgacttctccagagcatttcatttcctcttatcctttctctgcactttgttagaacttacattctgatttgtactgttgacctttgagcccttaagtttatgcaccttctctctctctctctctcgctcactctctctctctctgtctctgtgtctctctctgtttctgtctctctctttttctctgtcaattattttattctggtatttggtacttatgagaaatcttattagtatcctaaactctctcaaaacaggaaatgtgtattttccttctcatctaattcttaggaaacttcatataggaataaaaaatatgtagtagtggattgtctggtaaatgaataaaagagggatttgaggtcagtgggctgtttcaggacatgaccaaggaatgtggtaccagggcagcaacaagcttgctaaggggcgataaagtagtcattgtatataacagaggaatttgggctcaatgcagatttgccactaactctttggcagtatagaattcactagagaaatattagtaggttagttagtattcctaataaagaactgctaataccttatagagacataagccatgtttctcgtctttcgtttctgaaatgaaattttggccagggaaacattttgcatccctttttgatgtctacaaatgtggcatttgtcagatgtgagatagttaagtgtgtgtgtgtgtgtgtgtgtgtatatatatactttatatatgtatatatacatatcctatgtgtgtgggtatatatatatatatatatatatatatatatatatatgaatgatgcatggagagatatctctccatgcatccaaaatattcacaacttttcactaatatctgaataacatttgaaaaattgacaactcttctggctaaagatcagcatacacattcgttccacagagacttgtgccaaaatcttgctcagctcaaggggtactgcacaataaacaataagaaacttttataactccgactaatagaactcattgcttttccagtttgaagataaaggatgtctgcttgctttccatgcctaattttcctgatgctgtaaagctgttcaggaaagttcccactgcaggagttttgctagtaatcttcagctccgtgggaagcctttggactctgttgctatccctgaaagtggctgttcttctccatcagtttcctgggcaagggctcgaaccagctattagtgtctatttgcactgcatgaaaacaaaatttaatgtaaagacgcttatagcttgcctaccctaaaaccccaggagtctcattctgcctgaccctggacattttttgaactgatagagggatgggtatctggtgggtctcttcagtcagctcatctcagcatgttgaaagtccaaatgacccttgcctgaggatggtgaaagtaatttgtatgtgtgtatacataatcctgctttttcactatttccagtcacagattgcagagatagttgactgtgcttgttagtgtgagtgttaataactttgctatgctgatttttagacttcctatgctatatgatctccctgaagagcatgacagagcattgctttggaaaatcaatattcggcgtgattattccttctttcatgtgtaatcaaactttgaagaccaccaataggccaaatctacaagcattaggtttctaaacatattgtttagtcaggagaaattgtgttttctagctgaggtatgccagctactggtatggagaaaatctgcctagcaaattggaaggggccagaagctcaaatgctattgagaaccactcaacaattcttttttcttatacacaggattgaagcacagagcaaaaggaaaatccagctttgggatttgttcccttgaacttacaaatgattcattagaccaatgacattgtgagaatttggtctctgacaaagaaataaatgttttaaaaatagtgctaatacataggtacaaatacagaattatgtcaggcatgtatttttttaaagatagagtccagtgaaaagaatacgtgttagaatatggattaggtttctaaaggtatacttatgtctgccttcgtcttcagaaaacaaagttgtatgtacactttaagaaaggtcttagtgtggtaaacgtgaggcaaaccaaagtcctgttacttcttttgtcatatcattaaagcctccagacggaggtttcttcccattatgtgatgtgcagaatttcagatgtcagtcagcagctgaagtcaactgttggtccaccaggcctctaagctgcagcctctgtcagcttggggacagtgggatccatgtgacttgcctgctactgcccttgattgggcagatcacagagcagatggcctgtgtctagagtacaaggtgttaaggctttttttttggggggggaagaaataattcacatgtgctaatattcctggatgtttcactgataatataatatagaatgtatgaaaaaatcaaagtcaattagaaccagaaatctcctgatactggatgattctatacataaatatcttgcactaacagcaagaataataaaagttgtacaaaaaatgtctgttcttccccagaccatgagctccatggaggcagagaccttatttggttggtttactgcccttccccaatgtttctaccaagctgaacatgtatccagctctcagtgccccattgagttgaaataaattacagtgacataaactatgttcttcatcaaatgctggacaagcacgtttctcaggcaacttctctgggatcaacataagaacagggtgatgaaatgtgagaagcagtgagggcaaggacttgagcctggtgcctacctaaagtttacactccacaagtattccacccaacacttcagataccttctcttctttcaaagtcaacagtttatgcccattgaaaataaatacacacacccactcatgcccataggcatgtgtgtgctaccagaaaatatgtacatgttaggctctttggaagcagtggtagtttggtgagaattgctgcattggctcatcaacacagacctgatcgcactttgatttcatatcttgctatgcagggctcccattatctgcctgccatttgtgtgcatttatgtttagcgtcaatttctcctcccatgaggctataatctgccttgtaaggagctaaaatgggaaaagcagttagaatgatgagtccagttggagcctgctggggaacaagacagtcatcacaggccaatcggcagtggagacagggtggcccttatcacacagaggcatctggagactgagagagacaaagcaacacagctgcaagccgaccatgatctgctggaagcttcttcagtcataaagcaaaggacagtaattctgaatgacaatgtaggaaaacaaaaaagaagaagaaagaaagaaaatggttgagcccagacgatcatttttagttacggatgtcacaaatggtgattgctggtagtgaagtatctgaatctgaagaccagctgtatatagtatgtgtgtttatggaggtgtgtgtgtgtgtgtgtatgtgttggagaagacctgcatgcctagttgtagcactagccagaaattcttgtttcatcgtctagaatgtggccagaggtttgcctaaattctcataagtccattactgttcttctataaatcaggctgcctgttttgcataattcaccaggtaattcacctatcactaggcaaggcagctgccatggagtgcatgcaggaattcccttcattgactcaggctggtaccattctcagcatttttgctgtttatatatttttattttggtctcggttttcctttatctaaaaacgtcaagctgggatggatccttggagatgctcgcttaaacaagttcattacacttaaaatagttttacaagcacaagtgaaaataatgtaataattgcagcagattcttagacctccactggatcctgggttgcctgtttcctttactcagttctagtttctaagtttattgctgggttttgatgtatgtatgtgtgtgttaattttttaatatagaatatgaagtttgagggaaaactattgcccttattcttgtcgatttgttattcgatcttttcttttcctctttgttggtatgtgaggagttgcagagcaaagctgctgagatcttatatttgactgaggtttcacaagctctgcgagatatcctaatcttcagagtgacacctggtttagccaaccacgtggaaaaaactaagggtttagatataaccacattcaaccacagcctttaccttctcccctgtgctttgctgtatctaatgacggcccagaaaggtgcaaagagagacttttcagaaaaagcataaaaacaatcaagaaggaaaaaattgcttggttgttttctgagatacctgaaccagaagcaattgagtatttaggtgtaactttctatgacctattagaatgaatgccattcttatggcttaaatttttttcaagatgaagagggcacttatatagacaaagaatatatttcccataaagatatattagcacaattctaattaatcttaaatctaagtttttgttccccaagtccaatactcagtctagaacatatgcccttttctgtgatgcctgctggccaccatgtatgatcatggtatattgtgcattgtacaaagtgcccagccaagggctgaaatcaactagtgctctacttatgaggaattaatccaggcatggcgctgtgtctaccccagaggatgtgccttttctaattttcgtaaagttactgcaatgggccagccctgaagatatacagataacagaatcctatgacttttagatgacattagccatcatgagagcctgcctctctgtaaatggtgttagggtgtttattatcagcagcattgggaatacagttgttttgatgtgttttctgatgccctgttctaaaattcactacttctctgcaggctttggaaagtgggagtgtaaccactggtcctttgggttctttgtgaagttgtgctaaccataagatgccgcatactctcctagtgaccacagtttttatgggaggtgatgtacagcagcaaaagtctaatgtaaatctcatgttggttcttccagagcaggggcagctagagtctaataatttcttgggaagagtttctgtacctggaaattttagatgtatatcaaggacatgtgagcaaatgggaaatctaattgcccagtgcctctggagcaaagtgtagagacagaaccagaatgttttttaccggcacatttctgtattaaactaagggagggaagctctttaactatatgggaactttttctcattggttcctttaagtgtcttaaaaaaactgatgtcttcctaagagaacttgtgaaaggtggtaaaatgtttaattggaacttaagaataacttcctactgaatagctttgttgatttcactttcctgtggggaaaagatagacattgacaaaactgtttcgatgagaattaatcatagctgtagatttcaaggtatgttatgatactaggtttcatctcctggatcttcctcctctacattaaaatgattagaatgataaactcaaggcatattaatgatccctaatcaatgtaaaaaaattatcatttctcttctttatgctgtatttactgtcagaaatacagacatacatattaggaagatttttcttgaagggaattggcacaaaagggttgagacctttaattaatcaaaaaattgaccattccttgaaccttgattgtttggtatcattaacaaaggacatgagacaacatgttcaagctttataatttgctggaaataatattttctttttttttaaaaaaagcaattttttgttgtaattgttaatcttactatatatttgtctcctgaaaatggtgttatttgccactccttctacgtattaattggtgtaagctcttaagttatataggatagttttaatttctccaaaaagctgcctaaggaaagtaaaacaccataaagaaaagggtatgtacccaagaagtagcaagaaactaaagagaagagattgagatattatcatgagaatttaataagagaattaaatatctagaaaaatgtgtacatacttagaagtagtaaacattaatttcctttcttccatctatagttcacctctagatcactcttttctttctttagatcatcagtatccaagattggaaagagtaaatgagtgttgataaatgggcactctcttgttctgttgatataagcttaagttggggtagcttttctggaggactgcttgacaatatacgtcaaatttatattgtgatgtcctttggccatgcaatttacccttcctggaatgtacgctaagtagataattgaataagtgaaaaaccaaatgtcttcataaggatattcaccatagttttgttgaaaattatttacaaattggaaacaatctaaataaatgtcaatacaggaatagtttaattgcatatagaactgtacatacaatgtaatcctatgcagtcactaaaaatgaaaatgtataggtgtattgattgccctgggcaattaccataacgtataaatgaatgagtaaaagtatcacagaataatactcttccctcctaagtaaatcctcaccaataaatcctattatacaaggcaaaacctgtatattatccctatcccctaattttcatcatctctcatatctaatccaccatgatgtctttttcattcctaagtgtgtttcagatcatccacttccctctaactctatcactgtcttctggtccaagcttggtattcaattaatacttgttaaatggattctgaatatgattccattcataacagcacacctatccacgtacgtatgtgaagacacaggtgcctagagaggtgttcactgaactactaatggtggtttcctcttctgtggtagaattcagcattatctttatttttttatttgaatttctcttgttgtttgaaatatttttaaataataatgtgtaatttacccctctccaaaaataaaacttataaaatggggatgataactattattctacctttctcactggataaacatagtggtcaaataaacaaatactcgtgaaagtcttttataatgtgaaaacaaaggtttttttgttattatgtgcaataataataataataactatagatactaaaatttgttgaatatatttcctcagtattttgagtgtcttaactcatttaaatctcacaataagcctatgatactataaatatacccatttcaaatatgaggaaactgaagcagagacagacgaaataatttatccaggtagacacagccagtagagctgaggcaggatttgaccccacacaatcaggccctaggacccaagccctaaccactgtgccaaaatcataatacctgcaggaagtggcaaatgttgaacttagctccatatatcagactcttgccactgtgaagcccttacagataatttcttttcttttttgagacggagtctagctctgttgctcaggctggagtgcagtggcgcgatctcggctcactgcaagctctgcctcccagtttcacaccatactcctgcctcagcctccctagtagctgggactacagccgcccaccaccacgcccggctaattttttatactacctcagttaatttagaaagattttcaggcactgatgaatgattttgggagtaatcccaagccaaatgacctctgttggaagtaatttaatagatgtgtttaaatattagaggtgggtgagatggtgaagaattaacatttgaggaacatttggtatcctctgggcaatatgtagacaccctttcaataaatcctcacaacaccccagtaagttatgtgttatttgtttctattgtaagttgcagtcatagataaggaaactcagatatgtattaagtcatttgctcaggtctttacagctattaagttgcagagttgggagcccatctaaactcctaagatcagggtctggatcacctctattattttacattgggcatctatcatccaggacctatgtgctgcaggaacgtaattaagaatgactttgacaagataaatatttggggacatgaagcctgatcacagagtctaccagttatgtggacttgggcaagcaacaccatgaacctcacttttttcattctcaaagtgggactaatgaaatttttcctgcttctccaaaagataattttagtcactctgttggtgagttttgcaaaaacattgtagtataagccttcacaaggaattacagagaagaagataagtcttagcattcaagaagcctggactgtacctgtctcaaaattattttatgctaaatgcagacaattttctctatttggagtttctttcccatcttagttggcctcttctcagttttctgaatgaagcgtgcaccctcggatgtctggcctttactcctgcatgtcttccggtctggaataccttcccctccctcaggaacttaaccagcttcaacatgcagccttcctgaacactccaacatgaagggatgcccttctgttctaaatgtccactgcactgaacaaatcatttaatacaaatttctctgtagtttatacagaggatttgtgtttatgggcttatatgttttctttaaaaataagttataaagtttttgatgctagagcattcttttgtatccccaggagacactcagaatatatttgttgattgttttgattttaaagaaaaaggcggaagaatgaggtaaaatggccactatctgtcaggaacttcatataattatctctgcccagaaataaattaaaatagttttcttcagccagttgcaatagcttatagaaaaaaattaccttccctagatgtcagtgtcccaatttggaaaacagagtttggtcatatattttgtccgctgttgtacaacctttagaaacataaaattcaagaggaatactaaataaaaggatcaatcaatactgagttcagctttaaaattatttcatctaataatgctggttttcttggcagcactagcaagggctagaattttttaaaaatcatccttatatatgtattgattgaatttattaaaatgctttattaccatatccatttgcttataagaaggcaccctgatgtgtcctatatgagtttcaaaacacaattaaataaaaccatgcagagcaacaaacactacgtagcatttacaaactgcatttgtattcatttttatgtacatgaagggaaaaaaaacccaaaaggttgaaagccttctggagtgataaatgccacaatttagtggaaaatacacattgtaatttgagaacatctcccactaagagtcagtgtagctacagggacaagaagcctggtgctaaattgtctgaacattgatgtcccttcaaaattcatatgttggatcctagtacccagtgtgatataatcaagagataaggtctttggggaactgattaagtcatgaggggttctccatatgcatgaatgggttcatgctcttataaaagaggttgaagagagcaccctagggcctcttgcccttctgcttctgccatgtgagggcgtagcaagaggcactctttatgaagcagagtgagcccttgccagacactgaatgtgctggcgccttaatcttggacgttccagcctccagactgtgataattaaatttattttatttctaaatgactcagtctaagaagttttgttatagcagcccaaacagactaagacccctggcccacaggctcctgagcatctcagtgcctttgaggctataaaggacctcgaccttcactttcagcacatgttcaagtaaaagagaaaaatgtgtgtaaagaagtgcccatacccaataaacatacccatatttattgcaaattatcctctaaactgtttcattgtggtcaaaacccaagttataaatttttagtgtccttttaagagttcagtatttgtcaacctacggtcaacatttgcatcaacaaagaaggtaagatatgttgtgttatctttgtcatttttcagctgtcaactaggataggggccagaaatagcaaaactgtaaacttgaaattgtttcaggaagaagtgtaatagctaaggggtgtctatgaaatggaatgtatatcaatatgaggtaagacagctggtaaaaaataaaaaattagcaggaggggcaccggattcatgtaccagggaaaataatgtcatgttcattgcccagagagattcccaggaattagagattgagaaatattatttcttgacatgtctagaggctacgtggatagaagttctggaaaatgtttgagataaaggccaataaaaagcaaaaggacctgaggattctgtttattcactgaacagagaagctaaaaattgggctctcattttggacaaaaataaaagccatagtaataagtaaaataaaataacctaccaggtagcagagctcttagcaaaggattctgcaagcaaaaggcaggtgtgaattgggaaagtgagtctgggattgaggtgaggtggggttaggtgtagaacagggctatgaaggtcagggcagtggaaggtttgattctggaaagcatggcttcaagggaaaacttgagtggtgaacgggaaaatctgtgaggatcggaaatgtaagtctctatacttgctggggaaatgagcaagaaatgaaagggagagagccagatgacgcagctggaagcagaaatctgagcagggggaacctggcaacagagaggaggagctggaagaacaggggcagatcagatctagagccaagctgtattctctggccccatactttaatattctacctatgaggcgcagtgcctttgggtgttgttcataaaattccagtgttgaaaagggtttcagacattgtccgtgaagctcctctatccatcaagccctttgcaatatttacagtaaggaaagtgggagcgcttcagaaagagagagagagaaaaatgaaaattcctagccccatctagacatgccttatcagtgagttaggcgaagtgcacaaaatttaaaagtaagattctagttgtttgtattttagctattcacgttgcatcacaagagctccacaactggatttaaataattgtttctgccttagcaatcttaagtgtgcatgtattgttcagctattcctttaggggaaagattgctagatgggaataaaatggaaatgctgttttctaaaagttgtggtcttcatagggagatagctcttcacttcgtgtgttagtgatgaacatttgcaagctgtagagctgtagagaacactttgtggttcttctatttgaagaaaccctgatggctttgtcacatattccaagtttaacttttatttttaaagagtttatacatcatatttgaaaaagactcaaacatgtctagagttatatgttagacactaaacatacttgaaaaagatttaaaaccttggttttagtcatctgtaagtactctattttaaggacaactaattaatacttataactcagataattcaggagacgatcaatgattatgaaataacttcctatgacatacttttaaatagtaaatgccttcactgcatgtaattcacacatcaatatatactaaactatttccattaatatagccagtctccaatttacaggaagacattatgtttcacaagttgattttaagtgaattttttgtaatatagaaagaattgtcccaaagagtgactgctgaactggttaaatccacaaaaaaaagcatcacatgaattcatctactaggcaaatttgctcatccactttcaagtcaaaaaaaagttttaaattagataaaaacctgtgtatcccctttcttagtaaatttgcctgctgtgataaatatacacgtgcacacaaaaataggcatgcatttttaagaggagtagaaacccatttgaacttgtccaggaactcaagtttagaggctcaaatgtagagaatactaataaccacctataataattcttttggagaaggcatactgtattatgcctagtgcttaataggacaggggatttttcatctctcatgtgcctgggaatgagagccaggggcttcccccaattctaaaaaaattagcaattcagcagaatctacagtggggccaaattgtggctgggatttgggggatttcatcaaagtgggtcagaggtagaggtggaagagaagcagaaggccggtgggagtaggatacagtacaggggcgagcttccagctggctccatcagttgaggaagaagaagcaatcccaggaggtccatactcttgatattttatccctcctctcactaaggacagctatgccctttgtgatctgccctagactgactttttaatacagagaatgaaggccagtacagaaagcaaggagagaaagaagagaaatagatgctaagttgtccccttgaggaagaatgagggaaaatggagttcctgccaccctagtctattagctgacattgttactcctaattcaaggtaattattggtatgcaaagaaagtatgtattaactatatgtcaaccagtaactccctgaaatccacttgatgatagaaaattagtctatggccatatcactgtgaatgcaccaaatctcatctgatagcaaaatattgcatacatttcttctagaaactaagaattccaatgaaaagctatgaaagaatcctacttaggtctgaatttccatacattcctggtatctcagagggtggcaaggttagaaaacttgagaatctgtgggcacactagggatgaagtgatagtattctttgttggatatcaaaagaaatctaagcaggagaaccaaaatccattggtggaaccaaaaaaccattggtggtctgaaaagttaggtgggagaattgaatagcttagttctagggatcaagtaaccaccctgactattgagcttcccgataagacaacatgatggaaactacatggtttcatccaggtgctgggaacaagtcctactgaacattggcttttggacaaataacaggcagattctttggtgaagctttgttcatctgaaactcttccctgtcctctcttctccacttcatttttctgatgaggagaatggaagtttgtataaactagagtgctcaagcagcaggcagtggaagaggcaagacctccaagtagatctgcaagctctgaaccaagtgacctatctctaggccatattgaggaaggccaatgcagttttgcgatctctctacctcttcatttttccttttcctcctccccttccccttttgctctccccctcttcctctcaagagagtaatgtgctagtagtacctgatggtaccccagtgcttcctgccttcctcccttccacttcctgccttcctttctcccacttcctgccttcctcccttccacttcctgccttccccagtcccacttcctctcttccttcctggcaccccccagcactcccttccctccttctgttctccagtaccttcctttcttttcctttgcccttctctcttcctccttctctctttattttccttccttccttcctctgcaaggccttcttactagtttccacccattttcctatgtaaagcgattttgaattctagccatctgttaatacaaggcagtgaaaaatgttgaagtcacatcaaattccacttgctctgccagttaaaaatacagatgcttcctgttttatgctttcctctcactttctctagagtttaaacatgaaaatatgttccatgataaaaaccagcacatattccctttcatcaggaaacatattccaaacaatgaaaggaaggggagggggattattttcacaagtccagcaaggatacttggatgttgggggaatcatttgtagaaccataatttcacagagcaagaacataattattcacaactatcacattttatagatgaagaaactgagatcgcagggaattgttataattgttctcatatgtgctgcatatcgacttgccaaaattcacatcagcttaaattttcacccaacatgcctggtcctcaattgttccacaatactttttgctatccgctgatttcagaaagggttcttttggctactgggagaggccaaatcactaagcaatggataattaacctgaaactcagtaaatgcactggagtgaaaaaaaaatgtgagactaagagtcaagacacctgggttctagtcacaaatctgttactaactacccatcccaactcatagcaaaaatttttattaatactcttgctccacaaagagactagatcaaatggtctctaaatttactttcaactctttgaatcttgagttttcttccttcaattttctgctgactcagagcgtatagccttggccaagttatttactgccataaatctcattttttttccaagatgaaagggagaataacacattcccctattttcccagcatatatatatatacactatataatcttgcattaaattgactatctttagaaatcacattaaatcctttctatctatagactttggattagtcactaaagctagaataagacatgggccatatcattaggcaatgtctctggctgtagttgtattatcaaacactgcattgacgcttgttcatccttgcttccatcatacctttttatgtaagctgttctaattcttacatgactataacatggagcactgtatgtcaccatatctcttcctctcattgaatctgatcgtattctaatatctcctatctcaatgcctagttcttcacccattttaccaatgcaatatagaaactttcttactgcctttttatttcttacttttcttttgaataattcaccaagttattattgattttgtctgcctgatgtctttcaaatttatccacttttctctcttccatgatatcctaatctaagctaccatcacccctcaactgaactacagcagtcaaaagggttatttccacacagcagtcaaaaggattgtttcaggtgctaaatttggcaatgtcaccccactgaatggctttcttctggtcttaaagacccgattccagaacaaaacttacatggtaggcagctcctggcccttgactgtgtttctagtgtcatagtacatgctcctgaccttttgccctctttgagttcctcctcctcactatcctttcctggagattcaggtttggcagttccccggggttagaatgctcctccatgatttacctagttgctgcttattcttctggttttgtactgatggtcatgttctcagagcagccttctcagcctccctgggtcagttccctccatcatgcaccatcattgtgccttgtatccttgctgttattatacttatcagagtcgtaattttacatttgctcatgtcatactttttagattatgctttgctttcttctccttcaccagagtgtaaactctatgatactatgtctatttttatgtcaccattgtaattccagtgcctggcataatatctaatgcatagaaggtgcaggctaaaattctattgaataaataatgaatgaaaagaaagaatagaagtgcctgagttcaggccctgtatccccattccctcatatatgtggttggaaccatagaaggcaaaatttggtgttaaaagaataaagctggcaagcactgatgtgcctaacaggataggaagttcagaattcttttttaaaagtgttcaagggcccaggagtgcctggctaacataatgagacccagtctctacaaacatttaaaaattacacaggcatggtggcatgggcctgtattctccgctactctggaggctgaggtgagaggactgcatgagcctaggaggctgaaggcttcagtgagctgtgatcacaccactgtagtccagcctggtcaacagagtgagaccctatctcttaaaaaaagttctaggatattggagttgataatgtttgtaaagatcaacgctaacattgcctccaaccaagtctcaatatgctccaaaaagaaatacttcaaattaaaactcgtgtgtgtgtgtgtgtgtgtgtgtgtgtgtgtgtgtgtgtgtaaggagaggtggctcatacctgtaatcccagcactttgggaagccaaggcgggcggatcacttgaagtcaggagttcaagaccagctggccaacatggtgaagctccgtctctactaaaaatacaaaaattagcgtgctggcatgcacctgtagtcccagctactcgggaggctgaggcatgagaatcacttgaacctgggaggcagaggttgcagtgagctgagatggtgccaccgcacttcagaaacagagtgagactctgtctcaaaaaaaaaaaaaaaaaaaaaggccgggcatggcggctcacgcctgtaatcgcagtattttgggaggccgaggcgggcggatcacaatgtcaggagtcccagaccagcctggccaacatggtgaaaccctgtctctactaaaaatacaaaattagccgggcgtggtggtacatgcctgtaatcgcagctactcggtaggctgaggcaggagaatcgcttgaacctggaaggtggaggttgcagtaagcagagattgtgccattgcataatggagtgaaactccatctcaaaatatatatatttttatatatttttaaatatatgtttataaatatataaatatttttatatacatatctatatatagagagaataaatatgtatccacagagagagggagagagataccaagacaaacttataattgctataaattcaaataagagagaagtcagtaaaacctagagtaactaggaaatactccctagaggccaaatttgacctgtgctttgaaaggtaattacaattgggacaggaaacggcacggcttctttctcaaagattgattattctgactattctccattagctcttccttatacactttccactttcccaaactctgtcccgggatgctgacatgaaccacgtcaacaggactccctcacatcctgtcttcaagtagcatttgcccagagagaggcctcaggcaggaggttgtaggatggaaggagagatttgcaggcattcatttccctgctccctccctgcctggctgcagtgggtagtagctaattcctcttctgaaggccacagctcctggtggatgcccccttctcacttacaactgagcttctcagtgggttaccccttcacaactagggttggtcatggctttctgatgctgtgatcacccagggtacttttaaactctctacttatccgtctggggtgccatgtgttatttgctaagaatgaggtaataggaattttttaaaaaaagattaaaataatactatcagcctgtcaatggggattcctcccacccccaaaaatagagttgttcgtttctctttgtttggtttacatgatatatatatatatatatatatatcatgtatatgtatatgatttacctcaaaacagatcacaaagctgaggtcacttgaaactgactattacaagctagctggtagaattaaacttgtttccctaagtaaaatagaaaaatttggccaagagataagaaaatagctgcccctcaccaccacaaacacatacatacacactatactgaatggatcttcatagagagtaagttaataagaggccagcccctacctctgcttccctccccagggacatacatataaatagttcagttatgtctgacttaatagatttgggaaggaggaaacgtgagaggctagtccttctgaagggttgggaggtaagggtgagggaagggaggggagcaaaattacggtactgggatttggacccagataaaagctgctttgtcacatcatcccgatgtaaaatccgtgcatctgagagatagcccctgagccaccacacaggctcctcccaccagagtctgtctggcaggggtcagtgctgcctcgctgtggattagagggagtcatcgacatgtcatctgccatcaaccacacttattgtgaggaaaagaatgccccatacacatagaggccacccttgggatggacttttgagttgactaaagagtaaaaatcacaatggatcatccactagtcagcattattacctttactaacaaaaccagtagcttagccacgatcgtataaaacaataaatgttggttaatttctaaagtacattgattgttttagtttttgttttaagaaaaaggcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactctggaggctgaggcaggagaatggcgtgaacccaggaagcggtgcttgcagtgagccgagattgcgccactgcagtccgcagtccggcctgggcgacagagcgagactccgtctcaaaaaaaaaaaaaaaaaagaaaaaggctttatgtggctgttgggaataggattatttcctctaacatttatcccagtatttttaaaataaagaaacatttggtcgatgaaaagtatagaatatttgtggtaattataataagtgaatacattacataatgtcctttgtgaaaaaggcttacattattataatgggaaggaggtaaattaatctgagtagtattagtataatagtcttagtaattataatggaatgaatcaccctatattataattatgattcaaataatatatatttttagagatcaaccgtttcatgatgtgctggaatgggatgtggtaataggagagcagtgattttggctaacacattaggtattctgagtcaatttggcacaacagcagaaattattttctctattgtcttattgagaagaaacgtcctaagaaggatcttggggaaaataaataagtatgtgagtctgacataggaagagagggtttcttcccctgcaaggcaccttgtgaaagcctagtggggagaaatagtgggatgatgaaggatggggcaggttacttctggaagcaaaattcagatcccgagtgcaggtgttgttcaggcctctgtgccccactgtaagtgtgctggcttcattgaaagggatgagaataaggcagacacgttcaaatatgcagagtgagggaaaatacaaagagcatatttgatattggttgaatgattgagaatatttgatatttgatattgattgataattgatgagcacttactgtgtgactaggaactgaactaaatgctgccccagagatcattcttatttatgctcacaccactcatgaagcaaaccattgttgttattttcattcttcagatgaggaaactgacagtcagtgatgctaagaaacttgctcaaggtcactacagtagttattgtgggcctggggtttgaattcagcctaactccagagtctatgaccttaaccattaagtgaaataagtgaacatcttcatgttcaggacatgtgatgtgtgtgcacacgcatgtgtgtgtgtacaaaataaaatatttgaagccaacaggatcctaagtctgggtgggtcctaatgccagagtgcttagggacacttcctttttaagcaagatagtttgacattgtcagcttttaattgtaatttaatttcttgtgtgaacattattaaaatgtattaaaaccagatcaaaacatccaagacttttatccccctgatttttatagaagccctctgcttacaagcacttaaagagagatgaatccttatttttcctctggtaagtgatttctaaattcccgtagaaaagcctttaaaaagaaaactcaactagctgcatttatggacttgaatacctacactctactaaaattattgccttttcttaatgatgttcctgactcatcctgaaaattgatcatatatgtataaggtgatgctcactttacaggtggagaatgttgtagccacaagtaatgaagactaatatatagatatttaaatccacattttgtccagaattctcaagcagggagttctaacctagccccacccctcattccctcattaagcattgttttcttagaaaggattaaaactggtaatatatctgtaatcaattagctgacatgacttaaaattgataagtcatttgatgaattctcatctcaaattccgaatgaataaacaatgagaaatgggaaagcctttggcagagagagactcattgaatcagttaattaaggaaagagaaagagccagagtacaagctatcaatatcacctacatgggtcaagaactcatccttatgtgtgtaataatagagctactcataaacctgaaatgatacaattaattacggaagttatagaatattggagcatcctcgggtgaaaaataattgtgtctatattataaaagtatgcaacataacacattttatctgcatttaacattttgttggtgtttcatgcaaatgaaaaaaaaaaaacactgtttttatgatttagccaaaccatgctaactctagtaacaaccctcccaatctcagtgttttaatgcaacaaacagttgtatcttgttggtataaattccactgcattgttcttggttgggttgttccttaaagaggatactcaggaatccattctcttcctatactgttccagaggaagatggctcctccattttcaatacgtggcttcaaggtcacgctgacgttgttcagacagtgttctgttggaagagtgagagaaaaaagcatgtacatacaattccttccaacacacatacacttaactgctttggtttgaaagtgacataaaccttctgctcacattccattggccagaattcctcacacagtccccacctggcttagtgctcaggaagaggaaatagatttgatgatcatctaggcaatgtctgtgatgagattggttcaaaaaatgtaccagtaaaaataaaaataatcctgttcattacattccagaaaatgaactgattaaagacaaatatgtatgcatcacttttctctttacgtagtgaagcaatgtgaaaaacatattaattgagctattcatggcaagacttctctttataaacttcatacatctgtcactaaattgatatgaaagaaatatttgatctcagaaagaattttatctatcatgatggaatgctggcagccaaatgtatacctaaaaattgctgaaatattggagtaaaaaggaatagttagatcgatcatcttaattttgtgaaagcatgcgtacatttttcaccttggattcagttgtgttggcattttataggcacagttataaatttgcctaaaatacagaatggcattacaacaaaactcagactcatggtgtaatcattgtttttttcaaactaaaaacaaagaatgaaaaataaaaacctctaagaacaaaattactccatttaattaaattaaacagacaaaacttggaggcatagtagagatggcaaggaaaggcctcagaccccttacccccatccaggggaaatatttgccagccactcctatcttcagcaaaacttgagttatgatgtaaactcaagactcttaaatttgtgattaatcctgggtgtcttgaaaattggagagtgggttagcaaattcatagttccccaaatttgtgctatctactgctgttttcttgtggattataagcttgaaggaaatgtgctgcctagagatatgagctgtgtgtaattactcccacctgctgggtaaaatctttattacatgggcattagacttcattcccatcgaggggtgaggaggggtgcaatatgaaccaaccacaccacaaggcttgtgaacatccttcctctatggtgtctcctgacacttctttccagcttccaaatgtgatacaactttgactggaaactgtgaaccaatgtgtatccaatgaaccaagggagatttagctccttaaaagaaaattaaatgtagaaagatgtggaaggatcaatgaatcatatttatccaataagtggttcaacaattacaagagcgagacaggaagggaacccttccaggcagagtggtcctcagctctggttttccagcctagagacccatgtggcaggaacttggccttcatcattgaataccctgcatacacccttcctcaagcctcctttgtatgtgtgagagcactgacttcagaaacagaaatgagtttccagccctcaagggaactgtttgctaaagattggcaggagcccacaagactacgacacagtctttgatgagctggctctccaagtgtgggcagacttttgtttctaagttattgggaggctttctgtgggtataaaacctgcaaaaaacacaagcatcaatgttgccatattaataactgctttcatccttggcaagaagaaaaagaacgtggggaaaagagtcaggcgcaaacatggtttgagttttattgtcttttacttgctcactgcctacacctcccaccagtagctttggaaagagagtttcagaaatgttatcttatgttttttatccctaagaatggggtcatagtcttcaatttatgcctaaagtgtttaactactccttcttaatttactcgctctgcccaggaagaaaacagacataacttgcaaaggtggaaacactggtacgttaggaatatcattcattttcggattcttggcccttgagtttcactgttacttaattgacaaagctgagctgtttcatttcacgctaggaagtctttggttaaattgcaggcttgggtttctgtcctttggcagtggaagtaaagagaaatcagaagcaatgtagcatttatgaaccactggctcctctaactgcctctgtggcttcaaatcctgatgatgtcaattgtggtttgtgtatatgtacgtgtgtgaatgtgtacacacatgtgagtgcgtgaacattcgattcatttctcatttttgttctctctcttttcccctcacctccggaccttttcatccttctttatgttctgttgccttcatctcttagtttttctattctatgccccttttgtttctactcttttcatctgacctattattatgtcatcagctataagcaccatggaaaacactagtttcatcatctccatctgaaagaaaaaaaaaaactcaacaagggagaagctgaatatatctgtcttcagtatctatctttgaatttggaatgcttcctgccaagaaaattatattctgaaactccttagatcttgcagtcttcatgaagcacaccagccaatagctgcctcctgacatcagctcagatatctggttgacttttgctgctagctcttccagccaatgaaagtagataccttaggccagtgttcccagacatttaggttttatgggataataaaatctccaggagcaaaatgaagaggctgatatattgccttctctttaaattttaacacttttgaaaaactgccatctacacactaccgctttttacattttaacacttttttaaaactaccatccattgtcatcattattccataaaaagaggtattttaggaaggatactcacaacataagttggataaatttagcaattaaaaaagcactgctttacttttatcttctcctttaatcaaagatgggatatgaatatcaaccagcattgatccaattttaggcccttagttccaataaaattgttccttttcccatataaatggttatgcctttgggccaattgctctgtctctcagaggttattatatcctgttgcctctatattgaggattgctgtttcatctttggagttacaatgtcccaaagggatcactgatacattcttagctccagtatataaatagaggcactaagaaataaaatgagagggttttgacacctctccctctcccccaccccccaacacacacaaacaagtaaatgggttagcttttatttctacaattgcacagcatatttagtgagagagggaagttggaggtgggtatcacacatgtaagatattgcccttattttttttttttttcagagacagtatctcattctgttgcacaggctgaagtgcagtgcctcgaacatagttcactgcagccttgaactcctgggctcaaacaatcttcctacctcagccttctgagtaactgggactacaggcatatggccaccatgcccagataactttttaaaaacatttttgtagagatagagtctcactatgtttaccaggctggtgtcaaactgctggcctttagtgatcctcccattttgccctcccaaagtgctgggattacaggtatgagccactgcacctgtcctggcccttattattgagtagattgtagtctaatgaaaacatatgagtataataaacaaaagaaaaaagaaaacatatttagccaattcatagcaaaaggcagacagaagtagatgctgaatagagaaacaagactgttagagggcagagaaaggagtaattcattttgctggaagaatcaaggaagcaatcacaaaggtttaatgtgtaattctgaatttatgtgattgctatataatcattctgtttcatggctgcagtgtaagctgtgtgagggcattgtttgtatcagatgtctgaacctctttatctcatcccttatcatagtgtctggtatctagtctataacccataatatctcctgaataactgaatgggtgcctacaatgataagtggtgtgaaagataccaagaaaatcaagtatcattcattgccccgaaagcacctgtgagcacataggtttgcaaacatgccacatgtgttcggtcagcccattgcttgtgtacatgatcatagatggtcatagggatttacttcattctgaaatggaataatttcatcctcaccctgctttaccttaggtaaagattttgatgccatttttattaagacatttacttggaagtaaatgtcatgctgtgaagagccattatagacaaatattgtagccacttgccaagtaatgacttatgctgggaagttgcttaaaaggctgattttattcattttatttgctatacccttgtgctacttagagaagggtagagaatgagagaggagcaatatgttttgttctcttttttttcataaatcagtaattatttgcagagtgttttgtgtaaagtgctcagctcacaactggaaatagaatcctgggttagacagtggccatagtgatatttacatatctccagcttgtagtttgccaattgaaatgcagacatatgcggaaattgcctcattgtcattccttgtttttgtaatattatccttggctctacggattcattttttttctccttctactgtcaacactgttttagcagtgagttatattatccggtgacatcagagaagcaaagctacatgtgtcagcttggcaggaattgtccacttacagcaaatttgtgacaagttgtatttttctaccattttcacctggagtgacgaagaatctacagttgagggagacaacatggacctcccctgatggtaacagtgctatgtccaattgagctgctgttgcttcagtaccaaagaggaaggagctggtgatctttgaataatccttcccctatgaaaagtaggaatgtatccccagagttcattgtctgtatctgtaggtaatggaggcttaactggcattaaaatcatagccagtttcagacccattaagtttaatggtttttgtaatgataggctgcaactgatggaataaccaaaagaacaattcatggactgtttatggaagaataccttcaccattcaaaatggacattaaactatggctggtttcattgcaaggcaaaagttccctctttatcttctagttaggtccatgtgcagcccaggaggtatgtaaaagctatactttaggagaaaagttgacttgaagcttttaagctaatgagtttgaacttggcatgttttctattatcattgtctttaatcagtggtgttatataataaggagctaataaattaatctaagtgtaagtcaaattaatataagttaaagtcaaaatccagctaggcaaagccagataggcatattaaaatggcagcccctaccccaattccttgataatccattaaaagtagaaagttttggttaggaagccacctcctgttacgtaaatcagaatgtaagagccatgagattagggattttcatttgttttatccacttttatatcctcagtgtctagaaaaatgcttagcatattgcaggcactctgcaaatattgaacatacggggttgatgaacatataacccattttggttgatgtagttttatttcttaagaggtaaaaattctttcagaaaaagaaaagtaatcatttctacaaaataaccctccactggttgatattcttcccagatctacctttcttcacacagatctttttttaagagaaaaccacagggatatgtggctggtgcaatcaatgataggtttgggatatgataaaatgtaggaaatggctaaatgggagagtacatgatttataaaatagaatttaaaataacagccctcaacagcagatctttgccagcagcacatgatgggaaaatataaaccccattctggggatggcatctggtacagattgagaaataaattgggcagcgaaacagaatgtgtcttcagtggtccttaagatcaaaccaccaatgataagcatggatcattggagcctccaccttgctctttttgaaacagctaaaatcagcaagggaatgaaaaggaaatggctttatcatctgtgagcagcttgcccctccctctggagatccaaatctccaaacatgcattttgatatactttgggagttctctttatctagtaatttcatttaggggaaaaaaatatagctctccctgcccacatcccacattgttacatcactgattcctcaccatgctaacacattcaataatctgacgtgcaactcaactagaagagcaatcacagccagtgatgggccggcatcatggagagtaaagacaaatggaaacaataataactgtggaagaagcagatctcaaatgggaaactcaatcccagtgatcagggaaaactccaaaggaaggatatgagttcaaaaaaatcaattcaacaaaaacttattgtctgtctaccatgtatcaggcatggggatatattactggtcaacacaatgtgctttgctgcctggtgcctgtgttctgatatctggtgtgcatgttctcaatggtattgcaagttgcattgggctagaatcatgaagtattatcaggggatttacttgaaattaaattagtcccattcttgtggaaatctggagctggcatatgcatggaagtgaaggtcttgttgctggttgaatttagtgccctctgcaatgaaagccaaatcccaactttagtctgtgactggggggccttctacaaagagaatgaattttaacaattaaccaacaatctaaattcttggaaagtgaaagtttctaaaacataaaatccatgaagacagaattagaaaatcaatgtgtcctttttggaggaagaggaaagccgctggctgaccacgtcactttcatgtttctactcaaatcttatcaacaaggcctttgttgaccattcatccccttcctaggcccccttatttctatgtctgtcttgtatcatctgacacattgtaaatgtccttatttatttgcttactgtctgtctcttcactctgaaatataaattccatcatgtcagggactttttcttcatcttccccaaatgatgtttgaagcctcccatctaatgctgagaggtatttccctagtagccctgtcatcactttcctaccactgtccctgttgccacataatttaagattccctgtggccaatgctgatgtcattatcatggacgtccttaggaaacgaaaataatttaagcttctaaaatgggcaaattcgatgtagagttgatgggtacatcacacacccatctagaaaagagcatctcaggttggtacctgaaacttggtagactccaccccaagtcacatggccaactgatgtgttacttcttagacatcctgctttctctgtccataggcctggttgggtggtctttttcagatactaaatcatggtacaattggttttcataaaactagtactctaattctacttttccagtagccttgagtaaaggaatgttgaaaacttgtagtgatgaaacgtgtaggatttgcgatttgtcggagtagggacaaaactatttgagaacatagtccagctgaccaaaagaaaataagttctcatattactaataacttttagggatccaataggctcaagaattctgaggttgggtttgacagtgattagtgtaaattaagtagaagtagttaagaaagtggctgaaattgaaggatcggttgtggttagtaaatatggaggattgaaacacaatgcaaacttgataattgataaccttcatttaattctaactaaaagcccactttctggtccaaagttggaactaagaatgaattctttttactctgagaggatatttacaaagaaaacacaaacacacaaactatgggtaacacaaaagcaaactagaatgatttatcttattattctgttatgggttgaattatttcctcaaaaaatatatgcttgtcttaaccccagtgctgctgaatgtgactttatttggaaatagagtctttggaggggaattagtaaagatgaggttatactcaagtaaagtaggtccttaatccaatacaactggtgttcttattgaaagagaaaagacaacgtaaagacatagacacacaggaagaacaccatgtgaagacaggcagtggtcagaattatgtatctacaagccaaggaatgcctgaggttaccagaagctggaagaggcaaggatcccctccagagcccttagaggaagcagggccctgacaacactgtgatttcagacttctctcctctagaaccattagacaataattttctgttgtttgaagccaccaaatctgtgatactctgttacacaaatcctaggaatttgatacaccttcctagacccaagtggggaagaaaagggagaaacaggtttagaggtggagtaaaagataacagcttctcacaacttgaggcaagatgcgtatgctgatggcagagaaaggagttggcattttctgaaagcctgtcagatcccctgctttgtctgggaaggggaggaatatccacagcgtcttagcaggtgaaatgcagcagcgaagaccaggtgcctgtattgttgcctctggttgtgcagatgaagagtcattaggctgacctcatctatggacccaactggaattagccctgactctagagccactggatgttcaggcaaaactgaccctaaaattctttttaaatgcattgcttaagccaagcattctcttattcaaaatcaagctgctgcattttcatgtagcatgaaatgcaattttctatttaaggtgttcaactaacttagggataggttgatggccaaacaaagaaggtttcattaagatggaaatgatttggagtatctagtctccaaagtgattgctctagagacatttatcaatccaccggtggcttctagtcgatatttggttttataggttggggcaaaagtaattgcagtttttgactttttaattgcaaaaccgcagctacttttacaccaacctgataatattccccagatccttccctgcttcctctcattagtaaccagagcaggctgagaatcacttacctgtctcttgtgttccacaatgcacactttgaccccatctagtctcttccaatatcatttactcttgtccattagcggattttctttacttcctgtgtgtctagcttgttggggggatagggaggagaggagaggctgaggatattttttctgtgtgtgtgtaaaggttattcaaattctttatcacttgcttttgctttttaggaagaaaaaaacatgaatatcttataacactattttttaaatgaaattgttcagcaaattatacttaattatatttttaattttaagttctgggatacatgtgcagaacatgcaggtttgttacattggtatatgtgtgccatggttgtttgctgcacctatcaacccgtcatctaggttttaagacctgcatgagagggtggagccaagatggccgaataggaagagctccagtctagagctcccagcatgagcgacgcagaagacaggtgatttctgcatttccaactgaggtactgggcttatctcactggggaatgttggaaagtgggtgcaggacagtgggtgcagcgcacccagcatgagccaaagcagggagaggcattgcctcacctgggaagtgcaaagcgtcagggaattcccttttctagtcaaagaaaggggtgacagacggcacctggaaaatcgggtcactcccaccctaatactgcacttttccaaaggtcttagcaaacggcacaccaggagattatatcccacgcatggcttggagggttgtatgcccacggagcctccctcattgctagcacagcagtttgagatcaaactgccaggcggcagtgaggctgggggagggacgcccgccattgccaaggcctgagtaggtaaacaaagcggccaggaagctcgaactgggtggagccaaccgcagctcaaggaggcctgtctgcctctgtagactccacctctgggggcagggaatagccaaacaaaaggcagcagaatcctctgcagacttaaatgtccctgtctgacagctttgaagagagtagtggttctcccagcatgcagctggagatctgagaacggacagactgcctcctcaagtgcgtccctgacccctgagtagcctaactgggaggcaccccccagtaggggcagactgacacctcccacagccaggtactcctctgagacaaaacttccagaggagcgatcaggcagtaacatttgctgctcaccagtatctgctgttctgcagcctccgctgctgatacccaggcaaacagggtctggagtgaacctccagcaaactccaacagacctgcagctgtgggtcctgactgttagaaggaaaactaacaaacagaaaggacatccacaccaaaaccccatttatacatcaccatcatcaaagaccaaaggtagataaaagcagaaagatgaggaaaaaacagagcagaaaaactggaaactctaaaaatcagaacgcctctcctcctccaaaggaatgcagctccttaccagcaatggaacaaagctggatggagtatgactttgatgagagaagaaggcttcagacaatcaaactactctgagctaaaggaggaagtttgaacccatggcaaagaagttaaaaaccttgaaaaaaattagatgaatggctaactagaataaccaatgcagagatgtccttaaaggacctgatggagctgaaaaccaaggcacgagaactacgtgatgaatgcacaagcctcagtagctgatttgatcaactggaagaaagggtatcagtgatggaagatgaaatgaatgaaatgaagcaagaagagaagtttagagaaaaaagaataaaaagaaatgaacaaagcctccaagaaatatgggactatgcgaaaagaccaaatctacatctgattggtgtaactgaaagtgatggggagaatggaaccaagttcgaaaacactctgcaggatattatccaggagaacttccacaatctagcaaggcagggaacattcaaattcaggaaatacagagaacgccacaaagatactcctcgagaagagcaactccaagacacataattgtcagattcaccaaagttgaaatgaaggaaaaaatgttaagggcagccagagagaaaggtcaggttacccacaaagggaagcccatcagactaacagctgatcctctcagcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcattaaacatggaaaggaacaaccagtaccagccactgcaaaaacatgccaaattgtaaagaccatcaaagctaggaagaaactgcatccactaacgagcaaaataaccagctaacatcataatgacaggatcaaattcacacataacaatattaaccttaaatgtaaatgggctaaatgctccaattaaaagacacagactggcagattggataaagagtcaagacccatcagtgtgctgtattcaggaaacccatctcacgtgcagagacacacataggctcaaaataaagggatggaggaagatctaccaaacaaatggaaaacaaaaaaaggcagggattacaattctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagaccaggaagagacttagactcccacacaataataatgggagactttaacactccactgtcaacattagactgatcaacgagacagaaagttaacaaggatatgcaggcattgaactcagctctgcaccaagcagacctaatagacatctacaggactctccaccccaaatcaacagaatatacattcttctcagcaccacaccacacctattccaaaattgaccacatagttggaagtaaagcactcctcagcaaatgtaaaagaacagaaattataacaaactgtctctcagaccacagtgcaatcaaactagtactcaggattaagaaactcactcaaaaccgctcaactacaaggaaactgaacaacctgctcctgaatgactactgggtacataacaaaatgaaattaagatgttctttgaaaccaacgagaacaaagacacaacataccagaatctctgggacacattcaaagcagtgtgtagagggaaatttatagcactaaatgcccacaagagaaagcaggaaagatctaaaatggacaccctaacatcacaattaaaagaactagaaaagcaagagcaaacacattcaaaagctagcagaaggcaagaaataactaagatcagagcagaactgaaggaaatagagacacaaaaaacccttcaaaaaatcaatgaatccaggagctggttttctgaaaatatcaacaaaattgatagaccactagcaagactaataaagaagaaaagagaagaatcaaatagatgcaataaaaaatgataaagggtatatcaccaccgatcccacagaaatacaaactaccatcagagaatactataaacatctctacacaaataaactagaaaatctagaagaaatggatacattcctcgacacatacaccctcccaagactaaaccaggaagaagttgaatctctgaatagaccaataagaggctctgaaattgaggcaataattaatagcttaccaaccaaaaaaagtccaggaccagatcgattcacagccaaattctaccgaggtacaaggaggagctggtaccattccttctgaaactattccaatcaatagaaaaagaggaaatcctccctaactcattttatgaggccagcaccatcctgataccaaagcctggcagagacataacaaataaagagaattttagaccaatatccctgatgaacatcgatgcaaaaatcctcagtaaaatactagcaaactgaatccagcagcacatcaaaaagctgatccaccatgatcaagtgggcttcatccctgggatgccaggctggttcaacatacgaaaatcaataaatgtaatccagcatataaacagaaccaatgacaaaaaccatattactatctcaatagatgcagaaaaggcctttgacaaaattcaacaactcttcatgctaaaaactatcaataaattaggtattgatgggacatatgtcaaaataataagaactatctatgacaaacccatagccaatatcatactgaatgggcaaaaactggaagcattccctttgaaaactggcacaagacagggatgccctctctcaccactcctattcaacatagtgttggaagttttggccagggctatcaggcagaagaaggaaataaagggtattcaggtagtcaaagatgaagtcaaattgtccctgtttgcagatgacatgattgtatatctagaaaaccccattgtctcagcccaaaatctccttaagctgataggcaacttcagcaaagtctcaggatacaaaatcaatgtacaaaaatcacaagcattcttatccacccataacagacaaacagagagccaaatcatgagtgaactcccattcacaattgcttcaaagagaataaaatacctaggaatccaacttacaagggatgtgaaggacctcttcaaggagaattacaaaccactgctcaatgaaataaaagacgatacaaacaaatggaagaacattccatgcttatgggtagaaagaatcaatattatgaaaatggccatactgccaaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcatgctacctgacttcaaactacaaggctacagtaaccaaaacagcatggtactgataccaaaacagagatatagaccaatggaacagaacagaggcctcagaaataatgctgcatatctacaaccatctgatctttgacaaacctgagaaaaacaagaaatggggaaaggattccctatttaataaatggtgctgggaaaactggctagccatatgtagaaagctgaaactggatcccttccttataccttatacaaaaattaattcaaggtgattaaagacttaaatgttagacctgaaaccataaaaaccctagaagaaaatctaggcaataccattcaggacataggcatggacaaggacttcatgtctaaaacaccaaaagcaatggcaacaaaagccaaaattgacaaatgcgatctaattaaactaaagagcttctgcacagcaaaagaaactaccatcagagtaaacaggcagcctacagaatgggagaaaatttttgcaatctattcatctgtcaaagggctaatatccagaatctacagtgaactcaaacaaatttacaagaaaaaaacaaacaaccccatcaaaaagtgggtgaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggcgattcctcagggatctagaactagaaataccatttgacccagccatcccattactgggtatattcccaaaggattataaatcatgctgctataaagacacatgcacacatatgtttattgtggcactattcacaatagcaaacacttgaaaacaagtgaaatgcccaacaatgatagactggattaagaaaatgtggcacatatacaccatggaatactatgcagccataaaaaatgatgagttcatgtcctttgtaaggacatggatgaagctggaaaccatcattctcagcaaactatcgcaaggacaaagaaccaaacaccacatgttctcactcataggtgggaattgaacaatgagaacacatggacacgggaaggggaacatcacacactggggcctgttgtggggtggtgggaggggggagggatagcattaggaggtatacctaatgttaaatgaggagttaatgggtgcagcacaccgacatggcacatgtatacatatgtaactaacctgcatgttgtgtacatgtaccctaaaacttaaattataataaaaaaattaaaatataaaagacctgcatgcattaggtgtttgtcctaatgctctgcctcccttttccccccatcccttgacaggccctgatgtgtaatgttcccctcgctgtgtccatgtgttctcattgttcaactcccacttatgagtgagaacatgcggtatttagttttctgttcctatgttagtttgctgcggatgattatacttaaatatttttaaacaaggctttagacctaaatccatcaaaataaaccactttgcatgaaaaaaaatcatgggaccatttcagcatgttctataggtgggctgatttaaatgatttccttatacatctctttctgcttgtgctattgaataattgagaagtttgcagggggtgtggtgccttgcacagaccgagaaggaagagaaaggaagcaacacttgcaaaaggactttgttgtgtacagtgatagaatgctctacctgtgttactcattgaatcaggaggattgttgaaggaggagggctctctggaattgtaatctgaagaatgagggttattcatcaggaaaagagggcaaggcaaggggagggggaagcataggagaagaaataaaaggcccagaattctgaaaaactccatgctaaaagacccagaattccgaaaaactccatgtcagcagggtcaaaataaattttgtggaatggttacttagattgagagaaggactaatgagaaatgaaactagaggtagagtcagagatcagttaatagtcttctattttaggttaaggaattcccatttcattctgaaggtcaaggacaacttaggtaaagggcagtgactaagaaagaccaccctggtcaggctcgatggctcacccctgtaatccaagcactttgggaggctgaggcaggcagatcacttgaggttagcagttagagaccagcctgaccaatatggtgaaaccctgtctctactaaaaatacaaaaattagctgggtgtggtggtgcaagcctgtaatcccagctgctctggaggctgaggcaggagaatcacttgaaccctggaggtggaggttgcagtgagccaagattgcatcattgcactgcagcctaggtgatagagtgagactctgtctcaaaaaaatagaaagatcattctggcttttgggtggagaatagactgtccatgggcaaagtcagagtccaggaggccatgccagaagctgctgctgtactttaggcaaattctatgtggtggtggcattggtagtaagagtggagaggaatatacaagttagcgatacatttaggaggtaggttcgataaaacttggtgatttattaagtttgaaagtgaagaagagggaggagtcaggattgacttacacatgaaacatataagacttctttctgtcctaaaaaaaaaaatcaccgttgtagaaaatgatagaaactgatggacataagaaagcaatcaggatctcgattctcaatgccatgtgaagaaccacatgctcttttgacattttaagtagagatgtacatttggtttctgcagatccatttcatagctcggctatgatttcagactcattactcaaaagcaagggtgtaggatcaggggagggtgaacaagttaggcagaggaatgagctgctctgtgaggtggtttgctccacagcctttcactccttcttcccaacgtctcacagtcataaaaaaaaaaaaaaaaaaaaaaaaaagtaggagggagtgcctatatccagtagaattggagacaagttagggacagagctcagagagctgctcctgatgcggaagtggcaagaaaagacgcttcacctccctgacaacaacacatccactgtgtgtagcaatacgtttctgcctaagacaatttacccccagggaaatacaagaagggagacatctcccaggaaattaccatttgtttctactactgaaggattttcgtctatttatttgagaaaagtgagaagcttctttttgctgagaacatagtaaatgctgcaaaagcatttgatgtcatgtccattaagtaacttggctgaatttcttgaagctttaggtaccttgcttcaattcctgcatactatttactgaccctctgtaacaggacttttcaactttcaactatattagaacatgtagtttctctattaccaagttccagctgaacagtctatctttaatattcagaaagtgtttggtgtctactagccaagactgtagtctgagcaatgacattgacagtggaccttgatcttccttcctttgaagcataagtgccttgtatcattttactttcctctagtagaagtccttcctatggttatagtatttagtttctactttttgcatttaatcggagcatctttgtaatttacaatttttaaatctttttttttcaaggactaaacacgaaggtttgaagtccaacaggcaactaaagatgtatacaaaccccgcacaaatcagcctccattctaatgccattcctcttctatacttccattttttaaacctgagcatatattttgttttgagtcttttcttactcttttatttgttaatactctttattcagtttttgtcaggtaaaaatgttttgccttgccaaagaaccatctaattccttctcaggtctttttaatatattgcttccagatatttttggattggtggtttctgcaattctccctaaaacaatcttcgtttctcttacacatctcattctctacgctttggcagacttttgcagatgcattctataactgcacaaattacccttccaattttctccagctaaacaatctaatccagggtcctaaatatttttggtgccatagactcctttggcattccagaggtgcccagggattttactcaggatagtgtctttaaatgcatgtttaaaatacatcagattacaaagaatgtcaattaaattgaaaaatagcttaaatattttaataattgtgatatagtaataaatgaacttctttaggtgcattaagtaacaagatctactaacagggctaataacttattatttcagtatgtctgtggtttctattggtgacaaaaatcacaagtactgttaatatttttgttttattttgtttaaaattatttaaattttaattaataaaacatatatatgtatatttatggtgtacagcacattgctatatgtatacattgtggcatggctgaatcaaagtaattaacatatgcattagctcacatagttattttttgtggtgagactgcttaaaattcactctcctagcaatttttgactgtgtgctgcattgtttttttaactatagttagcattttgtaaatagtcctcttagaattattcccccaattgaagttgtgtgccctttcaccaacatctctgcattttctccttccaccactctctgtcctgagtaaccaccattctattctctgcttctatgagttcaactttcttagattccacatgtaagtgagattatgtggtatttgtcttctgtgcttagcttctttcacttaatgtaatggtgctgttcatattactgtggttttggtgcctacattcaaactcagtggaaattctaatttgcagttagtttttcagaaagaagaaatgtgtgaatagtttcttatggtccaagcccttggatcctctgtattttatccacagatgcttgggaggatctctagatcccagattaagaactccagctagttattagtcctttgtgctttgaaactcaaatcaaatacccatctcttccatagaactttttctaaattcactagactcacttatctacccttcttcctatagtttcattcactctctgttatgaaatatccatttattatcactattagtttttctgtattgctctcttctttgtaaatatctctatactttattctcttttatttcctttgtatccaggacagtgtctggcatatgcaggcacacaataaatacttgtttaataagtgaattaaaactctagacagcttctggtaagtttttccaggttaccagtaatacaaagacctgaatgttatttattcacttctacaaggggcacagtgtccaagtcctgacctttaataagagatgtgcttccagcagtgtcttcttggcatagtcttaaccttttattctgccctggtgcacacttaatctctcatgaagtcacagctattgatttataactgaatcttcaagatattttaatactttataaacatacaaacaacaattaattgcattgttagataaaaatgtattacagagatcaccagcacaaaaataagtatttctatttataactgaaaaaaaaactggcaatggaatattagttgtttacaaggcaagtattctgaataatgtgctgggagattataaataaccttaactaacagtaaaaaaaattgtgcttacagaaaaaaattatttgagttagtctaaatgtattaaacttatcagtaagtagcatgaattaactactattcaagtgtaaaattctacttccatattacctaattcagttccatatgaagtcagccagcaaggatcagctgaggttggctgttgtgaggtttcagccattatgaaaaagaggagctgggcacagcctctgatgaataataacatggcatgggttctgataataagcacagagaatcagaaaggaaaaaacacagagaggagtatggagaactggaacctgtggaaaatgatacacaatttttttttttctacagagtctcgctctgtcacccaggttggaatacagtggtgggatctcggctcaccacaacctctgcctcctgggttcaagcaactctcctgcatcagcctcctgagtagctgggattacaggcatgcgccaccatacccagctaatttttgtatttttagtagagacagagtttcaccatgttggccaggctggtctccaactcctgacctcaggtgatatgcctgcctcagcctcccaaagtgctgggattagaggcataagccactgcacctggccccacaggcttcacagtcagtaggcccaaaggaagtctggtgtggtcgatcaagaatccagctaattctcgcactctcactgtctctctctttctctcaccttccactgacctctcttccctcctattttgtcttgggaaaaggcaggtgattacaaaattcttctaattatgtattttaattaatataaaatctttacaaaacagtgttaataccagcccactatggtttatattttttgctgtgaaaaaaaaatctcctatgctttagcaatactttttaggcagagagtcatcaaaataaaagagtatcagtattgctgaagtaggtcattcctgctttactttaaaaaatttcaaaacgtttcatttttcctccgtaaaatttatttctatcaaggaaatggggagagaaaaattacaatgaaaaactgtgaggataaatgaggtcatatgcctatgaaatatttggaaaagaattataattatcaacttgttcatttttaataccatagttagatttctcattttaaaaggggaaggaaagaactccattacattctagggattctaggcaagataagtttccatcacagttgctggatggtggagctgggctggtatgacattctttccttgtagaacgtgcgttctaactgaagactagccctttattagaaatgcacattgagaagacaggggatttatgagtcacaaaggccaagatttctaaccttgctacatgtggggcgggacttttctatgctcccaaggacttaaggtcaagtcactttcttcctgttcccgtctccttctgtcttcctctcttttttggttctaaccagaaaatgtattccaatttttcttttctttttctgttcaagtcttacagctctgccaaaggcaaaatgctgcagggattagaaagatgaagcagctaagtcaaatcgatagtgacagccagtgaacgcatgtaaatttcaacaagtgaacgttcagcattgtctctggggcctcccaccaatattaacatcactaaattttctgatttaacattctcacaaaacaggaatcaaccaaccaagtgccagccactaatagccttcaggttaataaatttggtcttcattaatctcaaattagagtcctggagtagacttatgtttgggataggagtgcccatcctacaagaagcttattacccataaatcaggtaagagataagaaaacactcctccaggtctcattagccacttcagataggctctgcagctctttaatgttcaggtggcatgtccttagaagatgagctgagaatcaaagctcctgatacaggaagaagcctaactcagcccatctctcttcttggggcattcacaattatttcctttaacccttgtgtagtttcagttgtgttgattcaagtcattattttcttacacaactagggtatatagtttagaatgtgatagaatcttggaaaaatagcaattccccattatgtatacacacaatacacatacacacacacagtactatatatgtatgtgtgtgtgtgtgtatatatagatcacgtaaatatatatgatatatatagatatatagagagagtacatgtacatatatgtgtataatatattcttcactttcattttatttgtctttatgatttcaggcagtggtataagaagatagaaatagcatatgagcacttcacacagtatctgctataaaagtttattttgacactttacttataactccttgaaagtgataaaattttcctattttcctgaaggtacatttagacaaaaatctcagagcctaatattttgaagtgttagttttgctgaggccaaacaaaatcaaggcccagcatataccccgaatacattctcacttaccataaatttattatgaaatggtattgtgttgataggagagtttttgttacagcctataacatttcagggattttgatagacatgatttccaatgggataacatttaaactgagatagctactatttttttttaatatatgtttagttttgtgaaaaaaaaaataaggaaagcatctggtgattgaacaaatatgtagtagagctaaagacattttccttaaaagaaatatacttgttttatgctttaatggttagagctgttccattatagtgtatcatctatactcttctgatttttattacaagtagggatacaacttaaagatttaaaagtccttcccaaagtataagcatgtgtttaattttcagaatggcagtgagacttacttgcacataaagttaagatacctaggttgtgggcttccaaggatacttccttgggaagtctttagaagttgtttttagttaaggacttggtagcatcaagggaagccatgagtggtgaaattctcagagagactcttctttctgtggtcctgccttgtagatgacattctggagacttttgtgtgtaaatgaatgattgaaattccatagtatatttgtcatttttcctaagcctgtttactctggggaaaatcttctttcatccttctaagttcttactccacactcccgtgggtgctcatgcatgtgtgcatgcgtacacacacaaacacacacaaatatgcatgcacacatcttcagtacttgaggcattaacctgcagaaccataacaccgtgaatatagcagtaaaggcaattatttctgtaaacaggtaacagggtgtattaatattactgttagtacctctgaattctttcttccttaataggatgtattaatattaccgttattacctctgaattctttcttccttcccatcatgctagagccatcttgaatatgacttaagaagtgatctttacattttgcctctgtctcaaactaggttctagtggctattaggggctagaccaaagctaaactgagaataaggttacgatagcacaattgttcataggtggtctctcaagacaacagcattgcaaaagaaggaataattgttatgtttattttacctatgggggaaaaacagtagtccgggcagtctaaatgatgtgtccaccatcatagaataatagagagtgaagctgtaagtataattccggttgactttgtatccagtaaaatgttcattcaacttttgttcatctctcctctagtcacactttgtcatgcattgacttcttggcctgatctcaccagtgaaaacccatgggaacagttaataattccatgactaaggctattataatcctatagctacagtttctccagtgaaataatgaaaatttcttcattaatttattataaaagttactgagtttaattgtatgccatcctggatttcttacagaagtgattcttgataatcctaagaaaattcttcttcagacagattttcaaaatgtttttgtctctgcaattactgttctgaggttagatcttatagaagttactccataagaagccaaagcattttcctcaaagtatagtggctaatggctatgctgttaccaaaagctgtgacagaaaacctctggctattaaactcatatctaatgctatttggcctagctattatgtacaatttgagaaactgatttttctcttctaaaatgaaacacaaggccgtgtgcggtggctcacgcctgtaatcccaacactttgggaggctgaggtgggtggtaatgaggtcaggggatcgagaccatcctggctaacacagtgaaaccccatttcactaaaaatacaaaaattagccaggcgtgatggtgggcccctgtagtccctgctactcaggaggctgaggcaggagaatggcgttaacccagctggcggagtttgcagtaagccgagatggcgccactgccctccagcctgggtgacagagcgagactccgtctcaaaaaaaaaaaaaaaagaaaaaagaaagaaaaagaaaaaaaaagaaagaaagaaatgattcgcattgtagggtcatgaatttcaacacatattacagttcagccccttctctgctgctggtggcacactggagatgtggagatgcagattctcaccacacaaagtggggtccgtcctggaagcttgtaagaaaagcagaatctcaggccctacctagaacctactgaattagaatctgtgttttaacaagatctcttggagattcagaggtacagtaaagtttgagaagcacagctggaaactgtctgaagtctgctatgatcatcttaatcttgggagctgacttagcacagtttctgcctctcccagcccagcctctctgccctatttaggctacttctggagagttccacagtcagaaccttagctatttctgtgcctggtctttaccacacacaggtccaaagatgcccaggaaagctaaatcatagacttccccctactgagcatgttgggctgcctgcagtctctccctttatcataggttggccctctttccacattgccatgcagctttgaatgactgaatgttcaaatttttcacagtgttttcattgcttaacaggacatccatggctgtaatttttcagtgaagcatagaatgtgttaattaaagtggcaatggaattgggacaggttgaatattaaatgtcacttctattgtgaataccatcatgctcttaacatttttattttgttttcatgaagacttagtaagggttaaaagtgggcgcattagtgagctggtatttgcctgcccaccaatgctgattttgatttccatggcgtagttctttggggtcagcatgcatggtgtgttaaatgttaccggggacctgaggaataggagagccctttccttatgacacttaatcctgaattatttatctaaataattaagggcaagcatttttaacttcgttaacctatagtttctgaataaaagagttattgagagctctgactcaaggacaaatgacaaaagatgatccctggagtcagggcatcaccctccataagtctcactggaggtttgcttcctgcacaaggagacatgtctgtgatttgtgaagcattcatcttgtttcacaagactttatgctgcacttaggctaaagtcactgccgaataagtcacttcactatcaagaaagaaggggatggcttttctgggggagcagaggcatattaaggtagaggaggggtggcgcaaagcagtccagccaagaaaaaaaaaaaatcttactaacaggcttagaattaccagcacatgttgatagcagaaagcagattggcttttagccagttttattcttgtttttaaatctctaaagacaacgtacccacttagtgcctgcacttggggcaacatgctcccactcccacctcctccttggtatgccagtgcagaggagtttgttcacacatttaagatattacataaaatacatctctgaaggtcgacactctcagggaagagcaagaaatgactggagcatcttagctgcaagataatgtcttattcagatatctttactctaggattatagattttttttttttttgagatgaagtctcactggatttcccaggctggagtgcaatggtgtgctcttggctcactgtaacctccacctcccaggttcaagctattctcctgcctcagcctcctcagccgctgggattacaggcattcaccaccatgtccagttaatttttgtattattagtagagacagggtttcaccatggtggccaggcttgtctcaaactcctgacctcaagtgatccacctgcctcagcctcccaaagagctgggattacaggcgtgaaccactacgcccagctggattatagattttgacactcagattactttggctggtctagtaggcaaataatgacaagacatgctcctgccaaagatgtccatggcctaatctccagaacctgtgagaatatgctacattgcatggcgaaggggaagggagactgcagatggaattaaaatagctaatcagcagataggaagatcatcctggtttatccatgtggacccaatgtattccaaggagtctttaaaagtggaagagggaggcagaagaagagagacagagtaagatgtgactaaggaagaatggttaaagaaatgtcgctggtatcagagacaagaggaggaggccgtgtgcttcctcttcatgtgggctatgcatattctcactcataggtgggacttgaacaatgagaacacatggacacaggaaggggaacatcacactctggggactgttgtggggtggggggaggaggagggatagcattaggagatatacctaatgctaaatgatgagttaatgggtgcagcacaccagcatggcacatgtatacatatgtaactaacctgcacattgtgcatatataccctaaaacttaaagtataataataataaaattaaaaaaaagtcaaggaagtgaattagaggtccctagaacctccaaaaagtaatgcaaccctggatggcatcttgatattagcctggggagacctgtgtcaaacttctatcctgtagaactgtaagataacctgtgtttttcttgtaaaagatttcaacatttgctttagattcagggggttacatgtacaggtttgttacatggcatcacctagatagtgagctagtacccagtaggtagttttcctgcttttgcccccttccgtcttccccctcagtagtccccagtgtctgttgttcccatctttatgttcatgtgtatccaatgtttagctcccacttataagtgagaacgtgtagtatttgattttctgtttctgtgttaatttgcttatcaacctgtgtttttaagcctttatggtaattacttatggagcaatagaaaactagcacaatagataaagtcaaaattggtatggtatgtagaacctaacagagcacggtcctggctccacatctgattagtaatgtgcaattggtaaatttctttagccttattatccttatctgtagaatggacataataatatttaccttatggggttaagagagaatgaaataagaaagcaactataaaatgtctgggataatgcctatcagggtggggctgcccaaagatactaaatttgattttatttctttcctcttatacaatttggtggccctcttagtgagtggccccatatcgttaaggcttactgctaactggcccccctgagtccttagaaatatcaccacatttattgatatttcactgtgttcctctgagaacctcatttggccatatagtcttctaccaatcactggagttttcattagtgctagattggcattagacacatggttatagaaggatctagtagattattattttgtaggagacatcatcagtgctcatgttaaatgaatgatacattctgttgaattataaactgcctctcctacacctttgtctttgtacatttcagtccttcttctctattcaaaactgacgaagtaaatcagttgggaagaatacagtaatttatttgaataaacatttgtcaacattgtttaggaaaataagttacaaattgactgtatcgtcatgttcctgcactaagaaagcattaggagtctgcctaaatccttttatcaaaatgtattattattattattattattattaatttttttctatttactctttcttttttaaaaaattgctctcctctagatattttttctgccactctttataataaaggagacaatatttctaactgcccaacagacttcaagatgatcttgacagcctctgtagccaaattatcatattaatttgatctcagcaacacttctggttcactctgttctgtactcaaatccaaatcctgagctttttcttgagcaaataaaggcaacagctgtgaggtcccagttcatctttccggttttacccatacaacaacaggctgtgcaaagttgtgagcaattcacacatagtgctctcaactctatttttattaagtactctgaagagcaagcaatcttcaaactcctataaaatttcatgaccaaaacagctatcgggatggtgtttcccttgaaatgtctctatgagtacagtcatttattattctaggcttcctgataatccttattagtggataccagaactgtgattttaccgtatttgcaacctaatgagtaagtctaccacatgaatgctggcagaagatacaagattcctgggtcagagatgaaggatagtttattgctacaggatagcagaataccagcatttatgccagtccctaaaatttaagtcccatggggcaaagggaagagggccagacaatgcctgcagatgtaataggggagagttgagtttagggtacccccaaattttataataggcagtactttggtccagataaagacatgttttttatactggatagtagacaaacatccatttgctccagttggagacaatacttctgtcttcccatagatgttcactgtgcaaacaattcttgaaacaattgcctggaacaaagttatcagttattagattttttttttttttgagttggagtctcactctgtcacccaggctaaagtgcagtggcatgatctcagctcactgcaacctctggctcatggattcaagagattcttctgcctcagcctcctgagtagttgggattacaggcacccaccaccatgcctggctagtttttgtatttttagcagggacagggtttcaccatgttggccaggctcgaactcctaacctcaagtgattctcctgccttggcctcccaaagtgctgggattacaggcatgagccaccacacctggcccaaagttattagatcttctgttcacaagatacacagaaatgtgagaggccataacaagttgtcaccctacaatgagtttcttagatgtaaatcgactcttcccttcctatgttggtaagaattgtgccatatgaaacatcatcataggcatatgtaatgttaagcttttttgccgtaagagaaaatttttccttgcttccttagcagaatacaggcttcagttatgtgatcaacctgtttggatctgctaggttaaactataaatgcatttttaaaaatactacagatatttcactggacaggaaatggggatggggaagacagaggagagagtgtatggcctggtaacaaagcattaccctttctgttgcacactgctgcccattttaatgttggccagcagccaggacaaagagccaaggcagctccaaaggatctcagagttggaggcaagagagagtcaaggaagctcccacatgctgaaatgtcaaacctaagcagacctggcctcagagtacaacacaatcagatcttccaccatcagagtcattgatagccacactggctcccttgctgtttctggagcacagcagacatggacccacttcaggtcctttctgctggctctggtctgtcataggtacactccttcacctgatcacccagggatcgctttcttatttccttcaagccttcttcatccaagtactgaccaggcctcacactgcttagcttccgagatcagctgagatcaagcacgttcagggtgataaattagttcaatcactgtggaaagtagtttggtgatttctcaaagaacttaacacagaacaagcattcaacctagcagtctcattactgggtatatatccaaaaaagcacagattgttctaccaaaaagatacatgcactcacatgctcatcatagcactattcactataacaaagacatgaaatccacctagatgcccatcaacagtggataggtatacatatgatacgtatacaccatgtaatactacgcagccatacaaaaggtatgaaatcatgtcctttgcagcaacatgaatgtagttaggggccattgtcctaagtaaatcaatgtaggaagagaaaaccgtatgccacgtgttctcacttttaagtgggcacaaaacattgggtacccatggacgtaaagatgggaacaatagacactggggactactagatgcaggaaggtgggaggggtgaaaaagctaactattgggtaccatgctcggtagttgggtaatgggattatttgtatcccaaacctaagcatcacataacataaccaagtagcaaccctgcacatgtaccaatgaatctagaattaaacttgaaaaaaataagtaagtaaaacataaaacatatagatttttaaaaggcatcttcaaatgtcaccttgtagtgccccaccctgaattgtagtcacctacacacataaactcacacacaaacacacactcccatacacacatcaaaacattcaatacacctaccttactctatttttttttctgacttccaacatagtacatcatttatttaacaagaacgtaagctcaacggggaggaattgttctctgtttattttctgatgtttcctaggtacctagatcagtgcctggtgcatatataaatgaatattttgagtgaatatttgtggaatcatgaatgaatgaactgatgaatgttaatattggtatttttcattgttatttgtcttattcctaggaagacaggactagtcatttgaggtactttttcagaacagccagggctggggaggatcctttatttgtgggtgttaaataatagcaagtgaacacagtgcagcagtagtgaccctgttgatgatgataatgaatcacattgatatagtgcttttctttttctacctttgtgtgtgtgtgtgtgtgtgtgtgtgtaattctcctcagtgtcagggtgatagattatgcccattccttctaggaaaatggttattccatcttaatgcaggcttttagaaatgaaaaataatgcctgctacaatcaacttttaattatctacactaatggagtgctgatgctaaagaaataatccccaagtcatttacatttgactttaggatgcaaccgagggcttgtattcagaaaagcacgttaaaccatcgtcagcagcatgtgattgcagaacaaattctggcctgggagttgggaaactggatttggtagaggctcggtgttatgggttgaattgtgatgccgcccccctgccaaaaagatacgttagaatcccagcccccggtaactcagaatagaaccttatttggaggtagtgtcttgacaaaggtaattaagttaaaatgaagttgtttgggtggaatctaatccaatatgactggtatttttatagaaaggggaaatttagactgagacagagacatgcatacagggaagaatgccatgtgatgcctggaattatgctgccacaagccaaggagctactgcaagttagcaggaaggcctgggacaggcccttctctagcacctgcagaggaagcagccctgtggacaccttgatctcaaacttccagggcagtaagacaaccatgtctgtggtttaagctaccccattcatgggactttgttatgacagcccttggaattgaatatgcttggtgactcaactcttatgtgctcatctagcatacagttccctctcatctccaagcctccgtttcctcatccctaaaatagaatccaaagcccctagctgtttaagggctctataattagaaagcttctgacagaaagtccccatcagctcctcccagtttagcagtaaacccatccacctaggtgtcctctaaattaggtaagtgaccctagaagaaagttccacacatcatctgaaccgcggataaaatgcatgcagaaatgactttattcaaattcaagagtttacattttacttaactctggaaaactcagagtttaaacattttcacatttttttttaaatagcaagaatggcatgccacatcatgatgattcagctctcatctctatttctctaggcagaatgcatttacacatcatccaatcccaccctatttccatgtactattagcagaagcaaatatcagccttcttcaggccctggcaggataaaaattcagcccagtagacactgggaggacaagaatgaggatgtgacttacattccccagggccatggcattcaaaaccaccatacccactgaatgtgcttctctatcgctttgtttaatatttggagagtagtgtttgctccaaaacttgtaaaaagtgagaccaatggaaaccattggtccaaagcaatcttacctgagaaacattttaaaaagaagtctttcccttatgattcctcttcttactctacttttttgaataaagagattaatacccaaccgatgactactgcaaggatgaaggttattctttaggagaaaaaaaaattgtaacatacatttttatgaaaaaaagatttctaaatatgctgataaaatcactgacatctcagtaaatatagtttattcctaggaagtgactagaatgattgatttagctatatgtaagttatttaatactgtttgaaaggtacttcatcaacaccatttactgtgatcaatagcattttcaggaacacttcagacttggggaggttactcctttgggtaaccttttaggattatctgttgtgggaacaagaagtagccatcaaaagccactgagcaggctgggtgctataatcccagcattttgggaggctgaagtgggaggactgcttgaacccaggggtttgagaccagcctggacaacatggtgagatcccctatctacaaaaactatattaaaaaaatttagcttgttgtagtgtacacacctattgtcccagttgctcaggaggctggggtgggagaatcacttgaccccaggaggtcaaggctgcagttagcattgcttgtgccactgcagtccagcctaggtgaaagagtgagaccctgtctcaaaaaaaaaaaaaaaatgtccctctaagcagttaaaataggtcaacatcaaagctcatggttctggctcttagtcaaagcctatttatatctgacataattctcatatattgcatatattgacctgtttggtttactaatccacattagaggccaacagtatagaaccagaatcagaaaatctattaaaaggaaatgaaagaataaaaaagcatggcaatatcaggccattaggtgtgggtacaaataatctcccaaaccacagtagtctctgagtgtttcactgacaaagtttagttatcgataattataattatgaccttgaaatcctagcgtagacattgaatactatgtttggaagtcagggaattgtttaatatatttaagaaagatattcccttcaaagcagttcaagtggtcttagtattgccagttaaggaagtgggttacaggatcctggaatgactcagtgatatagaaaggctcagtccctggcaatgtcagatgagtgaagaggttgatgcaaaagtaattgtgatttttgccattacttttaaatgtaaagtacaggcactaacatagtattagttactaatagtattagttatttagtaaattacttttgtactaacctaatactatgttagtgcctgtacaaataatgtgcagtaaaaacaatgagtgtgtgtgtgtgtgtgtgtgtgtgtgtgtgtgtattggaaagcagttgatctgtacacatacttacagtttactaaacaaatgtttgagtgcctactgtgtgtcttgctttggctgtgctctagacagtcatgataacagagatccctggtctggggaggtcccactctcagagcaattacggaagaagggtagaggaaatcatgcaagtatgtagggataggctgatgagagcggaagcatgagggctgagagctgcaggctgtcttcccactagtcagggaaggctttctgattaaagaaaattttcatcacctatgcttagaagtttagactcagaataactgatggcaaatggaaaagatgaaataaactaggatgagaagacaagactgcccaattcacacaatgaatccagtctctgaatcagtcgggtgctagccaaagcagaaatatttccagcagagccctgggaacagagaaggaggcagtttttattaaagtcttagtttccaaatgatggatgccaacaagaaaatagtttaaaattccaagagaagccttcacctttcattccattgtagagtaatggctttttcaaacacattcaaataaagccagggttgttaagtagtatgtctcaatcaacatactcaaagtctgtgaaccaaaggcatagtcttaggcttcctcttatagtctagcatgatattattctatttcatctttttttatatgtttgctcccttgagtgttttagaatgagactgctagattttatgtttctaaagctggttttctaccaggcctgttctcagaacattcttttttttttttttttttttttttttttttttttaagatagagtcttactctgtcacccaggctggagtgcagtggcgcgatcttggctcactgcaaccttcgcctcccgggttcaaacgattctcctgcctcagcctcctgagtagctggaattacaggcgcccaccactaaccccatctaatttttgtattttttagtacaaaatgggatttcgccataatggccaggctggtctcaaacacctgacctcaggtgatctgcccgcctcggcctcccaaagtgctgggattacaagcatgagccaccacgcccagcctagaacattctttcttggaaaggaagaacatcacagccttctgtgcattctcttgttcacccacataggcaaggtgatgtgtttgcagccttctttttaccctcacctctgggaggtggccttggctcatcacctattgtttcatgctctctcttaaaggctgatttggtgactgaattcatcattgctgcctacacacccatggggctagcctgggcaaaatgtgcctcgtaggttgcctgaccttttgccttttggcaacgtttatcacctctgaggattcagcttctttcgtcagaaagtgagaacttggatcaggtcatctctaaggttcctttcagttttaacctttcagaagtcacacaaccataaacatttggtgtacctagactgttggcttattgtccgactttaagccagtcatttcagttaaacaaacaaaaatgggggcttgccagagtcaagtcatacaagactgctttcctaatatttggtgcttcttaaatgaagttgttatttatgcatccctcaatcccctccctcttctgcatattttgaacttgcaaagccttctgatattttaagcagaaggttgcaaatgcttgtcctactgcctggccaagtcttaggtaaaaattgtcacctaaccacatcctcagatcatttcccctgtactctagatcactaagcgcatgtgcacacacacgcatgcacgcgcacacacacacacacacaccatccaggatcctcctgaggatgaatgaatattcctgggccaaatattgcatgaggatttgggcaatgttttggctagttgaacaacaacaatgctcatatttatgccaattggcaggaccattgcttgatcatcctgtacttggtgaagggcattttttattgtttccttttttgtttgtttgtttgtttgttttgtgaggcagaatatcaccctgtcccacagactggagtacaatggcatgatcttggctcactgcaacctctgcctcctgggtcctagcaattctcctgcctcagcctctcgagtagctgggattacaggtgcccaccaccacatcgggctaatttttgtatttttagttgagacagggtttcgccatgttggtcaggctggtctcgaactcctgacctcaggtaatccacctgcctcggcctcccaaagtgctgggattacaggtgtgagccaccatgcctggcccaagggcattgttttctaatccagataactaagctatccttagggtgatatgtaatgcagcaattgctagaaaatgacatgttttcataatggatctttctccaccatctagaaatttaggtaaagttgaaagaaaggataggaggaaccatttactgtgcacctactttcttcctgagattttatacatgtcatttgatgtttacaccaagtttttgaggtcaatctcatatccaaagctctaatcaattaactttaaattagttaatgacagggctctcttattcttaaacctgtcatttcccctaaactatgttgttttcctaaagtgagattaaaagtttgaaaacaaaggaacaaaatgttcatttatttactacgtttctgaaaacttgcatatatcttaatatatatatatatcttatttatatgtcttatttcattgttatgaaaacctagctttctttccttctatcctttcaatattatgctacttgtatttagtatttacattgtatgattcaaaatattgttcactgcagagccaagtagtagactatgaccgctctgcttattttgaacaatcttttatttttttctggagttgataattgcttcagatttttgtctggctttttataagcctgttgataatttcctgtttattctaatgtctgtcatatgcctatccatggagttaacctagtttcattttgtttttcatggccacatctttatcctcctttctgtgggggccctcagcttctgctttaattccagctagatactttctgctttcattcccgctatatactctaattccagctagatactttctgctttcattcctgctatatactttaattccagctagatactttctatgtgggctgcaaaggtgtagccctgatacttttctcatctatcatcctgagacttcatcttacaattaccctgttttccaaatctcatgccttctacttccttcctttactctccatttagaatatttttcagcagcttctaaattagcctacataagacataaactcttagatcttacttgtctgaaatgtctttcacatatgattggtatttgagctaaacataaattagagattgaaagtcatttctcttcagaattttgaagacttctctactctttttctttctgctgttgtttttgagaagtccaataacatatttctaatcctttgtattttgtttcctctctgaaaactacttagatattcttttattacaaatattctaaaatttagtaatttttaaaattctctcattgttttaaactttttttttgagtggagtttcactctttttgcccatgctggagtgcaatgacacgatcttagttcactgcaacctccgcctcctgggttcatgtgattctactgcctcagcctcctgagtagctgggattacaggtgcgcaccatcatgcccaactaattttgtattttttgtagatacaggatttcaccatgttggccaggctggtctcaaactcctgacctcagatgatctgcccgtctcagcctcccaaagggctgggattacaggcattagccactgcacccggcctgttttaaacatttaatggactcaccagggaattttcttgtcttattactttgataatttcctccactccattttccctctaatatttttactttcggggattcctatgagtttgacattggttcttctggactaatgtttcctctagtgttttttgaagatgtctttttggattaaattctagaaaccgcctcaactttatatttcattgttgctcttgatggttttaatgcagatactgaatttccaagagtgctttagttgttctcttagtgttcatttcatagagcacgttgttctcctttaagaggtcatatcttctctttaacttccaggatttttttaaccgttttgtctgttctttatattatgttacttttctctcatttgctccacttcctccccaccccacccctgtttatttagatctcttcctttcatagtgaaggttcttctcaattcactagctacctcaactgtccctttgtatttgagaacaaggcattgagaagcattattttggaagctctgtgtgcatgaccaggacttgtcaaagactggagcttatcacaaggggatcagatagaaagctgtcttttctataagaggcattcccaatgttagtgtctgcaggccttctagaactggaagcagaaagtccctcctcggcatgtagagtctcactcattcccgtttgcattccatcacctccctgccctgagccctttgcacttgtggtacatgttgtttgaagtatgatgcttcattgattagattccttcaggggtaaaatctccattctcgtgtggggaaggtgatactttaagtcacctggctgtgcagcaacagagagggaccaggtagtctaataacaccttatgcagacttccaactcttgtttctcactataccttattctataaacttctggggaaacggctttctttgaattctgagcctttcttaggtatatttcaggccaacttacttgtaccttgtccatacacttgtcaactggcacccaagttcaggcagtctccattttaatcaatcagctgctgctcatccacctttcattttatcttccaaaatattgttataattcttatgcattggttagcttcttttctttaactttgtccttgtggattactactcattttggtcttttattgttactttagtggcatttcaggaggaaatggaatggaagtgtgaggtcaatgcagcatatcaaccagaatctagcctgaattgcaactgtctcacaataggtgccggactctgcagttatggttctagatagtacaaaatttcctctctcttatgagaaatatgaaatcatttaaagcagttaccttttctaaacaattccatggactctgagtcaaaataatttggcaatcatttattccaacctctcctggatgcctaaactatatccctaagaggtgattttacaatcttgaattgaatctctccagtgataaggaatttacttacacatgaaatgattcattacattttcaagtcatgttgtggtaagagttagagtgcttctaagtatctttgttaactcctaaaatctgagtcttacaaataactgacttatcaagttgtaaaaagtaaagagaaaatccccatttctcctactttaaatagaccgtagaaaataatgatgtccaaatttgtcaaatacgtcaaactcaactgcatataggaccattggtgtacttataatccaagaagtgccaacacaaccatatggcatcagttgaagggacctcaagaagttaatgtggatttcacagtggcaaggctgatggctttagtcttgctgaaagttctgcttgtttgatgagaaatatttatataatattttcagaggcttatttcttgtatgtaaactctcagatgtgaaagggaattcatttgctgcatattgattagctcgttgagtgttaatttctcatggttgtggtctgcatgagagaactacaatcagctagagtcaaagaaaagtggatgcttccaccagctgatttttattttatttttatttataatatggaacactactgtaaaagaatctttgcctgtctttccactttataattataaagaaaaggaaaaaaagaggttagagggcccttcaaggtactttaaaatgtttttttcttagcaattcaaaatgtcctagtgaaacgggagagttccctgactcccttcacaggacttgtgacaggggtgtcttgtttatttggcctcagtgctcaaaccccttatgggatggggaacatgcaggtgcacaggagcagaagccagggtgagtgcttttgggctccagccccacagtggtgtctaggggtgttacaatgctcttttagccctgccatctggagatggcttaagtgttaaacagctcagtgaaaagtcagtgtgacagccttttggggttcccatacccagtgtgtcctgaattcttgttcagtgtccatgaagaatgaggtcatacagacctgaaggctggtgaatgtggggattttgttgagtgatggaggtggctctcagcaggaaggggaacgggagaggggacggagtgggaagatgatcttcccctgtagttcatcggtcccgtagctgatttcctctctgtccacagctaaactcctcttgaccttcagacacttcctctcttccctcctctgctgcactgctctgctgctctgccactcttctgcttgtggagcctggatattggggtttatatggatgggcacacgatagggggttgcagtgggtcaaaaggcaacatttgggtgcaaaaacaggaatgcctgttctcacttagggctgcaggtctacgcttgagggtggaaccctcgccaggaactcttttgcctcctgtccatatcactaggaagaccattgatgtgtttgatctttgtaaaactacatatgactctcaagttgcaagtgatactgtggttcagcttatcaaatactggaatttggcttctgtcactgactctgccactggctttgtggtcctgaacgcagccctgatgtcagatgtgttggtaatcttggggaactttaagcaagccagctttttttttttttttttttttttttaggactagatggaggtaagggaaagtgtgagacaataaaactggcaaccagaaacagaagaagaaaggaagagagaaaggaatctacggagtgtggaagttttaggagtaaatttctatataagttgcaaaattttagtaattctttagttcttatttcatttattcacttattttttttttctttttagacagagcctcactttgtctggagtgcagtggtgcaatcttggctcatgcaacctctgtctcccagcttcaagcagttctcctgcctcagcctccccagtagctgggactacaggcaccagctaactttttttatttttagtagagatgggatttcaccgggttggccaggctggtctcgaactcctgacctcaagtgatccaccttccttgtcttcccaaagtgctgagattatagacgtgagccaccacacccagcctcattcattcatttattcattcaacaagtattaattgtgtgcctactataggccaagtgtattttgggccaagtgcatttctatgagctaaggatatagcagggaataaaacagttacctccatcctcatggcacttacattcatgtacctgcaatccccatcagaatcagcaactaggaagagatgatatcagagcttgaacgtggatccagtaatacccatggatagttctgtggaagtaccacagagaaaaattcaaaggaaagaggaataggatatattgagatacaaaaagtgtagcaatggaaaatcaggtgatcagattattgagaatgaaatatctttagtaaagatttgaaggagttgagtagagatatctcctagatatctacacctacatagaagatcatgccaagaggaggagcagcatgttcaaaggagagaatgggtatgacatgtttgaagaatagtcagtagtttggtatggctacagctgactcagtgagatgggaatgaggtcagaaagatgaggaaagggcagtccagattgtgttgggctttgcttgcaaaaacttcagctcttacttggtataagacagcaaaccattgaaagagtttgtgtagaggagtgacatgatctgacttcttttttaacaagatggctcttattgtatcattaacagcatggttttacatgaacctatcgttttgtttagtttgtgggtcaggactgaacaatgaaagtagaagcagtcctgtgacagtggcactaattacatttattgtcatagagaaagctcatgccagtcacatactagtcagaggagttttcagtcctaattgccacagaacaaatgactttggatgttaaatggactatagtcccctcatttgcaaagtggggatagtagtatctatatagtgaattatgagaagtaaatgagaaataacatttgtgaaaatgtctgacaaaatgcctgaggtgttaacggatcttttaaaatgttaactgtagcctcaatggattgtaagaatatacacatttaaacccattgacataaattatggctagaatgaaagttttgatcatcttgatgatagtttttgtcttttgggtttctttcttgtgtgttctatctgaagaaaatcatctgaaatccctcatttagaaattgaaatattttatgtcagcaagcacatatgttaatgatttcctgaatcagaaatgtgttcaaaatcatatctatagcaatgatcaccacagcggtagttctattagggaaaatacacgaaaacaaatataaaacaataacaaattaagtaactaattaaataatgtgtggcatggaaataaatgaaatactgtgcaaccttcgaacaccattttatagaacaaataatcattggagaagtagacgtgatatgttgttaagtaaacatatcatataaatggcttagaggcttagagatgtgtaggaaaggaaatactctaaaatgttaacaagaatggtatctctggtgcaattaaaagtctttttaatttggatgggtttttttatattttacaaatatttctgcattgattctacattacttatgtaatcaaaggtgcccaatacgtgttacttaaagaatctcttcaataattagaacgtaggcactcaatgctcatttttttccccagtgattctctgaacgtgtgttactaccatccaggagcagaactatatcttgctgagacatttgtgataatgacaaaacgtttcaatcagaaatttgagataaggatatataaatgattttttctcatgagaaataaaacgcaggtgtgttcaccaaaatcctgctcttttactcaatccccttggccaaaagtaagcacgacctctctggcattgtgaacaaaaagaggaattaactcaaaaagactaattttatgcattagatgatcctttagaataatcaagcatatgagtattagggtaacttatcctttttacttttcctgagggaggtaagagtagcaccgacttgctactgctaaagatatggactattggcctgggagggtaagcattttctgtctgatttaattaagaccactacctgctgacaaggctttgagaaagaaacaaaaataaggaatgcacaaataaaatgtaatgcaggtcaggcatggtggctgatgcctaagtgggaggcttaggcaggtaatcacttgaggccagaagtttgagaccaggctgggcagcacaccaagaccatctctctacaaaaaaaaaaaaaaaaatacaaattagccatgtgtggtgatggatgtctgttgtccagctagtcaggaggctgaggtgggagaatcccttgaggccagttcaaggttacaatgagctatgatcatgccactgcactccagcctgaacaacagaatgagaccctgtctcattcaattctttaaaaatctaatgcaaaaacattagaactgaaactagaaccagttttattggaagatgatggaaaagcaccttgtgatttatctcttttggtagcagagagctcatgatcgtccatctaactcccacaccatcttggagagccacagggtatcctacattatcctgctgaagatccttcagtacctaatggctctcgtgaagcattccaaagtgaaagtcatggagcctatgccactaaatcagatataactagatacatgttggattaaaaggaaaggaggaaaggcatagaagggaaaaacagagattattggagaccaaatacctctataaattctcaaaatttgtttaaaggctttactttttcaagatgcatattttggcaatagcttacgaagactgaagttttcttatttaatcttagagatactaatacttagaaaagaaaagtcttctatcttgttgaccttctctgtagccatttgaaatcttcattatcagaataatgcccctccatgtccacaattattaatttttatagatttagggggtacaagtgcagtttcattacatggatgtattgtgtaatggtgaagtctcggctttttgtgtagccatcacctgaatatagtgtacattgtacgcattaagtaattcctcatccctttcccacaacctccacccttctgagtctccagtgtctataattccactttctgtgtccacgtgtacacgttatttagcagccacttataagtgagaacatgcagtatttgactttctgtttctgagttattcatgaccagaattattattctaattattgtgaaataaaaattatgcctgactaaaatgactgaatccagaacttcaccataatccatctatctcctccgtgagtcagtgcatattacctattccaatgacctcttcagtactgtaaatattactgtgttccttttatttacttaataaatagatgtcaaatgtgtggaaaacaacatttgttttttcaaatacatgtttataacaccctttggaggaagtaagcctctagaacatgacagtctctggggtatgctattttcaggtaattttaaatgtcgctttccaacaaaaatgcaatactattatctttttttttaatgacaaagaaaagcaaaacaagtattatattggtgcaaaagtaatgcagtttctgccatttctcttaatgccattactcgtaagggcagaaatgaccattacttttgcatcaacctaatacctccagattttagatatttgagtgccattgcttgatatatcttttgttttttcttctggaaattttggttactttagttgcataaaggatgacttccattttaccctgttaagcatctctgtctggtcagaagctactactctgttctttctagttcagtagggaacaatcagtttccttctcaattttcagctaatctttatgaatgaaatttgattaaatctagcaaaactatgcaaacatcataacagcatatggggagccttcctgtagtaccagtgggctatttccgtctaataacagattcaaaaaatccaattagacagtttgaaaaaagaaagccagagttaaaaatatctgactgtttgactgagaacagcagggaatggtttataggccaatcatttatggtgaataggatcttagtggtgagcaactcacatctctagcccattagaataatgtgttactcatattgctcctaaagctttctacttaattataccaagttaaatagcagacattctcactcccttttgatggaaaatcacatttattcacccacacaataccatccttgggtgttaagggatgagagttgacctaatgggaagacaaacaaatggtttaggaaatgagacatgatttttttacacaaaggttaatgcacgagaaaagaaatgcctaggtctctgtctaatgtctatgtgttctcatcgaataattcttaaatgaccctatttagtttgattttctaactacattagaaatatatgaaacaattaagaaatcattttttacctgtcatatggcagatggactaacattgatcagggcagtcgaggaggttgtaaggaaatgggtactctcaaacattgctggtgggactatgaagtgttttaattttttttttttttttagacggaggtttgctcttgttgtccaggctggagtgaaatggcgtgatctcggctcactgcatcctctgcctcagcctcccgagtagctggaattacaggcaccctccaccatgcccagctaatttttgtattttcagtagagacagggtttcaccatgttggccaggctggtcttaaactcctaacctcaggtgatccgcccacgtcggcctcccaaagtgctgggattacaggcgtgaaccaccgggcccagccaagtgttttaatttttaaaaactatttgaccatatgaaaatatagatgttccattaaatatatatagcctaagaaatataatcagcaatgcagtaaaagattatgtatacggatgctcctgacagttggatttacaatagggaaaagctggaaacaacctaaatatttgaaaaaagagaatggtaaatacatcaaaaatacaataaatacagtgttaagtgaaaagtttgtgcaattttgacttgagaaatttttaatgtactatgactacttggaagaatatggatgtacctcaaaataagtaatgatctatatgaaagactgtttttgataatttttgttttcttatacataccttccaatattgtccaaattttcaataataagcatgcatagcctaatatatcatgtagatgagtgcaaaatgaacacagagattaagatcatgggcttttcaatgaaggtctgagtttgaatcctgtctctgccatttactagcaatataatttcaggaaataacttaacatctctgctcttcagtttcctcatctgaaatataaggataataatggtatctgtgccttaaggatgaccaaagttatagatatcttaagaatgaattaaatgcgtttctctccatggactattttaacaatgaatgcctgacatagcaattatgttccataatcaccattatttatttataaaattatttagtattatttaatactaacattctggttttataaaaccaaattttaaaaatagataagtaaatgaaaggacaaggaaaacctaatttcactgtttttctagctttttttattgctataacttttatatcataaatccacccatttgaagtgtatagctccattttactatactgttttcatttataaaagccttttataaatttatacatacctttcagtgttgtttgaattttccatagcaagcattcatagcatagtatatcatgtagcagggtttaaaataagcatagaagagggtttcgccaaaagattatttaagaaaatctactaaaagagggttcttctgaaaaataaaatgtatttgcttttatcaaatgagcaaacttcatccacttggagatcacccacatgtgaatttctttctttctttctctctttcccttccttccttccttccttccttccttccttccttccttccttccttccttccttccttccttcttactttctttctctgatggtaagttacattagaggacaggaaggctcagtgatcagttttgatgggatggctgcacagaggcacatggagaagaagcaaggaagccaccttcagcttctgggtctctttgttatacaggaaaggaagtcaactggggtaaacctgtttggaaaggattgagtccttctctcaattttgaagggatgattttttagttcttcagatttatcttctgtaaataaatttcttcagaagcttcctgcaatatgataaacacaaatgattaggaagtgttttgtaaggattggggactaaagaaattattgatgaagccagaatgtgtcaaaaaggtgtcgtaaagcagcaatacttaaacattttggtctcagagtccctttacaatccaggacccaaagaggtttttttgtgtttgttttttgtttttttctaaaatgggttatacctatcatttttttcatattagaaattaaaactgagaaatgtttgaacacaggaatacccaagtacatattccagtgatcagcagagcaatggcatcatcacatcatattgcctccagaaaatcccactgacaatttgttgaagactaaaagggaaaaagccaaacaccttagtatgctgtaaaaacagctttcatctcacagacctcccgaaagggtcttgaagatccatgagcaatccctggaccacactttgagaaccgcttttgtaacgtgtgaccttcccttatcctctgccatgcgaaactatctcagaatctaagattgtctacagccacggtacaaccagctctgagactttgaagagaagaaaagatgaacttcatcactaaaaaagccaaagtagttgaaagcaaacactagctgaattttcttcctccaagcctacagaccacctcacgtagtagctgtagtgggagctgctcccaagatttgataagaattagtaaagaggtttataagaccgtgtgtgcagagtctcacagttgctgatacttgttgggcttagctttatctctgtctacagtagcagcccaggacaaaacattcatatgatattctctctttcttctttaaccatagataaatgtcccaagaaaagggaagagaaacagaaaaatcatacatgctaaacaccagtttattaaatatatttgttgctgtttttcttttttacttggttgctcacaatattaatacaccctctttataaaacatgaaagcaatacaaaagtataatgagtaaaatgagaatcctaaaatgttttcttccataatcctctctctaatcgcatttctcagagataactgtgttagcattttggtgtgtttcttatagccctttttgttgtcaaaaataagcaaagataaaggggaaagattttgttctgtttcttttttctatatacacagtatatcttggagatagtttcaagtgccaaatacatgcatttatttttttcacagaatgcaagtcatgtcatagcatggatgaagttgggtttatttaatcattcactagttggcaggtatttaggttgtttacagtttttccattttagaaacagtgttcccatgtaaagaatgtcccttgtgcataaatcgttgtgacatgtgttggaatctcaaaagtggaattgctgagccaggggcatcctcattttaaaatttaatagacatcatcattatcctctagcatgcacatcactttacacaactgatggtaatttatgaggaattctatgtcccctcactccaacactgcatctagtcactctttgaaaattgtccagtctaatgggtgaattatggcatcttgctttgttatgcatttctgtgattaccagtgaacttgaacatctttccatatttttatttatgtttaacatcgaaacacgttacgttttgaatattttcctctactctattactgccttttatccttgattatagtttcttccatcacacagcaggcttgaatttttgtgtacttaaatttgccaatcttttcatttctggttcctgagtttttttgtttaacttaggaaccacctcctcccatactatctccaaggatagaaaaatactgttttctcctagagcttttgtgaactttattttttacaattatatctttagtccattgatggctgtgccttttaaataatgaaaagtccatatttaagttatttttttcccaaatagataaacatttgccttacaggatttagtaagcattttatcctttcttcctacatttgaattgccacctttaacacagggatattaggtaacttaagaggtaaatgtgtgtttcttgaatcccagatctaccacttaaaaattatgtaaggtttgatttactgattcatttttcctgccccaccaacttcatgaccataaaataggggcaggggagaaggaaatgataagacttagcatattataccatatggaaattaaataatacacataaaatacttaaaatagcgtcaggcaatttaagagcactcagtaaagttagctcttattaaatttttgcaactccatgtatacctgggatctgtttctggtttgttcatggcagcattgtcaactaaaactttctgtgctattcagtgtgatagttattggacacaatgaccactgaaaacatggctagaatgatgggaaaattaaaattttaattaattttaatttaaagataaacagccacatgtggtcagtaagtaccatattggacaggagaatgcccatatagtattttccatgagctttcatgagttatgctttattatataaaccagattttatttaagaactcatatggactagattatgaattttatgagatgattttccttgagtcatcaagaagaacacagtttttttctttaatctgttaaagttgggaagtattaatataaatctagttcctacttgaaatcaacattccagcaataaaccttattggttcttgttattctttgacctcacggttaaatttgatttgctaattttggttagagctcttctatattcatatttgagattattttaaatttgcattgtgcattgactgtgagatgagtattttgttggcttggtaaaatgaattaggagacttcatattctaaattctgaaatagtttgaatattggagttattatctgttcttgggagatggtttttatcaccagttcccctaaactcctttttaccttgaggtaaagcaaagtctaccttactatttcttgtatggtgattggctattcaggttttctatctattattaagacaattttgaactcactggtgctccaaagaaaatctgaatcattctattacaaagatacaggctcacatatgttcactgcagcactcttcacaatagcaaagacatggaatttacccaaatacccatcattgatagactggataaagaaaatgtggtacatatacaccatggaatactatgcagccataaaaaggaagaagatcatatcctttgcagggacatggatggagctagaagctattatcctcagcaaactaacacaggaacagaaaaccaaacaccacatgttcttacttataaatgggggctgaaaaatgagagcacatggacacaggagggtaacaacacacactggggcctgtcggggagcatgggagggagaacatcagaataaatagctaatgcatgttgggcttaatacataggtgatgggtcgataggtgcagcaaaccaccatggcacatgtttacctatgtgacaaacctgcacatcttgcacatgtatcccggaacttaaaattttaaaaaaatttaaaaaaaaagaaaatctgaacttgggtagcaatatctctacctaatgatactcttgatttttaagtacttaaaatgagtctgaaactgtagaggaagaaaaattcttcctaccaccctcctcctttctctggctggggctttgtaaattggactgacaaagacagcttaacaagagagaagcaggagtttattagtgtgtgcattgggctcacacgtgggagcactcagacgtgagtaactccaagggctggtaagaccttgagctaatatagaatctcagcaaaggaacaataaatttttagagaaatgacaagacaaaggaacgaactttgagtttctagggtggcagactgtgggaaagcaaatatatgggaaacctattgtagataaagattagttagggaagtttatgtggatgcctgtggttccgtctctggactcctaagggtctagagttgtctctgatgattaacttttatccttcctagtagagaggggagggaaaacacctttgcaaatttgtgtcctgcttttaggcaaacaggggcagggcagagagcttttcttatagctgttttctctcaaaattctgtcttcacatcaaaataatcccaatgccaaagtggcgtattttggggtggcatattcggctaccctacaggacctatgcaaagatatatctttatatatatttaaaccatagttttcaacaaagttggaaacaagaataaggattgatttaaaagatattatatagccattgacatcatgctgcataaaacctatttaattctcatctaactggtagattatacaaataataacattgctttcctttggatattagcattggaaagagtgttttttgccagccttgatggtgcacccctgcagtcccagatacttgggaggctgaggtgggaggatcacttgatcccaggggttcgaggctgcagtgagctgtgattgcaccactgcattccatcctgggcaacaaagtgagacactgtcaatcaagaaagagaaaaagaaagagagagagagagagagaattctttttccttttctttcaaggaaaaatcagaaaatgagtggttgatcttagttcaattaaagaaaacaaaacaaacctgctgggtgcctcctctgctctaaatactaagcaagaaataaagtgaataagcccctgccagtcatgtaactaaactctgaatgagggaagtagctaaaatgttacacataaaagaaagctgaatgggaaaaatgcatggaaattatgagtttagggacattttcacttggccaaatgccccattctctttctctacttccaggtcattgtgataggtattttaaatgaacttgaataatcccttaggacagggttgcctgaggaaatgggggacacccagtcaaattggaatttcagataaacaacaaataatttttagcagaattgtgtcctatgcttacttatactaatatatatacatatattttatttgcctgaaattcatatttatctgcactatatctggaaacattaagaataaattgtaacatcttgtatttgtataaggcaacattttaccaatcttttcttcagaatactagttttatgaaactcagcaaaaagggctatgtggtcccaaaagttgagaaggcatttcgtgctatagctcctcttgcttacagctgttaacttggagtgataatcacctgttctgacaaccagcatagactggactccttctagctgttaacacctctgcagcaggactgagaaaggactggagagccacgtgctatggtttacacctctgagcatttgctgtgtgccagccatcacactacatgctttacatacttcatctcactaatcctcacacacttatgaggaaactactgagagtgtatgcatgaggaaatgcctcagagaggttcagcaacttgcccaaggtctcacagttgtaagggacagagtctgaatctattgcctctatacttaatcaataaagattcattatatgcattagctcatcaaaggttctaagatgtctagagtaaggaaaatttttgactttgtttaaataaccatttcctggaagcaccatcgaaaacattggtagttgcagggtgcagtggctcacacctgtaatcccagcaatttgggagaccaaggcaagaggataacttgagcccaggagttcaagccccatctggccaacatggtgaaaacccgtttctactaaaaatacaaaaactagccaggctggtggtgtgtgcctgtagtcccagctacttgggagtttgaggcaggagaattgcttgaacctgggaagcagaggttgcagtgagccgatatcatgccactgcactccagcctgggagacagagcaagactctgtctcaaaaaaaaaagaaaaataaaggtagggtgttttatatttatatctacataaatctatacattatctagatattatactatattatggaaatgtatatattatattagaattaatatttctaattatcgtatacagttatacattttattgtgttattataacatattatatataattggttctgtttttctgaagagccataaataatgcattcaatttagaagacaaactcttttagttggaatgagcctaataaaaataattaccatcccaagccaactttaggttattatttgtctctgacagtattaaattatcattatattaaattcctagaagcactatagaaatggcagcagagtatttatattatatataatataggttatattattagatattaatatattacattacaattgtattatcatgatattatatataaattggttctgtttctcttgacaaccttactaatacatccagtttagaacataaattctattagttggaatgagcctataaaaataattaccattccaaaccaactttaggttatcatttgtctttgatattattaaattattattattttaagttcctaggagcacaatagaaatgctggcagagtgtttatattaaatataatataaattatatttttagatgtaaatatattactttatgatgacattattgtgatatatatataatataatgagttctttttccctggagaaccttaactaatacatctagttcagaacataattctattagttagagccagcctaacaaaaataattaccttcccaaaccaactttagattatcatttgttttcaaggccatggttctcagccttagttgctcattaaaaatattcggggagggcaggcatgatggctcacacctgtaatccctgcactttgggagaccaaggcgggaggatctcttgagatcaggagttcaagaccagcctggccaacatggtgaaaccccgtctctactaaaaatataaaaattagccgggcgtggtggcacatgtctgtaatcccagctattttggaggctgaggcaggagaaccacttgaacctgggaggcagaggttgcagtaagccaagatcgagccactgaaaccccagcctgggtaagagagtgagaccctgtctcaaaaaaaaaaaaaaaaaaaaaaaaaaaaaaatacttggtgcacttatgaaagcctgcagagcccagaaattctgatttaattgatctaagaaaagggagaggtaaaagctcccaggaaagtctagtgcccagccaaaggccatgggagtgatgagtgaccctgcccacacctaacggagcgtcccctgctctgctagtcagtcaacagaacaccagccaatttctctaagccaagagctggttatttccaacctcccctggaagagtttacttaataccataagaagtcattttctcttccatctactgcaagaaaaaactggatattgcaattgccatcctttttgagttaaaatactctacatttttaaacaaataaataaaaaagcttaaccattttgaaattaccagtagggaagaaatcgggtgaaaaaggagaggaaccatgcattactgagaatactcctgtcccaaatctctctccatatccatttcttaaatttattcattcattttaaaaactcaacttacaattcttgaaatctttacctaggatatgtcagccagtattctagacatctggtatacatcatagaacaaaacagtcctgcccccatgaagtttcattctagcttacccctagtatatgccaggctctgaactaagtctaaaacagatgatccctgcccttccagctccctgcaaagccagcattaataataggagggctttttacagaaaatgaaactgtgacttgtttaagttacaacctgtgagtgttgaagtcagagtaccagtctttcctgtataccttaccacctatttgaaaaatgatggatagttatcttaaacggtgaagaattagtgtaagttcttaaacaaaatagtggcgatattaagatcatgcttgagaaacctaattcttgctgtctccttacatattttaagtttggcctaactctgtctctgtgcatagtgagctgtaatgtaactggatgtgtaaacagattgtagcctactcttgtgccaatctccaagttttggccaatcaaaggtggccaaccattcaaaccatgttcaagtaaggcaaacatcaagctgtaaccaacccaactatttttgtaccttgcttccattttccatatgtcacttttctttttctgttcataaattctctcctaccacgtggcatcacgggggtgctctgaacctcttctggttctggggctgatccattcatgactcattctttgctcaattaaagtctgataatttaatttgtctaaagttttccttttaacacgaccaagagtcacagattgcttagtctggagaagctactcttggctctatgcagtccacaaaaaatgacatttagaaatggttttccttccctggtctccagagaagcagcggctttcatactctgaaatgcagcatcctcatctgtaagatgcaggtgctaaatgatgactgttgttctttcaaatgttaactttctatgagtcacttcttcattgtatgtgtcaagaagcacaacctcgaaagcctgcctttgacaatgcttagaggttagaggatgccaaatgagcctcatcttctttggctactgagttagtaaccatccttcatttatctcagggagcaaaggcaggatttccgtgggtgtccaaggtccttactcacagtcaggatgcatggcagtacccttaataactacagattcagaatcacagaagacatttaccgagtatgtattttctgccaaaccctgtgccaggtgttattagaacattacttatgaaatatttggtagtgtggatgaagaggcagcttttcctgcttacacaatacagaaatatgatttcaaaaatctattaaaattttattaatctcagaaggcatgatttctaattgtgtttgatcttacacttgttatgatttaggaattcacatctgagttggttgcatgatgctatagttggcaacatgattctgaccgccaccatcacaaatagaggttagaaaatattacttatgtgaaaataaatgccatttctggcacctaaaacagctcttttctcaccttcctatgatgaggttttattgagcttttgcaggaaagaaaagaaagaaatctgcattcaggtttcaggagtaaagaggctgctcattaacaaagccgtttcaaaatctattgaaatgctccaccacgaatacatgccctattactaaaatcactgtcatttctatgcttttcttctcccttcaatcacataccacccagttttcagttcctataattgccaaaagccatttatgaatctgccttattgtatgggttacaaacgtctattttcctgctctgttcatacacatttgggagcaccttaagatgctgaaacactggcaaatgcttaatatatttcatttgaaagaattatgatctaaatcttaaagaaacagtgagtaaagtgcagtttctgctgcttggttactgtagttcattcggggaatttcatcttggtcgtgttgaatgcagtggttagatcctgtgaagttgtttaattaaaggtgttctagtagtcaaagccatgtctaaaaccccgtttgtttaattctttagtaatgtcaacattcctaaatttcatgtagcctaagagatttttccactggcttcaaatctgagctttgccactttggtgtcctttgctatgaatgttcaatgaggcgttctgagatcaccaagaatagaagagacacacccccggctgtcagaagtttaaccttggagaatgccatgaagggcaattctggaagaaaaaagagaagggaattcctcgtaggtttaagatcagaaagtggggaaggcgggggtgctcttaaatgcatcagccctactgccagcacagtggggactattaacacatcatattttttttttcctgcagttactcaaccttgcagtgggacaagttgctcaatgacttaccaggagacaattgttatttttaaaaatgtctttcttattttaactacaaggacttggcttgcttagaggctcttgctcaggagtctttaaatgcaaatgagggaaaccccaggttataaagcatctgcttctgcaggttttcaatcctgttaccttagcaacatttgcccttgtattccacgcatcaccttgacagcctgcataatataagggacggagcggagcaggggctcggggtgggagcctggaaagaaaactggggctcaaggaggtttaatatcggttagtagcttgggatccttcggataacggctgggcaatgaaaataaaaagccccatttccagaaatcaaagaacttggggagaaataaacacgctggttcaaaggaggggaaaatatatcagaactagtcggacctaagggagcagatattttccaaaaatatccttcccaccagccatgctgcagatgtgtcactgtggctcagaggcaggccatctgctgcagtgtttccctggaaacccccagcaacgcccctcccggagctcctccgcggtctcccccactccatccccgcgcagcggaggagcttgccggtgatgtcactgctgctagctgggagggaatcccaggacctgcgtccctcgggtagagccaatcatggtcggctctggatgctggaaacctggggcttttaaccagaaagaattgcaaaagcaatatgcaattcatcacagtccacaaagcacagttcctaacagattctgaaaacgtgattttaaaaaaaatgagatttatccgtaaacgagggctaggctacagttggtagggcggctgtcaattcttctacggagttttaacctacactcaatggatgcatgaaaaaaagaaatgaaatgatttttttagctactttaaaaaataaaggtaatgaatatttcttatctatatgcatatatatatatatttcattataattgttgcttctgcagaaaattgggatagaaatctcagatgagctgtagttacacggagatctacagcaatgcaatgtttagctagcatgcattttgtcatccaaggctagtaggtgaaatatttcctttacctgtcttgatgcacggtggagaaaggagacccgcttcgttttccctctaatctagagagttaacctcctccaggtagggttgaaaatatgaacagagctgcttttgcaagactgtgttgcctctaaatgtgatttaactcgcatattcagaatcttagcaaaaataaataaataaatagtaagatggggtaaggcaaatacatagatattttggagatcttatcccttattcaaggactgtagattattacagctttgttgtcatattatctctaggcagtaaatcatagtaaagtagtaaattcatagggaatgaattaatctcctttttgttttgttttctctgaaaaagagggtgtgattacagcatatattgattgggtactgattatgggacattttcattgtatttgttgttgttgcagtagactaaatgtcgagcccgtgaatctcttgtgttggcattgtcagaaaaaagttgtattttttttaaactggtctaaaaggaaaaaaattgaacatatatctttatattttttttgctctcttctcaaccatgtttagtgttttgtttatattcaaaggattttattttcacacttacaattctttacttgtctgtcattcaaatctttgttaccaaaacagtttgctctttttcatcattcactaagcattcctttcacagctaagctaaagtgtctatatggaaacatacatacacacacacacacacacacacacacacacatgcacacacactttttccaggccacagacaggaagatatgtgtaaatgtatacatgttttcagtagcatatatacacaagggtctccaataagatttttctagaaacaaaggctgatactacttcatttcatattattgtaaagtgctaattctaagtaaaagtagactaaaaaagagataaaaataaagataaaaatgagtgggctctcacaaccttgtttttttctttttgtttttcacttactctcttggctttttaactccttccttctctgcctcttatgaatgacaccaggaagagttattgtaaacaattggaatttctaaagttctgtgtaactgttagtatattcactatatgcatggtataatttataaaattaatctttgaaactgttaacccctagaaacagaaagaaagaaagaaaaaaagaaagaaacataaagaaatcttgacccactataaatcctgttttctctgccatctcccccagttacacccagggcaagtctatcttcttcaaagacattcagtcagcccacagctttttatcttttcaaacctttaatggcaccattagctacggaaccttgatttccttaatttttcccccactgtcactgcaaccatcacatgtggctctcagagcttctagttccctggaaacaggagttctatctgccatcaccaggtataaggtgccaccacttgaagggatctgccctatcaaaaatgaggaaatatattgatcaaaatggctggagaaagtgaccagccaaaacacagcttcacagtcttgcctgttttaagtagattctatttccattttgccggtgacagcactaagcaaataagcaatgttgccaatccgagaacagcctgcattcaaggtattcaatcaatcaaagagagacaatggcattctctcaaagatcagatgttttgtagtgcaactatgttgttctgtttttctttacttcaattatcagatagacaggaaaaaatacaacaaaatagcatgtagttgatttgccaaaaataaatagcaaagaaaaaacaagaataactagaaaacacgtgacaattttagaaaaaatgtaatcacatttccaattactagacaagatataaataaagagcatttataaaatgtttaaatccattcttttaaaacgataaacaacttctctaactggaaattactgtgcagctgctactttgtattttattggtataaaataactttagagttctatttcattgcattgcaaaggtgtaatactttgccataattaggtttaaatcttgcaaaaatagaaacctgcattttttggttttatattagtttttttaggtgatgctattcaatgggaggatataattgctgtttctatgaccttgggtaagtcatttaacccctctgaaccttggtttccttctttggttgaaaatagagacagtaatacttgacctctctctccagattttgatcaggttaaagaggccaataaaaatgaatgtgattttgtaaatagtgatacacacatctgatgcactgttgtgtatttttgcacctcctcagcagtgctctagctagtctgtccttgtccttgtcaactgtacgtgaacatgatgccctctagtgactgcactttgtagatgctgtaggccccaaggaagccttgagaggaaaaaagagcttaatgaagttagagaagggaagggaggcccgtagcggaaaattatgggttataaaccaataaaagcagcaggaaaaataagcagcagctgactatgagtaagaggacaagatgcacaaagagggagaagagaaaataagcagaatagagagagaggtgagatgtagctgattttggaagagttcactgtggcctggaaggagaggaacaggaatctctgcccagctttgtttataaccggcagtaggtccttccgttcatgtaagctctgccctccacaactcaccctgtgactgcaaaatgagatagttaaaattaaggttcagaattctttgagtcaatgtaagaagatgagcgaaaagtacaatgaaaatgagaactgaaggaggaagagtctgtggaagcaatttccagaatcttgtttactgtgtctaaggtcacctcagtattgcagtaacttaataacaaccaagcggctgaatgaggcaagctcaggtggggtttggtcgatcgcaggatgatcctgtactcttgtagtaacaggagtgttttgcagtacagctccacccttcacaaggatccagcccctgtgagattgcatcctcttagactgaatgcctaggagtctcactgactacctgtctgaagagctccttcttcttttctgaattaatccttctttacttagaactatctgaggatcaagtgatcttccagtgggaggatatttaaacccagcttccccttgcaaattacagatgctataatcctgtctgcattaggcttaggtcatgctttctctaaacgaactgtgtattacaggaaagtaatcaaagtccacaagaactgtgtaattaaaccagtgatggtgcaaataatccagaagtctgtcattgctctctctagacaaaggatcactcaaagatgagaatttgaactaattttactgaaagacaggatgatgcagctgaatggaaagaacactgcataggggtcagaaggtgtggattttcattctgacatggacatttgctatctgcctgatcttctgcaatattctaaacttaacaaagccttatctatacaatgggaattaatccatttattcatatatattaaagattttcaatgtgccaggcactgtgttaaacttccagatggcagtgagaaacaaactctagaatttctgagtcatgataaagatgaaacaggtgttatattttaaaactcgaaatgtcataacagtgtaaggtactatgcattcctaaagcaacataaaacaatagggatttttccaaccttaaagagcagcatttaaaattgagtcttgccttgggagcctgtgacccacgggagcattggaaatgacatcaaccacgaagtcttttttcttccagtgaaatgcaaaacctgctacctccctggagctattagcttggccaaatagtcctctagttagtaagtggacaaagtagttactgcacggctaactgcaactcttcatttaaatatttccctcatgtccagataggatatgtctaatatcatatgcctaatagcttttcagcatctttccacacagaaagaaagggaaataagccttgtcatagccatgaagtgtccccaccaccagagtttcttctctgctacccctatgctgcctaggaatgctaaaactattttatggggccaccaggtggcagttagggcaaatggttttagtttttttctttctacattcttggggaagaccaggggcttaggaatggagaagcaagccttggaaataaaagcattatggagcatttgggggtgccaggccctgtgctatatgtgatatatgcaatacctcacccaatccttatatcaatatctgttaaatatactattgaacaggtgaagatagagtaatatgggaaataaaacatcttccgtaataagcagctagaaagtaccacaatgtaaattcaactgcagaagacatgacaccacagggaaatttcgtttcactgcagcagtgtctaaaaactgaagatggggaaagtgtagagtgtgttattaaaatgattttttcaaaaggttttaagagtctaaataaattgcataattagtcagtttcctacctcctagtcttcctacctttagtctttatttttagctctcctgagtttgtagttgttctccttccatggtttgattctctccttagctttcagattctatacatttcacttctctttataaataatttttaaaaattcttcatgtgaacctgttcaagaacctgttgcattgaggactgaagatatggctctagattccttactgtttccggtagagaatctgcagagagaatatttcactgaagcaaaattataaatggaacatttgactttatatttccatgtccccaaagatttactaaacattagatctgatttggccaactttttctaccaatatttccggctcttgatatgaaactagttaaagctattttttcccttcaatcagcacattttcaaacttagaacatctattactcaaatttggcataaaattatgcagccagctcattatccactttctgcatattgccaagggctcgctacgtatgtgtgttctggttggcagacattttgggtaactactattctcaatttgtacctactttatttcaatacatgtttcaagatgagtgttaaagggtacattgctttaggaaacttgtctttttctggcatttgaacttgcctaaattagaaaaaaaaattctggttccagtcctttttttctaaaaaaatattccaaatcattagatgaaactgttaaagataacgtttggaaagtttgtctcctctttggtgattaaaaagtgctttccatttttggcccatggctcttttcctggggcatagcatttgattataaagcttttctgatgaaagtatcacaggacagcaaacatgagaatgggagaaataattttgcatgcaattttttgtcatctggctgcactgtatgggaaatacattttccctgtcaaaatgtcaagttgttttgacttcacaacaaaagaggaaggaagttcttaaatgtagaacaataactcagctcactgctgatttctatttgttctatccttacatcacagtatagagatagaatgtgtcctacaaatgtccatgcagcaactcatattcacttggcataattttgtttattgtttgagaaagtagtattttgggtaaaaattctgaaacaggcagtgagtatgtctgagtatttctggcaagggctatttcttcctttctccttttactctggagttttcttgaactgagctgtttggacaaatgacacatatttcaagaattccaactgtgggagtgtttcactcacaggattgtgctttcttctaagagccaggtctggtgaacactctcaggagctttgtaacatgttccaagctatgcagaagtgcttagttcattcactagtcaaagactaacacatttacagcaataaaatgcattataagcattctttcttcatgaatctattcatcccattaaaaaagcaggaattccaattaagtgaggtaaaatatgctaagtagtacagtataagatttttaaaaattacaccatgtttttcatggattattttaagaaaaaaactattttaagaaaaaactgtcctatttttggaaggtctagtcccaaactgcacaggaaagttagaggtaaactgttaaagtctttgagaactggcatttttcaagccgcagtgaatgaaatcaagcatttctctgtttctcctttcctttcggaatttcttttcctgaggcttgagaaggcaatactggtcttacttttcacatgagtcaagtttatactagctgagcaccctgaatcattaacgtctttctccccaggggagaccaagctcaaatccatcatcagaatacatacttagaccctctcccttctttctggccccctgcttcttaggaatgtgctctaaccaccacagcattcctgatcaccacctccagatgacaaaaagaaaaaatgagtggcagtgaaccagaagagcttaggccatctattttatcctaaaatctgttcagaaatacgaggtttgtatcaattagtaagcacactgggaatacaggtatacaagttgttagcaatatttggttatataatgtctatagatatttattttgctttctctcagatattaagaattatgtctttcctttaacctccatcatttgtttttctactttggtggaagctttttgtttgtttctttactgcaacagtgaatttatccttggatttctccattatgattggcagtatttatacaataatttcttggtattagttaattgataccttatatttactattttcccccaaagctgagtaaagaatagaatgaaatggcctatacttatcagtgtaaatggatattagaattgctgctcttattccaaaaaatatcacttaaagttcacaaatgaaagttaataactgaattttagtaacaacaacttcaacttaaaaaattccatgtaattaatagctcatgagtcccactgagataggttgaacttcataacttctaaagccttttatgtttctactacttttcagttctaatgttcaatagtagcgtgagtatctggttagtttcagtataaaaaagatgatacccacttgtgatatgattctactttcaatgtcacggtggaatcatttattagttttttaatttaatttttcacatgtgagtgtgatacagaacacctgatttttctacactataggatgtcagttcagtaaatcgattttcctcattagcaactgcttatcaatgactatgctgtatagaaagcaagagtattatactctatttttgatcacagataattgaagtaaatttaattagatccatatgaaagaaataagaactctcacaattgtgacatatatacgtgtctgtgcatatgtcatatcttagtatatgaggtatttgcatgtgcatacttaccaagttaaacgacctcctatcccacaaagttctctttagaaataaacttgagtctcttgtttgtgaaaccaaagagaatttcccgccaaagaaatacctacaaagaagtgtaggtaaagaattcaaatgattgactcaggcttaagatgatttgatagctctttctgcaccaagaaacacagaaaatctcaaagcaggcctgtgccaacttggtataaaaaaagccttcctaaagagtgcattatcttcaatgggaaacgtcgcagtacaccttggcatcaccaggtcaattagtgcaccggaaagatgcatgatatttcctgttggcagccacgaagtgagagaattggacggctactagccctgttgtgtgccaaggcctaaaaatcatgcaaggaggtgaaatgatgcgtgccaagaaaatagcaaccacaggaaacagcaaataatgtaaggttttgtgtctttactctagatgtaaatactcatttaccagggcagctttaaattgacagcttttgggtttgtgaggatattgtgagtcagggttctcctgattgggcaagatgaacgagtgaacaacatcactagggggccggagtagatgagatactcactcattcgtgtgcctgctttagcaccagcagtgtgggaatggggagaaggccaatggtctcaaggcagtttccagctctctggcaaacaagataaggccatggctgtaacagacaccctctgccaggttctaaaatctctctcttatgacctttttaagatctttaaagcaccgtctgcccttggccaacaaaagagaaaaaacagagtcaatgcggaaaacgctgccaagacaacattttcttcttaagatcctaaaagcaccattttccctttgctaacaagacaggagcaataaagagtcaattaggaatatgttgccaagacattggccatataatttctactccagtcggttttgggtttgatgcagtttagaattctctagacacattttttcatttttttttcttactagaacgcagaatgtttttgagagtagaggtggatggcactgctcattagaaatagctgtcctgccccagaacaatcttcaagacaaaggttgcaagactatctttgaccttcctgtccctaaacactccccaaccccaagccaaacacgcgcctaaaagttttcacaccttgccctttactaacagcaatcatatttaggaggaatatattattgttagtcaggaaattctacctggcttcaggaggtagcttagtgggtatttgctaagtctgatacctttcctttcaacatttagctgagattacctatactaagagcacgaactacaactgtggaaaacagaagaaaggagaatgttctccaaatcaaagtgtgctaaggtcagcttggggcagccaacaattcctggaaggtgacagagataaagttgcagagagggaaatggttgaagacaaatgtctcacgccttaaaatgttgctaaagtaagatggctgtttggatgagtcatcaacaagaacatcacctttgctctcttcctgccacccctgcacttctcaggctactgctcctaaaacctagaactcaggagtgatggaaatagagggcacccatggcaaggaagaaattggagagtaggaaactcagggaagttaatcctgaggaaagtggaaagtgactaaaacattttgagcagagaaaagtcaataaatcaaatatagaaacaagagatgataggaggttctcataacagtccaaatgagaggaccaaaaggcctggagtcacgtcattgcagtaaaatggaagaaaaaacaagagtataaatgaagtgtcaaagatgttaagaaacaggatcttttaaaaaattatttttaattattatgggtacataataagtgtatatatacatggggtacatgtgaaattttgatacatacaatgtataataatcttatcggggcaattggggtgtccatcacctcaggcatttatcatgtcttatattagaaacagtccaattctcctcttttagctatttgaaaatatacaataaattattgttgagtatcatcactctgttgtgctatcaaatactagatcttattctttctatctaactatgcttttgcacccattaaccatccccaccttctccccatgctggctatccttcctagcctctggaaaccatcattctattatctatctccatgaattcactaggagaaataggatttttgactaatgggtcagaagaagcaaaggaaaggaaaggaaaggaataaagaatgactcaggtttcttgcctaggaaattggttaaaaaaagggtatttttaattaaaaaaggagagttgaataggagactaatttgaaggagaaaatagcctatttttagatgtattaaatttatcaaatttgtgtgctgtatatcagggctcaatcacaattctggcataaatttatatattttatagaacattattaacttgaaagaaatgcatgtattttgttaattgatagaaacaagatcaaagggcatattatattattattccgctttgtaaggaaaaataggttttgcatatttatataaaaagggaaattgaatgtgatatactctggggtattaataataattgtgaattaaattcctttctttagtttatattgctgtctcaaatcttctgatttttctaccttgaatgtaaattttttgtttgtaatatggcactttaaattaaagttgtttttcagctgggcacagtggctcacacctgtaatcctagcactttgggagaccaaggtgggtggattacctgaggtcaggagttcaagaccagcctgaccaatatggtaaactccttctctactaaaaatacaagcaaattagctgagtgtggtggcatgcgcctgcagtctcagcaactcgggaggctgagacagaattgaattcgagaggcggaggctgcagtgagccgagatcataccactgccctccagcctgggcaacagatcaggactccatctcaaaaaaaaaaaaaaaattaaattaaagttatttttcttttcttccattacccagactggagtgcagtggcatgatcacagctcactgcagcctcaacctcccaggctcaagtaatcctcccacctcagctttccaagtaactaggactacagatgcacatcaccatgcctggttaatttttgtaatttttgtagagatgaggttttgccatgttgcccaagttggtctcaaactcctgacctcaagtgatcctcccacctcagcctcccaaagtgctgggattacaggtgtgagccactgcactaggccttaaaatttatttttcaaaaacttgatgattcaaatcattgaagatgctcttatgccaaagaaaaggtagttctaggaagttcatggaatcttacaaacacctttacagctcaacagaattgcaaagatgggtagtgttttgttttgttttgtttctctgattgttctacagcttatagatactgaggttacattttatgaaacaaaagtaagaatacatgatttaaaagtaagatcaattcctaaaaattggacctgaaaattttatggatagagtagatagacgtgtagaattcatcccagcatagagttgctgggatattactggtgcttcttcacagggaaagaaacctggctacccagactacaaagggaaagggggaaaatggcctataactcatatcaggtgaattagcaaacattctcatttcagacgatttttgctgtccctggtcatgaaatttccttaactgggttctatcttttactttttatcccaggcttttagcaagggtcataggaaaatggccatttccacatatctggtatatcccatttgaagatattgcctaacaaacattactcaggatcccttacataaaaacctccatgataaatttcttctgtacttttttccccaaaaagctggattctcctgtaaaactgttatctattctctttatatattataattatggaattcattatcatttctactcttatctacatgactaggtcaccaacagctaattatatagctaattcatggtagttaattttatttacttctcttaagtcatgacttacaaaattgcatttctatgtatgccatcttattacctccatttatttaagttgcatactacttcacatttcctttgaagtgtatattattattagtagtagtagtattttggagacagggtctcactctgttgcccatgctggagtgcagtggtgcaattatggctcactgcagcctcaaccttccaggctcaagctgttcacctacttcagcctccccagtagctgggactacaggtgtgtgccaccatgcttggctaattttttaaaaatttcctatttcttgtagagatagagtcttactatattgcctaggctggtcttgaactcctggacacaagcaatcctcccacctcctcctcccaaaatgttatagacgtgagctaccacacccagccatgagtgtacattataaataaataccaataatgtactttcacatatgaaaaggctataaaagtatgcaaatatattatggcaacatctgttaagggataaagtgacacactgttgctcataactcgaaagaatatatatatatatatatatatatatatttttttttttttttcttttgaaacggtgtctcactctgtcaccaggctggagtgcagtggtgcgatctcagatcactgcaacctccgcctcctgggttcaagtgattctcctgcctcagcctcctgagtagctgggactacaggcatgagccaacatgcccagctaattttcatatttttagtagagatagggtttcaccatgttggccaggttggcctcgatctcttgatctcgtgatccacccccccatcagcctcccaaagtgctgggattacaggtgtgagccattgcatccagcctcaaaagaatagtataaaccttatgtgttcatataagcagtagaacctatccctaatagttggattttattgtgtaagtgtttcattaaggaatgtctgaaacatgtccagatttttatttcagtggcttagttttgccacagaacttcagttttataaatgtgtgtactggcttaactgtgaaagtattaaaattattgtattgatttttgcttgcaaatgaaattcataaacagaattatcactgaaatttacatgcaagagaaattgatcaagatgatttgaaaacttatggaaagattgaaggttgccaaaatctttctctttctaacttcctacctttatgtacatttacactctaatcacaggtatttacaggccttaattttaacgaaaatgaagaaaaccaagaaagaaacagctctttagagcaatggaaaatcttctatgatttctcactgacattggctagatactctgcatttatgagcaatcatgcatgtatatcatcagatttaaccttcacaacaattccatatatattatcagatttaatcctcataatagtttgctatcctaggttttagtttagaaaactgagcctcccataagctaagaagttacttgtccaatatcacaactttagataatggtagacttagattaaatccatatttgctcgctctacattccatattcttcccatttaattgaacaagattttggaataaagttgaaatccacaaaaggaataggacagtgacttcacaataaaaatattaaatgtggcagaaagtatggatgtcaatggaatgtaaattctgggcctcctcaaaaacttgatatactcatcctgtgttagttgtgaaataaacaggttggagagtgaggaaatgtggtttttgttcccagagtcattactgaccaactgtgtgctttgatattatatttgctttctgatactaattatattaattctcgctcatagaaatcttccctccttcataccccacctctgtttgattcttaatctcatacataagaggtttttattcaatgtctcatttttctttccaggacaagtatgttgtaagaattaattaatagtcttagaaccattcaagcagtaggttctaattgagtatttttctccccggttagcacagcaccctgtcagagccctcaaagtcagacaaagaaggatgaaacatgttttggtccttaataaagaactgctgattgactgtttgaaaaacaaatgccgcacacctgtaatcccagtgctttgggaggccaaggcaggaggattgcttgagcctaggagtttgagaccagcctgggcaatatgatgaaacctaatctctacaaaaaaaaaaaaaaaaaaaaaaaaaaaagagccgggcatgaacctgtagtttcagctacttgggagactgaggtgggaggatcgcttgaaccctagaggcagagttacattgagctgagattatgccattgcactctaccctagggtgcaagattctgtctccaaaaaatgaaaaacagctgtatggtttggagagccagtggctgacaaactgaaggtcatggctaacagagtctccatatcagtgaatctcaaacatctgtttacataaatagcatcttcttataaaaaaatacaaattctgagcccccatcccattatagttggtaagtctaggatgagaccagaaggggtcattttaatgagattttcagatgactttgaatttatatttaatatttattctggtttgcctggggttgaagggttccccagggcatgagactttcagtcttaggcaaactggaatagttggtcactcagatttcggtgcagtggttaaagttaacactttcaaaaatattgtagtgatctagatttggttctaggagtttggctcaattcagggctaacaaaaaaatctgtttagggccacttggggattagtgattctcaaaaggtagtccttgaatcacttactgaatacctatagttgaagaacagataactgcattttaacaagattcaaaggcaaattaatgtttgatgaccgttgacatcaagtctcagaatcagaactgttcaacttccaagcaaatgaaattactaaactcacttctctgagtgaggctgagagcaagaagttaagtataatgttttttgagctaaaatacagagtctactatcagaatcctgtttcccaccataaggattaagatttttttgtttttgtgtgtgtatgtgtgtgtgtgtgtgtgaatgtgtgtgtgtgtgtttgttttttgtttttctgaagtgaatgacatcgttttttggaatgaaaaggtcttgccccaccctgcaagtgtatctctgcctttgagacaatttagccctggaatcaaacctgggggggaaaatcaaattatgatattaaagaaaacgctgacaaatttctaaattcctttcctctactccctgctgcatacaacttccttctttctatctataaatactatatctgctctagaaacgtgaaaaataacataaatattgaacagagtgtgaaggaatttaaactttattgatgagtagtagtattacccttctggactgatgcagatgagagcaccataaagacaaagtgagttcttttggtccttaagccatgaattggagtctggatagtagggatggaaatgggttattagatcatcagttcactttcctctccaagcagcaattaaatttgttttctttgtctcagcttactcgttgctcaaaaaaaagaaacatttcagctcctcttcatggggaataagaccaaacatagaacacttttctcttaacatgtgtggtgcttgagaggagaaagaggcaggaaggaaatgcaggagaaatgtgggaatcacagttaacctgaaggattactttggctgtccccttcagctaatgtgaacattctggcagtcagatgcagccctgtgagaaacatctatcagacatcctaagtagatgctccaactgctgtttttcatgtacagctgactccaagatgagtgtgatgctatcacggtgcaggataacagagatgtaccgcgaacccaacactcaagatgggaatgataaaacttcaataacaaaaacaaaaaaacaaaacaagccacactatcctttcagccttcagggatcgcctccttaaactgttttctaaaatctttctgcactttatatcaggtgcaggagaagtagactacatacattatttgttgtctatctttgaaaggatttcattccctctactgcacttaatcattcccttatctgaatattaactcagtgtaaagcttcccaaattttccaagttcttgaaagagagcaaaacatattgcaaagctctatatgtttcctgctagatatatttcgtgaaagacttcattatgtccactttcttttgagtttttgtgttagccctgcattgctataatttccaacatcccctggaacataatgaaaaccagagaattgctttttttttctgggtccattttattacattcttttacatctcttacttaactacttctaatgcctttgctctgaaactttgtgcatttgagggtttttttttccccgtgatttggtggactgcaagggcacacaaaactagcttatttttcctagtcaggcagttttgaatagaaggtgattgtgttttccagagataagtatgtaagtcttttctgctaccggaggaggattctattttagtagtctattaagtagacaataagcgctgagttatgagttgataagtggatctgcttaccacctagaaacatcaattgaaaccacagcttatggtttcttactgcctctttttggtttctcactgagtctttctggttattgttatcatttcgtttttgacttgggcttggactgttcagcttggctgtgttaatttttcagaatcaatgacttttatagttacttccatgagtttttcctcctgcattttatttaagcaattcactaactatttataagaccatctttgaaagcctgagatacatatctaggcaaatatccatggaaaaaataaacactctgcaaatttgcaaacaaatacagcaattgccaaagtagggttatcttttgcaatcagtactgtggtttcagtttgaaaaaataaagctttcttgtcagttttgctccaagggctatctgattcggtgtgtagtcggtgaggaaataaatacaggtataataatctgtgcttgctcaaaaattaaaaaatcctttaggagggggccaggcgtggtggctcatgcctgtaatcccagcaatttgggaagcagaggcagacagtttacctgaggtcaggagttcttgagaccagcctggccaaaatggtgaaaccctgtctctactaaaaatcttagctgggcttggtgacatgcacctatagtcccagctacttgggaggctggggcaggagaatcgcttgaacatggcggagattgcagtgagccaagattgtccagcctggacaatagagactctttctcaaaaagaaaaaaaaaaaaaaacctttaggaaggataaaactcatttcctctatcagcatagtgtcaccatattacagaagtatcaaggtcaagtattaagactactgaggctcaggtgtccttggctgaagggagagagaggataccattcttgcatagtcttcagggcagcagtaatcagcaaactgataggttgcttctgggtctaaacccactgtaatcatttgcttgtagagatgacaaagttatcagttgtacttacatccactttttttgttgtttcagaagcttaccacacttctcccagtttccttttaattagtttgtaattttaaatcattacattaagataagaggtttttattaaatttggtagaactcatggtaggtcctacagaaatcactgaacttggcagccaaaaacagtgaccaggctgaggatgtgcctgaattgaacagggagatgctatttacttcttaacagagacatacttttcacgcagaaacttggcaactggaggagaaaaacacagaggtgaaggggaaagaagactattctggaaattaacaggtttcaattttggttgttcttcaacttgttagctatgtggccagaaataagcctcttaaactctctattccttggtttcttcacccactactctaaatctgatgaaacagagcagtaagaatttcttaggatatagcttaatttatttttttttaaaaagctcaatctaaaaacaagcttaatttaaaacagagacaaacaaatatgcctaactttgagttttgacaaaaaatgcaaaagtaattcaatggaggaaagatgagctttaaaaaaaaaaaagtgatactggagcaattggatatccaaaggcaaaaaaaaaaagtgcctaaattcatttctcacatcttatacagaaattaactcaaaattgattacagacttaaacataaaatgttaagcaataaaactttaggaaacaaacaggagaaaatgatgaggacctaaagctaggtgaagaacttctagacttgatactaaaagtatgattttcattttaaatgaattttaaaatgaatttcaatgaattttaaaattcattttaatcaactgggacctcatcaaaattaaaacttttgttctgtaagagaccctgtgtaaagaattaaaagaaacactacagagcaggagaaaacatttgccaaccacatattcaagaaagattttgtacctagagagtataaagaactctcaaaactccacagtaaaatccaaacgatccaattaggaaaatgggcaagaaacataaacagaaattttaccaaagatgatatacagatggaaaataagcacatgaaaagatgttcaatatcattagccattaggaatatgcaaattaaaacaatgagatagcactatctacctatcaggatggctaaagtaaaaaagagtaataataccaattgctggagaggatgtggagaaactggatcactcatacattgttgatggaaatgtaaaatggtacactctgtaaacaatttgcttgcttcttataaaactaaacatgtatttaccatatgattcagcagttgtgctcttggacatttatcccagagaagtaaaaacttagactcagtaaaaacctgtacatgaatattaatagctgttttatttgtaaaagccccaaactggaaacaacccaaatatccttagatcagtgactggttaaacaaactgtagcacagctatactatgacatactatgaagcaataaaaaaggaatgagctattgatacagacaaaaccatggatgaatttcaagggaattgtgctaactaaaaataagccaatcacaaaagatttcatgtgatgtgattttatttatataatattcttgaaatgacaaaaatatagaaatggagaacagattagtagtttccaggggtcagagagtagaggagggagggaggtgtgtgtgtccataaaaacgttgcgccagggatcctggtgaggaagctattctgtatcctcattgctggtgttcacgtgaatctacatatgtgataacatttgatggaaccaaatacacacacaaacacacacatacacatatgagtgcatataagaccagagaaacttattttggtggattccgtaaatgtcaaatctttggttatgatattgaagtgtagtttggcaagatgttactattggggaaaatagtaacattgtactattgtcctgtgaattattgattcacaggaaattgtaaaaaaaaatgctttgtcctatacatttttttagaatttcctgtcaatccataattatttcaagataaaaaaagttttgtaaaggaagaattttagagactctttcagattttttattttgagatttaatcaattatatgagaaaaataagctttaactgaccactctttccttcctatccaaagcttagtcaatgagaaaatgttgcaagagaaggagaatggggggtacctgagactccaggagagtacataccctttttaaaaaagcaatacaagccagcagaaaaaggaaagatgggactctggagcgattatgtgaatctgtggttctcaaagttcagcatgcatcagattcccagagggcttgtttaaacaaaaatttctgccctgcaaccacagagtttctgattcactaggtctgggggtggtgggtgtggttcaagaatctgcatttctagaaagttcccatgtgatgttgactccagtgctgatgctgctggtcagaccacactctggaaactactgccatagaacatctgagagtcacaatttgaaactgtctcaagaaatttctaagtaaaatgcaatgcaataaattacttaagaattctctatatttacaactctttatttgtatagtttccttccccctcagtatgttggctggtaagaatgttctttttgattattcatctgtgtgggctcaagagtgtgtcactgagttaatttacaaagcctcggattgcatatccatcacatttgtagaaagtattatcccagaaaaatccatcaacacaacacataagctccaaaatgtactgcacaattggcgtgcaatagagtagtcaaagaaccaatgaaatgcaaaaagttatctatatggagatctcaaaatgaattaacaaattaaatcctttgacattgtatgagatcccattagggttcattgttacagttttctttaatgtttctaaaatagaaatgttgtcctgggcagagcagtgtaatgtacttgctttggcatcaaatgccacattttttttttttttgagacggcgtcttgctctgtcacctaggctggagtgagtgtgcagtggtgcaatcgtagctcactgtagcctcgaactcctgggcttaagcaatcctcccacctcagcctcctgagtagctgggactacaggtcccaggtgcccagctatttttaaaattttttgtagagacaagtcttgctatgttgcccaggctgatcttaaactcctagcctcaagaaatccttcagacttgtcctcctagagtgttgggattacaggtgtgagcctccacaccaggcattgtttctattttaactttgctacttacgagaagtcttaatttgaccaacaactaatgtaagctctagtttccccatatgtaaaaagaagataatgcctaaattgcagggtttattgggagaattaataagaacacgcctaggccaggcacaatggctcatgcctgtaatcccagcactttgggaggccaaggcagctggatcatgaggtcaggagttcgagaccaccctgaccaacgtggtgaaaccctgtctctactaaaaatacaaaaattaggggagtgtggtggtgggcgcctataatcccagctactcaggaggcttaggcaggagaatcacttgaacccgggaggcggaggttgcagtgagccgagatcgtgcaattgcactccagacttggcaacagagcaagactccatctcaaaaagaaaaaagaaaaagaaaaataagaacacgtctaaaataattagtgcagtgtctgacacttaagttctcaaatagtggcggtgaagatgtgaaggagggtagagatgactgtgattattaatcatcttatttgttgatcatattaaaatgacaaaaaccacaattattttgcaccaacctaatatttcagcagatgtcctctgaatcagaagtaaatagccatgataatcttaccattagttattttattgagcaattacaagtcccaggctcttacgtttttatattaattttttacaaccagtttatgcgatgcatactgtcctcatttatcatataaggaaactaaaacttaaagagtttaatatattgctcaaggttatccagtgtattggtttgctagggctctgtaacaaagtaccacaaaccaggtggctcaaacaacagaaatgcattgtttcacagttctggcgtcaaaaagtccaaaatcacagtgttggcagctttggttccttctgagggctgcaagggaaagattgttctgggtccttctccttggcttgtagatgtctgtcttctccctgtgtctctccatgtcattttttcctctatgcatgtctgtctctgtgtccaaatttttccattttaaaaggacattagtcattgctgggcacaatggctcacacctgcaatcccagcactttgggaggctgagagaggcagatcacttgaggccaggagttcgagacgagcctggccaacatggtgaaacgtgtctctgcaaaataatacaaaaattagctaggtatggtggtgcatgcctatagttccagctatttctactcaggaggctgaggcatgagaattgcttgaacccaggaggcagacgttgcagtgagctgagatcatgccactgcactccaacctgggtgacagagtaagactctgtctcaaaagaaaaaaaaaaaaaaagggcattagtcattggattagggcccaccctatggaactcattttaacttgatgagctctgtaaagaccctatctctaaattatatcacattctgaggtgctgggaggtaacactccaacttatctttattgaggggggcagaattcaaatccatagcacatagtagtaagatgtcatgctgaggtatgaaccagacttcatacgcaatgctgtggactaaacttttgtatgcctgtgaaattcatatcttgaaggcctaatctctactgtgacggtgtttgagatggggcgtctgtgaggctttaataggtttagatgaggtcaggagagtgaagtgcttgtgttggaattagcacccttataagaagaaaaaaaggccaaagcctcctctctctctgccacctgaaaatgcaacagggaatggccatccacatgccaagaaatgggcccttatcatacaccaagtcttcctgcacattgatcctcgatttctcaggttttggaactgcaggaaatcgacgttcattgtttaagccacgcagtctatggtattttgttatagctgcctgagctgactaagacaggcaatatatgacatggccgtttgctccaggacttttaggaaatgtggatcccattggtagtgctcagcaatcaaatttatttgatcctcatgttcagcagacatgttgtttttttcttcatgtattgccaactcttttatatgatacataaaacatattgaaaaacgtagacttgctatctttatattccacatgttggcagattctttccaagaaaagtgattttcagatcattccttaggagcgttgaggctgagaagtggtctttgcatatttatatttagaaattatcgagtccaaaatctaaatattgagtcttggtagaagagaaaaccagtcacaatttatgtaaaatagttgttcctaggtaatgaaccaaagcagggactatatttgagaagtagaatggtattgtcaaagtcagtgtacaatcaggaaattaaagagattattttatccaaactattgcagttaatgaggaatgtctcaaaagaaagggaagcagggttttatagatataggggaacaaaaagtttaagggatttcttaaccaccacttttttctagaagcatagggattaggtcacattcaacattttcagtccccacttctacttcagatcaataaacattataggatgctgaacaacatagaggtgatcatcagaaacctgagtaagactgagcagggtctaagaaatagtctctcaagagttcttgttggcattattgtcgtaacatcacctaaaccagctgttgagaagtagtggcaaaggccagttgtttcaaagtcatagagatcaggctccttaaaagagaagtatttaaaatgaaaaacattaatatcaaagattatgttaaagaccagagtttaaccctgagcataccagtccagcaaattccaaaaggtgggtggggaaaatctttcagttacacagtaccgttcgttgagtttcttgaagctaggatgtcaatgttcttgatgatgttcagtctcggttagctttcctctaagagaatgaaggacctgagcttttcaccagaatttgttaggggctcagacagtggtttgtgcagggaaaagtctggcctgcgtgtaatctgctgcagtggtgagttcttcaaagtttgaatcaagtagttggacttcagctggcagaatttcttcaactcctggagaaaagagctagctgctagacaacctagagttccaacaggaatctgggcaatcagatgttatttttcagtgacatcaagttagggaaagagagaaaaattggaaacattaatttgtagggttgtagccagatattgaagcaaactggaaggcttcacagtttggtacaaattaacaatttgggcaagataacaggatccagttcaatttttaggaaggtgtccaaactgctttttccacaaaggaggggaagtcatttaaatcattccagacaagtcagaatttgcatatgtatcagttacctgcaatttatgaaactgtataatatggctaagagataattatgtctacaatctgataaacaggaaggagctgcttgctatagttttccactgaaacaaaacatttctctctatagtcacccctcttttgatcaaaaataatctcaaagaaagattattcttgatcacaaaataaagctagtaccatcagatttggcctgattatttacattgttgtcttaaagatgataattcactacatagggtttcttatatttgctttgctgaaagttttcataaggaatctcaaattgaatttttaaaaaccacttgaggctaggaagctatatcaagaactcaccaacagatttacctacagtatctataaatttcagtaaatgcctctcttttagaggtcccaaaaatatctcaagttttctgagcctgcgaggaagtatcctttacctgtaaatttgggcacctcattagccaggaatcaggctgattttcccaagagggctttaaatgagcatacctaatgtttccaatatttcatgcaaacaaggaagagttttattgaacctatgcaaataactataattttgaaatataatgagaatactcagtaagaatttctgatttctctaacagtcaggcaggaagaaaaagataccaatgacaaatgtttcatttatatttgcaaagcatagacttctgaattgttatgagtttcagttagtttaagagaaaatagaaagaagtttcctatgtccaaaaaatcaaccattaaaatatcagcaatattccaaacaaaagctacagtcattcctcatcagttccttcagtcctgtgtaattcttgctctgcttcctcttggcttaacagtttcatgcatacatctgcctctccaaacagggctctggaaatcctgactcagtctgctggtatggtctcaaggttgtgtaagtgacggcatcagaagcttctgccccaaatgaaaagtacctggcatagagctttgccatggggctctgagataatcctttgttaagacaaagcactacagctagatttgtaagagctttcagggaagcaccacaaagcaaaattctatttgtaaatgacaaaagccttaaaaattactttgaaaaatcattttcaaacgtgaaagatgtaaggagtgtttatcacaagaatctccatttgaaaaatactggcttataggcacagaaaaacaaagatagtatgttctcacttacatgaggaatcttaaaataatcacactcgaagcagatagaatggcggttacaggggatgggggtggagggaatggggaggtgatggtcaaaggctataaaatctttattaggaggaatctgtttttgttttttgagttctagtgtacagtgtggtaagtgtagttaataataaagtgttgtacatttcaaaattgggaagagtaaatttcaaatgttctcacacaacaaaatgactagtatttgaagtgatgtcgttaactggctcaatttaattattccacatggtaggcataaatcatattatcactttgtaccccatatacttacaatatcataaattgtcaatttacagtttttttttaaaaaaaaggaaagcactggcttagaagaagctaatttgaaattaacgaataaaagttgttaccaagttaacattttaaaaataactgaaacttatgactcatgtggtgctctctaataacagggcaaagtgacatcgggactcaaagaaaaacacgttatggacataaaagcctttgatgactctctaggaattttccatacagcatacaatttctgaaatatttatactgataacattctgcccatacagatttgtcctagggaaggttaagcatctcttctgagttggcaatgactcccgtgcaatttgtaaatagtaacatatcaaataaacctaattcttttcagcaactttcttttcataaggtgaaataacaaatcctttgtgattttcaaaggccctctgggagatatcaaagacagtttcagatgcaatagatatcacttaggaatcagttttgggagggaaaatatcaaaagttgtcaggagattgggacactttactaggatacggtcgtgagttactgataaacaatactttgctaccttaactaaggtgacagcaaaaagagtgaaaaagtaagcacaggcagtaacatgattgtaaagaatcttagctttttcaaaagggagaagactttattaaataagcaaggacgtgataaactcaatacacaatataggaagttattttaagacatggaatctttgccttctaggcagattactcagaaggtaaagaaaaaatattattaagagtagactaagaagtcaagaaaatgttatgtttttaaacagaggcaaaattaaattctactttgcatcattatggcatttgatattaaagatctttttgaaatcttataaatgaattcatcaagccttagctagcactgaccacagcaaagtttgtttcccacaagcgttttacaactttctacgtctattcagcttttgtcctacacattaacaactagctatatgacttcagaataaaatgactctatttttttcttaacaaaaacatgttctgcaaaccttgcatacaaaattgtatctctctgctattattatgccttgtagaatctcattcatgtatattgattataatttttaaatagaaatagtaacatctgttgcacaaagaaaaaagggaaatggataattgtgatctttctgtcatacataagctttttgtaacacactagtggaactcatgaatacacatctcacaacttttaatagccatgcatattatttacagcacgacttatgcaaagtggcaaaaatgaacacatttattaacaaaactgaatgtacatgcttctctatagcatatagaaacaaaaggcaaaaaagtatataaacttaaaattatgcttggttaccaatatttcacttttctctcttgcatagaaattacataaatatccaattaatattcattaattaattcaatttagcttcaatccaaggttttaaattaccaaatatcttggaatttgtcttcaggctgacatgctccaaaatattagtaccattgaaagtttgttagaataatgactcaatttgcttaaacacaaatttttattttctattgtattaaacattaagtagaagtaatgctaggttatttggttggtaaatctaagtttaggaagaacattcacaagtagaatagaagcatacttgtgttatatttaacactaaaaactcagagaaaacagctatttttactaaatcaacctcattaattgattatcaaaataataattattgttaaatattgtttgccaaacatttacctagattttgtgaacttgaattattgtctctgagttatgttcctacaagagacagctttttcccctacagtaaaagtgtttaaggctcaatttcctcaacttctgggaatttgggaaatatttggtttatataaatggttatttatttctaagccaattagaatagagctcctttaagagattctataacctaatttagcgacaccatcctgaggtagggaaatattttatttttatttttttcagagatgggctagattagaactcctgccttcagcctcctgagtagctaaggttgcaacttccatagtagctgaaattgtaggtgcatgccaccgtatctggccaacagggaaatattacatactctaacaatgagtggtgacttcctttctgaattacagacatgtagacattaaagcagagatagcaagaatttagtttccattctaacatttaagccatgggtcaagagtggacacagaatcacaaaacttactgtttcatatcaaagagctgttctgttctcatgattcttaagtgatttgagctcaaaacagacaaacagaaaagcgtagcaaaccaaattctctgttgtctttcacccataagatacaagatctctaaaagtcattaatcccctctcagagatcaccaagtggtcagaccacaaaaccaaagccagtgccagaaatcaagtgagtactaaaaccttgccttgctaccaatagacaagggtccatatcacaggaccaggagttagacttattcatagttccttggaccaggaatggagcacaaagggcccaaataagccttattacctgtgttgagtaaacaaagatcccagtgcaggagatccatatcatggcaccaaactatcaaatacaggatgcactaggtcattaaagagaagattttattcaaagcattgcaaaatggagaacattgatttatggtgaatatcttgaagaaaaggaagggggtctggggttctataggggcaagaaaaaacgggagtcatccagaagtcttataaaagtcatgaagaagggtggagatgggtcttatctcagaatatgggaaggcagtttgggcctttgcattagttgtttgccagacactaaagggtagagaggtttcttaatcattactcttttccggaagcacagggctcaggtaagattgaatatttttcatgcctttcatcctctctgtctgatctctttcaaactgtcttttttgttgaggctatatgaaatgtttactgttttaccttccaatcaactccataaaaacggttgatataaagcatctagccaagttccactacattttagtcattcattatggaacatcatcccaaggaaggctttattctctctgtctaagcaagcaatgaagggagatcttttggaaatggcctagtatttgatgagaagcaagaacaaggtctacattagtggatcacagactttttgccactgagatccaccatcgaaaatgcattcattattacctctgcatgtgtttatttaactgcaacaatagtttaatgattttcataacacaaaacttcacagtgtatgatgacactgataccttctagtctattcccagctgttctatttcatttttttatagcttatagtgactcattaaaatggatttccacgaatgcaatgcaacacacagtttgaagtccactggaaaatcttttaaaactgttattataaaatgaatttagtaaccttttcaaaattttactagtgtagtttctgtggtttttaagaatacaaatattttgccttctggtcttttttttcacacaagtatatggcagattcctataaatattttaatagatcagcagtttccaatgccatgtttcggtgatgatattttaccagagatagtctgtaatgaaaaattgagacaaatgatgacaatgtaatttgcagacatgtatacttatttataataaatttgtagacatgtatatttagttagttattcaacaaatattcagtgccttttatatcttaagaatggttcatgttaattggaggcaaacaagaaaggcaaagttactgcttagttgaaatttacattctagtataaaaattgccatatttattattattattattattatacttaaagttctgggatacatgtgcagaatgtgcaggtttgttacataggcatacgcttgccatggtggtttgttgcacccatcaacccatcatctacattaggtatttctcctaatgctatccctccccgctccccccaccccacaacaggccctggtgtgtgatgttcccctccctgtgtccatgtgttctcactgttcaactcccacttatgagtaagaatatgcagtgtttgtttttctgttcctgtgttagtttgctgagaataatagctttcagcttcatccatgtccctgcaaaggacacaaactcaaccttttttatggttgcgtagtattttgtggtgtatatgtggcacattttctttatccattctatcattgatgggcatttgggttggatccaagtctttgctattgtgaatagtgctacaataaacatatgtgtgcatgtgtctttataatagagtgacttataatcctttgggtgtatacccagtaatgggattgctgggtcaaatggtatttctggttctagattcttgaggaatcgccgcactgtcttccacaatggttgaactaatttacactcccaacagtgtaaaagtgttcctatttctccacatcttctctagcatcttgtttcctgatgttttaatgatcgccattcaaaccggcgtgagatggtatctcattgtggttttgagttgcatttctctaatgaccagtgatgatgagttgcgtttctctaatgaccagtgatgatgattttctcatatgtttgttagccgcataatggtcatttctctaatgttagctgcataatgtcatttctctaatgaccagtgatgatgagttgcatttctctaatgaccagtgatgacgattttttcatatgtttgttagccacataaatgtcttcttttgtgaagtatctgctcatgtcctttgcccattttttgatgggattgtttttttcttgtaaatttgtttaggttccttgtagatcctggatattagccctttgtcagatggatagattgcaaaatttttctctcattctgtaggttgcctgttcactctgataatagtttcttttgctgtgcaaaagctctttagtttaattagatcctgttcatcaattttggattttgttgccattgcttttggtgttttaatcatgaagtttttgcccatgcctatgtcctgaatgatactgcgtcagttttcttccagagttttatggttttaggtcttatgtgtaagtctttaatccatcttgagttaatttttgtataaggtgtaaggaagaggtccagtttcagttttttgcatatggctagccagttttcccaacaccatttattaaatagggaatcttttccccattgtttgtttttgtcaggtttgtaaaaaatcagatagttgtagatgtgtggcattatttctgaggcctctgttctgttccattggtctatatatctgttttggtaccagtaccatgctgtttgggttactgtagccttgtagtatagtttgaagtcaggtagcttgttgcctccagctttgttctttttgcctaggattgtcttggctatacaggctctcttttggttccatatgaaatttaaagtagttttatctaattctgtgaagaaagtcaatagtagcttgatggggatagcattgaatctataaattactttgggcagtatggccattttcatgatattgattcttcctatccatgagcatggaatgtttttccatttgtttgtatcctctcttatttccttgagcagtggtttgtagttctccttgaagacgtccttcacatcccttgtaagttgtattcctagggattttattctctttgtagccattgtgaatgggagttcactcatgatttggctctctgtttttctattattgatgtataggaatgcttgtggtttttaaacattgtttttgtattctgaaactttgctgaaattgcttatcattttaaggagattttgggctgagaagatggggttttctaaatgtacaatcatgtcatctacaaacagagacaatttgacttcctcttttccaatttgaatatactttatttctttctcttgcctgattgccctggccagaacttccaatacaatgttgaataggagtggtgacagagggcatccttgtcttgtgccagttttcaaatgcttcctgtttttgcctattcagtatgatattgcctggggggttgccataaatgactcttattatttttggatacattccatcaataggtagtttattgagagcttttagcatgaagtagcattgaattttatggaaggccttttctgcatctattgagacaatcatgttgtttttgtcattggttctgcttatgtgatggattacgtttattggtttgtgtatgttgaaccagccttgcatcccagggatgaggctgacttgatcgtggtggataagctttttgatgtgctgctggattcagtttgccagtattttattcaggatttttgcatcaatgttcatcagggttattagcctggcattttctttttttgttttgcctctgccaggttttgctatcaggatgatgctggcatcataaaatgagttagggagaagtacctctttttctgtcatttggaatggtttcagaaggaatggtaccagctcctctttgtacctctggtagaaatcggctgtgaatctgtctggtcttgggcttttcgattggtaggctattaattactgcctcaatttcagaacttgttattggtctattcagggatttgacttcttcctggtttagtcttgggagggtgtatgtgtctaggagtttatcaatttcttctagattttctagtttatttgcgtagaggtgtttatagtattctctgatggtagtttgtatttctgtgggatcagtggtgatatccccttcatcatttttttattgtgtctatttgattcttctctcttttcttctttattagtctggctagtggtctatctattttttaatcttttcaaaaaaccagctcttggattcattgattttttaaagggtttttcatgtctctatctccttccgttctgctctgttcttagttatttcttgccttctgctagcttttgaatttgtttgctcttgcttctctagttcttttaactgtgatgttagggtgtctttcccactttctcctgtgggcatttagtgctataaatttccgtctacacactgctttagctgtgtcccagatattctggtacgctgtgtctttgttctcattggtttcaaagaacttatttatttctgccttcatttcattatttacccagtagtcattcaggagcaggttgttcaggttccatgtagttgtgtggctttgagtgagtttcttcatcctgagttctaatttgattgcactgtggtcaaagagactgttatgatttccattcctttgtgtttgctgaggagtgtttcacttccaattatgtggtcagttttagaataagtgagatgtggtgctgagaagaatgtaaattctgttgatttggggtgtagagttctgtagatgtccattaagtctgcttagtccagagctgagttcaatggaatatccttgttaattttctgtcttgttgatctgtctaatgttgacagtcaggtattaaagtccccactattattgtgtgggagtctaagtctctttgtaggtctctaagaacttgctttatgaatctgggtgctcctcatattgggaatctggttgctccttgtatttggatgtgtatatatttaggatagttaactcttcttgttgcattgatctctttaccattacataatgcccttctttgtctttatctttattgatttgaagtctgttttatcagagactaggattgcaacctctgctttttcttgctttccatatcttggtaaatattcctccatccctttattttgagcctgtgtgtgtctttgcacgtgagacgtgtctcctgaatacagcacaccaatgggtcttgactctttctccaatctgccagtctgtgtctttaattggggcatttagcccatttacatttaaggttaatattgttatatgtgaatttgatcctgtcattatgatgctagctggttattttgcctgttagttgatgcagtttcttcatagtgtcaatggtccttacaatttggtatgtttttgtggtggctgttaccagtttttcctttccatatttagtgcttccttcaggagctcttgtaaggcagacctggtggtggcaaaacctctcagcatttgtttgtctgtaaaggattctatttctccttcacttatgaagcttagtttggctggatatgtaattctgggttgaaaattcttttctttaagagtgttgaatattggcccccaatctcttctggcttgtagggtttctgcagagaattcctctgttagtcttggactttcttgaagaaatgggcttctctttgtgggcaacttgacctttctctctggctgcccttaacattttttcctttatttcaaccttggtgaatctgacgattgtgtgtcttggggttgctcttcttgaggattatctttatggtgttctctgtatttcctgaatttgaatgttggcctctcttgccaggttggggaagttctcctggataatatcctgaagagtgttttccaacttggttccattctccccgtgactttcaggtacactaatcaaatgtaagtttggtcttttcacgtagtcccatatttcttaggggctttgtttgttccttttcattcttttttctctaatctcgtcttcatgctttatttcattaagttgatcttcagtctctgatagtctttcttctgcctgatctattcagctgtcgatacttgtgtatgcttcgcaaagttctcatgcagtgtttttcagctccatcaggtctttatgttcttctgtaaagtggttattctagtaagcaattcctctaaccttttttcaagtttcttaccttccttgcattgggaggagcttgttattacccaccttctgaagcctaattctgtcaattcatcaaactcattctccatccagttttgttcccttgctggtgaggagtttgtgatcctttggaggagaagaggtgttctggtttttggaattttcaggctttttgcactgatttatcctcatctgtgtggatttatctacctttggtctttgatactggtgacctttggatggggtttttgtgtggatgtcctttttgttgatattgatgctattcctttctgtttgttagttttccttctaacaggcctctctactgcaggtctgcaggagtttgctggaggtccactcgagaccctgtttgtgtctacggccataccaccctgaatgcgcccgatctcgtctgatctcagaagctaagcagggtcgggcctggttatacttggatgggagaccctgtttgcctgggtatcaccagcagaggctgcagaacagcaaagattgttgcctgttccttcctctgaaaactttgtcccagagggacacctgccagatgccagctggagctctcttgtgtgaggtgtctgtcaacccctgctgggaggtttctcccagtcgagagggatggggatcagggagccacttgaggaggcagtctgtcccttagcagaacttgagcactgtgctaggagttctgctgctctcttcagagccggcaggaaggaatgtttaagtctgctgaagctgcacccccagctgccccttcccccgggtgctctgttccagggagatgggagttttatctataaacccctgcctggagctgctgcctttctttcagagatgccctgcccagagaggaggaatctagagaggcaatctgactacagcatctttgctgagctgtggtaggctctgccaagtacgaacttcttggtgctttatttacactgtgaggggaaaactgcctactgaagcctcagtaatggtggacacccctcccctaaccaagctagagtgtcccaggtggacttcagactgctatgctggcagcgagaatttcaagccagtggatcttagcctgctgggctccatgtgggtgggatccgctgagctagatcacttggctccctgactccagccccctttccaggggagtgaacagttctgtctcactggcattccaggtgccactggtatgaaaaaaaactcctgcagctagcttggtgtctgcccatatggtaaccagttttgtgcttcaagccatatttcttttattggaaaatatagaacttttccttctcacattcaacttcttgagaggatctctttgataatgtgttcatgtacacagttcacatcaaatatatataacatgtggatcaaagtgttaagatattcttctttacatatagtgttagtagctgacgatttttttttcttcaaaaataaatttggaaacttgtcagtccataatttttttaagtattattttactatctcatgaaatctgaaaggctagaatacactagataactcttgatttccactcctaccctgccatgaagtgataattcacatctggctataacttcataaaaggggcagggcgacccacttcctaaaagaccactattgacttgaagacctgtgtctcttgtctcacttctaaaagtgatttaaaactcaataactcactctgaaatccactgtataagaaatagtaatgtttagggtcatttaaaagaaagattagtttaataaattttggcaccctgtttaacatataaaaccatgaccatgtgttaagtataaccatattttgtgcagaatgtgattcaaaagactgatttaatagctatagtccaagaagtgttgaaaactcttgcccagtttatggtttccaatataggacacatatcaacagaataagaaactcaagaattaaactgatgactgtgtcgacctctggaggaactcttttttaagacacaaagccaaattttcaccttcatttatgcacactcatctcctgaaggcttccttatgcatttacgtgtgaaggaaggagaggatttgactcagtctctttgtctgtcatctttcttcctctctcattctgaaatagcttttcacagttgaggaaaaaataaagatttgaccttcccacagtgaatgataacaatgataacagctgatctttatatagtgtttattatatgacagagatcatttcatgcactttgcttctaagaactcatttattccttacaacactgtaagtactgttatccccattgcacagacaagaaaaatgagcttctgtattagtccattttcacactgctataaagaacttcctaagactgggtaatgtatagaggaaagaggtttaattgactcacagttctgcatggctagggaggcctcaggaaacgtacagttatgtggaagaggaagcaggcatatcttacatggtggcaggtgagagagagagagagtgtgtgaaggaggaactgtcaaacacttataaaaccatcagatctcgtgagaactcactcactatcacaaggttttttgcacagacaaaaccacccccatgatccaatcacctcccactaggtccctctctccacacatggggattatggggattacaattcgagatgagatttggatgtgggcacagccaaaacatatcaggtacaaacaaatagtggagttaaaaatcaaacatggaccatctgcctctgtagtccaggcccttaaccactacattatataacctcttgagagaggaaaacttagattgggcaatattagcatccaattgccagtgcaaaaggaaatggaagtcagcacaccagcttattacttacccgagatcaataagagacctgcaaatacttgactccgggttatagacttggtaaatccaaatgatttctctcatgaatccgaatccctgccagtaatgcagatattctaacttgagacttaccttccagactgaaaatgccaaatgagaaaaaccaagtaagtttgagtttctgcagttacaaagtgctatggtttgaatgtccctatcaaaactcaggttgaaataaaattgccattgtaatggtattaggagatggggcctttaacaggcgattaggccatgagggctctgccttcataaatacattaatgtcattattgcaggagtgggttagttatcacaggagtgggttagttattgtgggagagggttcctgataaaagcataaatttcacccccgtccactccatcttcagtgctcacttcatccttccaccttctgccatgggatcaccatccccagatgccagcatgatgttcttggacttcccagccccagaaccatgagccaaataacttctcttctttataaattgcccagttgatggtattctgttatagcagcagaaaacagacaagacataaaggaagacacataattaccctcccccaacagttcatgttacccctcaacattgttttagtcagtgcaagactaccaaagtataggtgtctgaacatcagggaaatgtaaatagagaaggtaaatgaattcaaccttccttttccctatactctcatttctgtcaaatataaaaacctgtgggttttacccttgttccagtttacataatcacattccaaattacttatgtggacttttatgagggctttttttctttacacctctctccttttctcatcagcctctgcaatcagctttatacaagagttatatttcattcatttcattttcttttctttctatttcacaagttctgggacttggctgtcaaccgaatcttgaacttggtaattaaattgttcataagctccaaacatgttgtaactcatgtcatattcatgtacacttctctgccccaacttgataaaatgagtgatactgggacaccattgtcatacacacctccaaacctgggtgtgtccacttcaaatgcctgaacttgctcaaatagaaatgggattactaaaacaactatatatcctcaccatgctggttttagtaggaaagatgcatcaaggataaagctctccagtgaaaagcatggggctgaaagaaggaagtctctctgaggcagaagtcctttggaaaaactgaagatgacgtcctagataattttgaagtcttatgtagcaacagaagtttatgtcattaatttagcaaatagtcatagacaaaacatgcaactttagagcaagtgccaggctgtgccaataattccacccttcacctccacatggggtcagtccatagaacaaaataccaaaggccttagtgctcaggtcttttgctcctgacattctcccttcatcctttccctatccccacttatccttttttaatgcactatagatgagtatgtcttaatttcttaagttaatttgcattggcattaagcacctactttatttatttcctttctcaacaactctcagactttgattcttcatgtccttccagggccctgccccatgccttctgctaaatgctaaagtcatgcaacagtttagtactgcgtagagtaggatggctagcaaaaggaaatctctcaaaggagcttcatgctctctgtgactcagggtagcagtatatggccttcggcacccactgtgggctgggctatggcagactttgcttgccctcattgctctctttgctttccttgatcttgcccctgtctgtcttcattttctcccttctcacttttttccctattgttacttacagtttaagttatggaagaaaaacacttaatgcttattggccactggaggatacacctcataacttggaaaatgaaaataaacactttaatagttttgtacttgatatgatgactcttttaaacaaaacactttttatctaggcatgaccttagatttatgggaaaagaaagttgcaaagatagtacagagagttcctgtatacctgtcttctagcttatgctaatgtggaaaacttacataagtgtggcacagttgtccaaaaaataaattcacattggtataattctattcactcaaattcagactttactcatatttcatcagttttttcattattatcctttttcttttcccagatctaattcagaataacacgtgtgttactacatgatgatttaaaatgtttacaaaaacaagacctctacctatgctcctattagtgtgtgtgtgtgtgtgtgtgtgtgtgtgtgctggtgtgtgtatatctttatttaataataaaactagaagggcaatgaattcgaaacggaggcttttcttactagcctttttaagatagacattgctgacacatggacagggattgaattagtacaaatattaaatatcattaagccttcttttttgagttctgtctgcacatcaacttcacctgaagaatgtttgtaaaatacacatgcttgttccccacccaaaatctattgaatcagaatctctagggagtgaggaccaacagttgcgcttttaacacctccactccccccttgtattggacggtaaaggccagaaaagattaccttaggcattctcatttcagaagctaaaacagacattcaattttctataccctaatttgggacttatatctgagtgttaatatatgcatgtaatactttgtgatgaatgttaaatgtgttttaatagtgttcccttgcagaatattctttcctttgccggtattattaagactatcttgcattgggattcatgcccccaggcttacagttctctgagctatacttgcatacactgtcctcagtgaacctgggctttggatccagatcgccttgaattcaaaccctagatctgccacttaaagactcaagaaacttacataacctttttgtaattgttctctatctataataaatgaaaagtattactaattattacttacatgcaagattgttgtgagcgtaaaccacatgatgtgtggaaggtttggggcacagcattctttaccaattcagggtaaccctgaaaacttaggaaaaagagaggattcatataaatcacaaattttgcaaatgcattttaaatcctctctttgttccagctccttgtacagacaggactgcttgctactaagaatttccaacacaacctccaattaaatagttctttgatgtatagtgggtacagaagaagtccaacttatttgcatttgcagaatcaggagacccccccaaaaaatgctggaggtgtgaaagcaagaatcagaatttgtcaggattctccgtaaagtactagcggttttgtagatgctttgcagctgtggaactataaacactcaaccgcagacacctcattttatatctcttctatgtggtatatttcccttgtgaaaatgtgtatttttaaaattcactctgcaaaatgacagtcaatgttatcaaatatacatttatatgcccttgattgtaaaacccactacaaagtttattaccttaagtttaatagaaaacaattttgaaaaatgggaaaaaaatatatctgtcacagggaagtggttagaggttctaacagaggagatttcttgttagaataatttgttgtattttggttatacattttttgtttttctttcgaatgttgaaaaagttaagaatatattaatacatggacaggttagaaaatatgtaaataataggttggtcaaatcctgcagatgacaaatcatgagagtttgccaagctaaggggccctggccactcataccatccctttatctaactcttcctcctcatccagtcccataataaaaaatattaagcttgcacgtggtaccttctcttctaggctacttgttaatgggtcctcttaattggctatgtataaaataagattcccatgggcagaaatctttatctgatctgttcatggacatatccaagtgtcaactagattttggcacacagtagatgtttggtaaatatgtattgaatgaatgacagacactgtgctccacattgtaaacacatcatatcatttaatcattataacatccctatgctatcccctatgtgctattattagctccatggtacagacaataatcaggatagatcaggaaactaaccaaggttacacggacagtacctagatggcaggaggccccaaagcatgtgtactaagcattatggcacactgccttcctgtctggcattcttgggacatgcatgtgtgagcgataaggtaagtccaggaaagcgtggggcactgggagaatgtagaagtagggatgatggaatttcatttccacagtgagagccccccatcctgctcccattgtcagacccgcactttttgttatctcttttccttctgtcttgctacgtttgctttgtcttcttcctcgatagtttcccaaagactttaaacgactaactatcaaagaagagaatatatgtgaagtcactagttacttttctgctcaattagctatatatagattaactttttaaaaaaatattttccccatacacccactcacataactgtgaagcttaggaaaaatttcaagattatcgtgggtgggccccatataaatccccacactgtcaattctcccagcagctgtttcttaattcgtcatcagtgtagaaatctaaatcagcactcagtgaaatctaaaagtccaaaagatttatttcaaatttcaaacctcctccctaatgttctgaggctgtgtcaacacaggtagagagacggggagagctgagggtatttaagaatcacataatgtgagaaactgaggagaccctagggatcttttagccctaccccctcatttacacataaggaaatgggatctgaggccaacagcaaacttgcctgcctgctatctgggaagttctattaataacacactgtcatgggggaaaaaattcatacaggtaataaaggtttgttattttcaaagattaacattctttattaattaccacttttttgaaactgacacagccacaaaaaactcctgtataagaagaatttgtctaataaattgtatgattgtttattgggtatctgtttattttcttaatttttaattgtctgtcaatccttcttgatttaaagtagtcacataaatatataaatgtaaagagttaatataactaattgaattcatttgagggaaaaaaattaaattttctttttaaaaaaagaaagaaaacattaaagacagaggtaacattagcacaaaaaaatgtgtataatcaaagtctagagggaggcctaaatgtaaatcaagctttctagtaagcaaaaacaaaagagaaaacctggttaactccaaggttcagaattgctgtgatatgcagacaaaccagctgtgaagacactgcacaacagtctatgataaaaagacgggagggacatttcttgtttgtatagcaaaggtctacaatttgcaatgcactgtggtaaaacagaaaccataagctgaatgcttttgtcactgaacttatattttagttagaaaagacataagaaactaattgtggcatttaacttataatttagttagaaaagactaaaaaagctaactgtggcatgaatgagaaagaaattactgctctattagtggttccaatactgtgaggccacaggaaaaaaaaaaaggattctgaaagatacggtttggaaagacttcgtggaggaagtggcatatcaacagggacttgaaggctgcctagatatgcaaagaaaaagttcaacggaaatacaggatgaaagaattgggtggtcaaaggaacaaacccacttgctgatagattgtcaaaaagtatagtgtctgcactactatgtgacgatgacattttttttccctttgtcatctaaaattgctatcaggccgggtgcagtgactcacgcctgtaatccaagcactgtgggaggccaaggcaggaggattgcttgtgtccaggagtttaagacaacctggcaaatatggtgagacctctctacagaaaaaattttaaattatctaagcatagtggtgtacacctatagtcccagctactcaggaggctcagataggaagatctcttgatcccaggaggtggtggctgcagtgagccaagattgtaccactgcactccagcctgggcaacagagagagaccctatctaaaaaagaattaattaattaaaaaaataatattgctgtcagtaaagactgactagtctgtgtgatatttatcatagctatatttcataactccagtgacctttttaaataaaaagtaaggtccagttgaccctccctgtctgtaggttctgcatacattcaaccaaccatgggtcaaaaatattcagaaaaaaaaatttaaaaatacaataaaaactaatgtaggctgggtgggtgcaatagctcacacctataatccttgcaatttgggaggctgtggctagaggatcacttgagctcaggagttttaggtcagcctggcaacatggtgagaacctgtgtctactaaaagtttaaaaaattagctgggtttggtggcatgcatctgtagacccagctactggggaggctgagatgggaggatcacttgatcctaggaggtggaggctatagtgagccatgattgcaccgctgcactccaacctgggtgacagaatgagaccctgtctttaaaaaaataataaaaataaaaatcaatacaatataacaactatttagatagcatttatgttatattaggtattacaagtaatctagagatgatttaaaatataggaaagaatgtatgtagcttataggcaaatactacgccgttttacatcagggacttgagcatttgcagattttggtatccttggggggtcctggaaccaatactttgaggatactaagagatgattgtccattaaaaatgttttaccataaaggaaacattttatctcttctgtgtcagtctgtgaccttttgggtggaatctgaacaatgtgtaaatgatagtttcccaacagtgtgcgctgatgtgtaggagtagaaaatgatcctttggttttcatataaaaactttcttatgaaacatgaagctaacaaccaagaagattaatcccaccagtgagacacaaggaatgcttaattttggaagtgaagctacttcctcatccctgaggcagcacatacactttttcaataatcctttatttaacaagatccaagaatattaatatctaacagcttagcctaaatttcttgaaaggaccaagcccattgtgttgtctcctgacttgattttcccaaactgtcatggattttctatctaaggaagatgagttccttagttctgggaaaacaccattgaggaaggatgcttcagaagaggaagggatgtcagccagggcagataaaattagcaagaaatattaagattaagtgctatctaagaggtacaaaaaataatagtgtttcacctcaatagaatcttattgttaaaaatacagtgtatctacagttctgaagattatcaaaacacaatattctagccccaaaacaggaaaagaataatgattcttaagaaaaaattctttctgggctgggtagggtggctcatgcctgtcatcccagcactttggaaggctgaggtgggtggatcatgaggtcaggagatcgaaatcatcctggctaacccagtaaaaccacgtctctactaaaaatacaaaaaaaaaaaaaaaaaaaattagccagacgtggtggcacatgcctgtaatcccagctactcaggaggctgaggcaggagaatcacttgaacctgggaggcggaggtggcagtgagccaagattgcgccactgcactccagcctgggtgacagagccagactccatctcaaaaaaagaaagaaagaaaaaaagaaagagagagagaaagagagagaaaggaaggaaggaaggagggaaggaaggaaggaaggagaaagaaggaaggaaggagaaagaaggaaggagaaagaaggaaggaaggagaaagaaggaaggaaggaaggaaggaaaaatattctttccatccattacacactgtaatgtaaaatgatgtgtcccagacaatggtctgtaaaccacattttgtaattccattgtaaaagataatgtagtgcgagcaaggccaaaaatccactattctttggaaaagtgtgccatttaattccactgaagataaggcagttggcacaagtcaacttttccccctggcttagatgtagttgtgcctttcaaaatgagctctctcatttgccaaatacaaagaagagaatagtgttttctcagaggaccacaggatatcaaacataattaaaaataaaagtaagattccctttgaatctagaagaaaactcacccaaatttcttgtaccaaatgaaggtatactgcagattttatcacagtcattaccatgagcagtcaataattccctgaatccctgttggacagaattacatcaggtacatgtgttgtgatgttttctgttttgagttctgtttgttttttatttattggtaattcagataatctcagtttcaggaatttgttttcttctctcctaaaatggagctgatgttcatctcttccttatgttatacctgtatttatgcaccaatttcatagaaaaccatcgtgcattttcccatggaattttgggtgacagtttaagatcagcgtttactataatgggcagacttaaaatggtccccgtgatccctgactcctgaagttcactcccttgtatgcttccccctctttgaatgtcagcggacctttaacctagagaatacagcagagttggccagatatatgtgattccatggttatcttatgtaagattggagtgcatgtcttgctagagtcttttacttccttattgactttgaggcaccaaggggccatattggggaaccccacatggcagcctccaactgagccaccaaagaagtgaattctgccaacaatctgaaggagcctgaaagcacagccttccctggttgagcctcaaatgagactgcagccctagccagtactttgattacagctttatgagatcctaagtaaagaaacaagcataactgagtcaggattcctaagccacataacccgtgagataataaatgtgtgttttaagtggctgtatttgttatacagaaataaaaaatgaacatacttactaaaaaagtttttagctgttgtgagtcctggtaattggatttgttttccagtgatatccatggacactgtgtcaatagtgatgattgatgctgatttgttttactcttatttattcaggatctgggtattaaaaataaattcaaactttcaacaggctgatcacctctgcccctctccctattagcatgtgcatgtgtgtgtgtgtccatgtgtccatacatgagtgaatggatgtgtatttaagcttaatcatgacacagggggttgtttatacagggtttttagaaaacaaaaacattgtctctatgaggcagttccttagaagccaactctcaacagtgtctcagtgtttccctcctgtaatttttccacacattatgcactggattttagtttgtgatactcaggattagtcatgaaaccaagtctttttgtgttctatggtttgaccagccctgtgcaagtctccagggaagcacgaaggacgggtaaatcagagtcccatcccttgaagcatggtggtattagaacatcacttaaagaacagggatacattacccatttagtgaaataatctagaagtcctggaaactaacttagctcacaagatgatattcattagccaatttacttcagaaactttaagaaaatcactttacctcctctgtacattcctccttccctccttccctctcttttcctctctccctccctccttccctcccttctttccttccttccccatattgttattaaatatgctcattattagaatagtatcaaagacactgaggcatttttagatatcttgtgaaatactccttatttttgtctcttcctttagatatcttaattatcaaaataatctaataagactctatttggaaataaagtgaaggagggtaaagttgtgtttttaaataggctgatcagtgctagaaataataggatagttttaaattctagcaattatagatcaaggctccatatactatttctaaaaagtctgtgaacccctgggaattgtgaatgtttcccattacatcctgccaacgattcttattaacctattggtgacgtctttcccagaggtgaagctttgatctgcttgtcatctcacattctgtctcaccacagtctagagcttccaggtccatggggaacaaggatggggcagcagcttccctgtgccaggactgactgggaaattccagaattctatgaccaggtacctgggaagggagaagagctctctgagttacagttagtctgggagcttttgaagtgaaactgtcatagggaaagtgaaggaatttgctttgtgcaatcatcatgccatagtctgacaagacaatggaaaaagaaagaaggaattttctctcaagatgtcaaataattagctgagtcatgaatgcaagcaggtaggcagaaaacagatatttgtagagaacttatttctctttctcctaatgaagtttttgaacaacaacgataaaatggaccttttgcctaagaagcaatttaacaaccattgcttcagtaacacgagaaccaatgtgattagagtgcttgtgctctgtcccctcataaatggttagtattgaggccttataaagaaatataacatctgctttttatacataaatacctacacgtaaccatccacaaataacttacgaatacccataataaacacagaatccatcattatgttaaatgccactgtgattctgagcattttaatatgctgtgaaggcatcagagtaaaacagaaacaagttatatctaaataggaatgcccagtacatttaaagtaatgagacgttttgctaaattcatatgttagcaatatgtcatgtggagtcatgaaggatcagaaataaaaaacagtaattgtccaagccgtcaaggagggatcagaagcaggctttgatcccaggctctgagtagagttgctgtggaattgtagattacatagaatacaggtggcatcaccacagattcctgtttatgtatttaacttgtaacttctcattctgacatcacaggaatatttttccttaacaaagtgaaataaaaagtaaataagctctttaatattgggacataaccaaatcagagggcaacacaaatttacatgggtacttgtgaggcaaaagaaagaaaattcaaaattcacttctaaaaatggacattgtttaaagcacatttaataagtgttacagagtgatgtttcactgtcacctttaaataccccttactgtttctttgggattaccaatttcaacatgaaggtccgagtgaactttgctagaggtgatttgcacaggctcatatgcatctcttcctcatattcagtgacctcacattagcagctttaaattggccatgttgagaacattgacaccacagaaattggcaaaaactagaaatcaagtaacacatgctacaagtctttttttttcttttctcccttcttggaaaattgtaatccagttgttaaatatttatcattataaagtagatccttgttaaaaatattctaatcctcaccaatggttttattttctttctgcctctcttctgctgcccctaaattaaagtaggtctttttatttggggctaagactagttccatcaaaatataaaatagatgaaaagtgttttggggcctttttgccctcttttcctagaccttttctgtttctcctcttgtcaaaatctcacttttttcctttaccttttcagccctgcttcagccctaggtcttcctaaaccagagaattttccaaaaactgcgtgaatatatatgccacaggctgaaatagtcttcccaaaaattagtcattaaaaaagtagagaaagaagatataagttttacatgaaaccctatatagataggagttccttcgagtattttcaaacttgattaacaacagagtaaattatttaagaatgatttaagaaatcaaagtatgagaacttggggctgatccaaagatgtggggattcagagatgaggggcaggcatagaagaggagaagagactgagtatttgtcaccacgtaaattcctgggcgagttgggtaaattttttattataagaaaacactcctttttcttctatataaaatttttttcaagtgagttgctaagttcattgtgagtcatgcattcctttgttcaagtgtggacaaatggtccttattttgttggaattttacactggcagagatcaatggtacaacctggtgaaccccccacaccaaagacacacaggtgtacttaaaggctgatcttctacagtacgcatctatggactggctttggggtgtgttcccaaacactcagagccaccttgagctggggaactggttagtacaagtctctttatgtgtcccttactctacaatcatgcacctagggtcgtgcaaacatcctgaaaccaacccaagctctaggagtcagaaaaggccctgaatgcatcttcaatacaggatctgtgcacacagcatggcctgcttctagaaaaccaatggggctcagaggcagtccagacagaggccttattttaagggctgatagaataggctgtgtttccccaacagcctaccttggtgagtaaacaccaacaattaattcatttatttactcactcaggttagaacattgtgttttcaagtttctaatattaaatttctttttcttttttctggaatagggactatcttattcagctcaaaataccatagactgaggcttaaacaaagacatttgtttcccaccattctggaggctggaagtccaaggtcagggtgccagcctgcatggcgagggttctggtgagaactttcttcttggcttgcagatggcagccttctccctgttcccttacttggcagagagacagagtgagccctggcatcttcctcttcttataaggatgctatattccatcatgggggcccaaccctcatgtgcttatttaaacctaattacttcccaaagaccccacctccaaatatcaacacattgggagttagggcttcaacccatgaattggtagaagggcgggaggtggacacaaacgttccatccataattctagctggtaacatcattgttagaatcagttgccttgccagtctcagaaaacaggacactgagatgcaaagacatgtacatttccatttgaggcaggtgccaggagacaactgagaggacactgagtttagaacattggatcaggcattgagagggaatctgggttgctggatgcaagaggctagtaaggggtgatgagagttcttcacataaatcaacctataactcacccagcctctgtgtcccaggggcctatccattattgatcaaaatgtcagtagaccttttgggttgtgtttcaaagagtaaccattatcttagagattcatagcaaaatatgagtggttcccagtaaaataaatcagagtttcctttatcttagctagaaacacctattgggacttttgtcaaattatttaggggaagaagaaggttgaaagcaaacttccaattgaaaagaagcatatttattgaagttcagagggctggagcgttgttttttgattgacaaaataatgaactctctgataagagtccagaattagttggctgaatttgtattcatttctccataaatttgccaaagttagaagagaaaatccatagaggccaaatgaagaaccatttgattaagcgtgttatcagcctggttgtggccaaattccacctcatatattcatgcacacattctttgctatgagttgcatatgtgctttgtggttgtgggcagatttaggtttgtttttctttctgagtcttttctggtccaaaagctcatcatttaaagttttggaagcaatttagaaagctattagattcccaaccccctcccgacttttggaacacttgcagttatttttttctggcacaaaaacaatcaaaaaggaaaaaaatgtcaggatatcttccaaagagagacataaaggtaacattttatttataccatgatttgtttattcttatttgttgttaccataaaagttatttaatttttttgaactgaaaggcagatgattttaggggataaaaaacctaaaataagaagtgttgctatgtgattacagagaatagttgcttttgttctgcctgtgtttaattaaagcaccatttgagaaattcaagaatcaggtggtaccgttgagtcactggacacatttttaagcaccatcttgaaatgtgatataaattgattttaaattttaaatttgtaatcatacacttcctctaaattgggaatcatgagagcatttctttttaagtagtttgtgataattttggaatttgaaagaaactttaaaggtaatgtatttaaagttactcacagaaatatgctggatgtgttgactggtaactttaaacatgtttatattgctatttttctagcacttgaaaagtaatcatgttttatagccaaagtcatctcctgtccatagaacaattaatagtcataattgatagttttatgcatgaaaattaagtattgctcctgcaaaactgaggagttaatgtctttacgtgctttttcacaaacattccttataatggaacaccaaatgcctacaatttgaacacatggctggtggaaaaaaagaagaaaaagaaaatcaatcctaagccagaaatctgaaaaaagacagtgactttgggtcattttgtaatcatctttggtgcttcagtgactaaaaaatacatgcagagtgcaagagcaccttgctgaatcctacaccctgccctccttgtgcagttatgttacatgcaactccaaagcctccacagctgttgtctctactctccattcaaaacaatgcacgtgcaactttcccttgtggctggcttcgtcctccacacaccaatgctttgtgtgaaaaggtttcattaaaattgagtttagggtaagtacgggataggtggagaaaagattttcttctaatgcttctccagaccacactgtttagccttcaggagacccaggaattgatatgagcaaaatgtttttacacatgaactgttctttaatcccttttttgcttcttcaatccttgaacttcattccctttcttttcattaacatttacaacacacactttacagggaaagaaagtgaaagatatgtaatgattctgcctgctacatctgactgtactccatttctcacattctatcctcatctttttctagccacctgagtcttcagacagttttaccatcttccctattttaaccccaatttaaacatccacaggaagccaaacaaaatatgcccatctgctccagatgtgtcaaatcaagttctgctattttaatttttttccaggcaaaccctccaacaaatgtataaacaggttgctttttagaagaagtaaagattaatgtctctctgggaaaaaaaaatcccatgcattttggaaagtctggctgttttccccttcaaaaaacttcatgtaaactaaatgcatggcttgatcctcccatgtaccagaaggggagcagcatctttgagctctcttcccaaatcctctgcttggtctgggcgtatcctgtgaatgaggagagaatctaccccacagccagatgcttgcatttggccacagttcatttccaggcagcctggaagagagcatcccacaacattgaacagaggcagccaagatactgtcgggtgatcaggacagctcccgcctctgtgttcctgtggagcctccttcctctccaaggaatttgtcgcatgggactgcataattcagttgtccattcagtcaacagtgatttactaacaacctactttgtgttaggcactgttccagggtctgcgcattcagcagtgagcaaaataacacaaaatgcttgctctcatgaacctggagacagacggtaagaatatacagcgataggcaacatggtaggtggggatgagtgctctgaattaaaataaggcaggacacagagatggagagtgacctggacaggacagggttggcagctcagaagtgcattatctacagtggtcagggaagcctctccagtgaaaggacattaagacggagctgaaggaagggagagagtggatgaaagagcaaaatccctggaactgggacatgcttggcaggttgagtgtccacaagagccccaattaactacaggagggtgagcaaggagagagtagagggagttgaggttagagaagtaaccgtacgtcaaattatggaggactgagtttctcaaactccagtgtctgcgcaaatcccccagggatcttgtgaaaccacaggccttgatttagaagatctgcggcaggcccagggtctgcattcctaccatgcccccagatgatgcccctgcctctaccgttccccagaccatgctttgagtagcagagatgaaggccttcttgcccacagtacaaattctgctatttctttcctgttaatttgaattggtatgcaacaactgtacatatttatgggataagagtgatatttcagtgcatgtatacagtgtgtaatgatcaaatcagggtagttagcatatccttcactgtgaacatttatcatttcttcatgttgtgaacattcaaaatcctctcttctagccttctgaaaagataccccagagtattgttaaccatattcaccctacagtgccacagagcactagaattcattcaccctatctagctgtaactttgtatctattaaccaaactcttttcatctttcactctcccatacccctccctgcctctaatgactacaggtctatctctgtttctctgagttcaatttattttagcttctacatatgagtaagaacatgtggtatttgtctttctctggctggcttattttagttaacatgatgttcttcaagctgatccatgtttgctgcaaatggcagaatttcattcttttttacagctgaatagtattccattgtggatatgtaccacattttcttcatccatccatctattgatggacacttagattaaaggtactctgcttttactatgagtgaagtggaaattttttgaggcttttctttttatgagacaggatctcattctgtcccccaggctggagtgcaatgtcacaatcataattcactgcagcctccactcccagggcacaaatgaccttctgcctgagcctactgagtagctaggactacaggtatgcaccaccacaccctgccaatgttatattttttgtagaggaaggttctccctgtgttgatgaggctgctttggatgcttttaaatagtggggaaataggatcagactcatttttagggagcccctctggctgctctgtgaaaatagggcaagggaggaaataggagacctcctgggagataactggagtagtctgggtgagatacttcagtgccagcatctaaggtacttgcaggtgggacagccacaacgaatgccacttcaagtgaatgtgaggatcagctctgctgcccacgtggaaacataagtaaggttgttacctgtggccttgcagaagcctgcaagtcaaaggccttttgatggttggtgaaaatcacatctgatatgcgtgattccaggaagctcatctgcctcattcctgaatttaatttctatccatgatgcacatattactattgcattaaacgtgaagtcattgcctcctgccattgtaatgtatgcatgctattgcagaggaaatgtttttatctacctcccaaataagtaagcataacttgagctcgcattacaaaatgacacaataaactaaaaaggaattcatttaatatttttaaacatgattttggtgtccttatatttagggaaatattttattgtaagttcatcttacaataaaatttataagggaaagatattttattgtaagttcatctcaggacaagaaacttcacttggcatagaaattaacatccaatctgcagcctgtcattgtagtgagatagtcttgaattccctagctaagttatttacctaaacaaagtcttgttcactttgaatttcctagctaagttttttacctaaacaatcattatatatgtttcaaaatatttaaatttttcccttccctctgattttataattttcttgataaaccttcctaaatatctttaaatttcactgatctaatggttcttaaccaggggtgattttgccccccatcaagggatatttaacaatatctggtgacatttttaactatcgggagttgggggatgctactggtatgcagttggcagaggccggggatggttaagcattctgcatacctgggagggccttccataacagaggatcgttcattccaaaatgtcagtagtgccacatttgagaaaccctggccttctggtgaccacaaggccttcagctacagaaaataaaattcaccaaagatccccacagccatgctttgaaatccttcacagtttgcactgagccatgcttcccacaggctgctccaatgaaggggattactctgaaggccagctttggctcctggattctccaacatccgtgccaaacctttcttatgcagcacagtagcctcagacatttccagctcactcccacttttctctcaggacatttttcctataaaattcttgcacatttaatctcatttagaatctgtttctcagagatcctggattaatatatcatggcattaaatcattgaaaataatgaattaatgatctttcctcattgtagtgatatgggaagaaaacgttctgatacacagaacacagaaatggctcagaaatgagaaactgactgactactaaattgttagtaaaagcaacagaataagtaagtgaaaaatagagcaatttggggggaaaaaaagttgagaaaccccaatcttcaaaaaaaggataaaagtcttagcttttgttcatgtgttatttaaaacccaactcaggcctcaactgaaacaactaaaattaggaaccaaaattgcatcccctgcccattcacacttttggaaccagagtggttctggacatagtcatgaggtcatcattcctaattagagtaggaatttcaattcttgggtttctaacccaaatctcgctatcctcagaaagcttgacagtatttgcagctctgcccattagatgagatctaccctttgcctttggtcaggaagagtcctatgtatggacacatcaccacagaccactcagattccctcttaccttccctaggacactctgcctcccttcctcctttccatgatactcatcactctgggtagactctgcccaggcaacaattgccctctgtggtttgccaagacccatcctgctttctgggaatagatgagtccctctaaagatgggcatgtccccagccacccaccactgtgcaggtggcagctgacgtctattgtcctgcaactcacatatcctgatctctgctctgttatgaactccagccagagaaatatacagatcttattcctgattcataagagactgtgtttgccttggatttaaccaggtctgatgactttcaggatttattatgttgatgaataaagggaaattctctcccttaaactaacacaatgatctctctgaatcagattctccctatacgcagccagcaatactagagaagccccagagacgctgctacttgagggctggcctaccgcagagctggcgtttatgttgtgatgataaacattcttgaaaaaaccctgaaggagatcctggcattttcctagtgcctttatgtgccataccgagtgcaagctgcttttcatgtactaactaatttaattcctgcaagagtcctgtggcatgggtatttcttattcccattttactgacaaggacactgaggctcaaaaagttgtttttttgttttgttttgtttttgagacggagtctcactctgtcgccaggctggagtgcagtggtgtgatctcagctcactgcaacctcagactctctggttcaagcaattctcctgcctcagcctcccaagtagctgggattacaggcacgtgccaccacatccagctgatttttatatttttagtagagatggggtttcactatgttggccagaatggtctcgatctcctgatctcatgatccacccaccttggcctccgaaagtgctgggattacaggcgtgagccaccacgcccggccaaggctcagaaagtttaagtgacttgcccaatatcacaatgttagtaagtggtagaggtataatttggattttatttgaattggaaaaggctgtgatctttctaggtgatattctaggtaacactagtttccagcaggcactctccattacctgcgtctgttaggtctgagtctgctatggttttctgactgatgtgtagggtaacacaattaaggaactctccactggaaggccaagtctccactcaggcacgtaggtagctggcagtcctccttgattctgctagccagagccagcttattgaaaacaaaagcagtctgttaggacagtgcccagacttctgacttcactacggaggctaggaaccaagtcaatatcatcagtcattactttccatcaacctctatcatttacatgcagtaggtgctcagtaaatgctgataaattcctgtatgaataataaatgaatgaacaaacaagagcatttgtctgtacaagttacagagttttagaatagaatgtaagtgtgaagctcgataaattcaaacttctgcaatatccccaccaagtggttatctaaattccgtttgacttcccttggcagggaatacgcacgcacactttctaaaggagtttttccacttcatatgactctggctgttcagaaggaatcactaattaaatgagatctttgaaaaaagtcaagaaactggaaataagtaggaattgctttacctgatgcttatcagcttacaggctttactgctccaaaaatttggttcgatttgaaaacattatgctaagtgaaataagccacacacaaaagggcaattattgtatgattccttttatatgaggtacctagaataggcaaattcatagagagagaaactagaatggagattcccaggggccgtagagggagagtagttattgctgaatgtgtttggggtttcagtatgtggtgaaaaattctggatacagatgctcacatgtcattgtgggtgtctttcatgcaactgaattaggttttttttttgtttttttttttttttttttttttcagataaaccatgaatcacattttatttattttgtcctttcatttttttttttttttttttttttgagacagagtcttgctctgttgccaggctggagtgcatggtatgatctcggctcactgcaacctccacctcctgggttcatgctattctcctgcctcagcctcccgagtagctgggattacaggtgcccaccatgatgctcagctaattttttgtatttttagtagagacggggtttcaccgtgttagccaggttggtctcgatctcctgacctcgtgatccacccacctcggcctcccaaagtgctgggattacaggcatgagcctcaacttttattttacgttcagatggcacatgtgcaggtttgttacatgggtaaattgcatgttactggggtttggtgtacaaattattttgttacccaggtggtgagcatagcatagtacccaataggtagtttttcctttttttttttgagacagaatctcgctctgtcgctcaggctggggtgcagtggtgcgatctcagctcactgcaacctccgctcctgagttcaagcgattccccctgcctcagcctcctgagtagttgggatgacaggcacctgccaccaggcccccataatttttgtatttttagtagagatggggtttcaccatgttggccaggctggtctcgaactcctgacctcaggtgatctgcctgcctcagcctcccaaagtacttggattacagccacgagccatggcacccggctggtagtttttcttcctcatcctcctcccaacctccaacctcaagtagcctccccccaacagtgtctattgttcccttctttgtccccatgtgtacttagtgtttagctcccacttattaagtgagaacatgcagtatttggttctctgttcttgcattaattcgtttagacatggcccctccagctgcatctatgttgagcaattaaaaaaggttaagatgagctaagtgaggtggtatgcatctgtagtaccagctactcaggacactgaggcaggaggatcacttgagcccaggagttcaaagccagcctgggcaacatagtgagaccccccccatctcttttaaaaaatatttcagatgataaattttatgctgtatgtattttaccataatacaaaattggttgaagaggagtacatataaacacaacaacgaagtgtttaactcatcaatttcagatacacagtaaaagaatgtatatgagaattggtcaaggacattctgaggctttaagcttcaagtcaagaaaaacaactgcctttctgaaaacttacaccgctcacagagtctggtgggctatgaatttgatggtacaacttctaacttgacagtgtggagatcaagggtataggaatgtaaaaagctttgaaaagtttgagagtggagtttgcacagctggacacagggcaccacaaacacaggtggtgcatttgtgcctttggtggacaaagtatcacccacaatgcacaggcgcttccctggctggacaataggtctctctctccatcccctctctctctgtttcaagagaagacattttacgtaggaccttccactctgaatatgaagggtatatcatttccctctcaaatccagactcctctagttgaatggctgacagccaacagaaggggtgtatgcacccttcattaggccagatttactgtccgccttccatgagtggttcagcatgctctctgtccagctgtggctcctgcctgcaaagcgtgccatcagcttcctggttcagagagagctaattttctctaattgcttccaatgagaggtgggaggcaggagggtatgtgccccattcagagccgctgttctcatcagcctcaccaagcagtgagagcagctttcacattcaaggtcttctttccattatttgggtaaaaatgttttgtctcataacctgggatttaagaatcttcaacaggttgcttaacccttaaagatctgacccacctggcctttaatagatttaaagactttatttggttttatgatttttaaaggaatcataattcctacttatttaagaactttaattcctatataagaataatttattctcattcatacttgtaaaaaaagtgtatccattgttttagaaaaggggaaaatagaagacaggttaaaaaagaaaactaaaaggcatttggtgttgcttagatgtacatgttttgtagtatatatatgtggttttgatcataaataatgtatcaaagacatataataccaatttctgttcttttttctgaaatcttagaattgagtccttagaagaaataccaagctaaagggcatgtgaatttctaagtttcctggcacttaattccaaattgttattccaatttctagtgtgccatactacatctttattagcattcaggattatcttcttggttaatatagtaaaatatcattttgttgtttgaattttcattgctttgataattgatgatatttaaagatgtttaggctctttttttctttttcatttgctcagcttttctgaaaacctttaggagacaagtttctcccaaattttttctactgagatttatgcattactgatatgacttctaacatataagctagttaacatcaagaggattagtctatcacaccacttgtcacctggggcaaggtagtatccagttcattagggtaaaggtcaagtaagtgttttgtttgtttaaaggggaacacgggtaggagttatcccaaagttagaacgcaatgaaacccaactatatagtaaaatatatttggggctcaactctgttagccatcaaaggtagtacaaaacatcagaagatgaagagggttttgaaagaaagaagggccatgtcagattaagaggtagaggaacatcaagataatttttcttctattagagtttctcttttagggtttctattagagtttctctaatagggggtagagaaacagcaagataattttttttctattagaatttctccattagagtttctcacctgcaaggtgttgactttccagttacctggcatttcattctactttttggaatggcctgagctgaaattaatcaggctctgttgatgatgcatccaccagggtttcccattggatgcttagaaaaaattccatcacagaatatctgtgtcttgtcttcttgggggctaggagatcccccaaatttttctcttctgttcttgtttgataaaggatgtgtggaggacctggtgcttaagagtttcagtttgacataaaggtactagttctggagagtctcttgggccactttatgttaacaaagactctcttgatcagcctttagttaagcttctctgagctctctccttgactaggcttcaaccttgggcttctgtgtcagtccttgtggagtctggttttagcaagaatcttgcaaagtcagtttagagagaataccccaccttttatatctgatcaatttcctcaatccccacctgtaatgtataagcccttgacctgccttgagtagaaatctcctacccttcatgtctcctcctagtaattttccatccactgaccccacactctgctctttgactctaaatcttcatttgtccttgttgtcttcaatgtcgaggccaatctctttcccctaccataatatctctattgaaatagtcctgaacaaagtcttccttgccattttcacacgtgccagaataatgcttgcctccctgcctgcctgccttccttccttccttccttccttccttccttccttccttccttccttccttctttctttccacagaatctcgctctgtcacccaggctagagtgcagcggtataatcaaggctcacagcagcctcggccttccaggctcaagtgatcctcccagctcagcctcccgagtagctgggaccacaggcacatatcagcacgcttggctaattcttttttgccttttgtttgtttgtttgtttgtagagacaaagtttcactatattgcccaggctggtctcaaactgctgggctcaagcaatcctcttgcttcaaggtcccaaagtactgggattacaggcatgagccactgcacccagcctcacaattttttctttaacaatgcccagagcatatgctgagcttcccgtcactctctggggcggaatggaatattacacaactggcacggtaaagaatgcacttggttttggtggtggataacattttcctttgcacctgaagcacttccacaaatagcccatttgtcctccttgcaattaaattagaaaaactgtctctaagcttggtttgacctatctgtagctctttgaaaagactgcttgatctttcctcactctccgtgtacctaaatcttgttcaggctctgtccagaaatcaataggaaacataaaaccttgaagcattataaaatcaggcattctaaactggaaagggcctttgattatttagcccaaatgcatcacctgttttacagacgagcaacctgaagttcggagaggtggaacttcctccaggtcatctgctgcactggtgatagaggcaggactaaacactctcggtgcagtgttccttctctgagtcatgttgactactatatgctcattcacagtcacaaactaaaaatctcagacaagtcaaaagcatacaattacaggaccagaagactcctcagtgattatctgggagtccaggcatccaagggacttgaccaagtttttgcagctattgctggtagaccaagtacggaaatacacttctcttgactctcagtctagtgctcctttccctgcagtactctgtgcaataccaaaagatatggatctccaggattggctgaggttagcaattaatatggtatttttagtcatgtctacttggagtagggggtgctgatttttgtttcatgtgtgttcttgagactttttgatgaggttccgtatgcctcactctaggtgatgtttttattagtaccatgttgtcttcctataaagagtttttatggcgaacagaaagctgtctggattcttgctatggttgtaggcaggagggaacatggtgtgtggcttctgaacaaactctggctgctctttaagttcaatgaagtgaaaaaaaggcaagttaattgactacagacatatgcaagagagctctcaattgagccataagatcttttgggatgtgggtgtttacaaggtagctataagcactctcataagtactgcacctgtgaatcatggactttcattgtacatagctttccactgcttgcttcttgaggctactgttcagcccatcagtaatttttaaagatcctttagaaagttatatagaggaatgcaaatgtgagtaaacaaggcgcctctacctactgatggcatcttcaatatttacattggcccgttgagttttatcagctggatattgctataaaacacatcacctgaaaattaagtggtttgaaataatgagtatttgtagttgttcacaaacctgtgggtcagctgggcggtgctgcagatctgaaccaggtgtggctgatcttgaatgggctctttcctgctgcggaaggcagccagcaaggtaggtgggggctgatggtcagggatggcctcactcctatgttttcccattggctgactatcagccagggctgcagtgatgactggtgaaatagtttggatatttgtccactctaaatctcatgatgaaacttgatccctacagttataggtggggcttaataggaggtgtgtgggtcatgggggcagatctatgatagatggcttggtgccattctggcaggatccagtgagttctcactcttagttcttgagagatctggctgtaaaaaagaacctggcaccttcctctcctctctttcttcctttctgtctggccatatgatgcctgctaccctttaccttccaccatgagtagaagtttcctggccgggcacggtggctcacgcctgtaatcctaacacttagaggccgaggcaggtggatcacctgaggtcacgagttcaagaccagcttggccaacctggtgaaaccctgtctgtactaaaaatacaaaaattagttgggcatggtggcgggcacctgtaatcccagctactcaggaggctgaggcaggagaattacttgaacccgggaggcagaggttgcagtgagccgagattgtgccattgcactccagcctgagcaacagagcgagactccatctgaaaacaaaacaaaacaaaacaaaaaaaacctccatgcttcttgtatagcctgtagaactatgagccaaataaacttattttctttataaattgccctgccacaggtatttcttcataacaacgcaaatgaactaagacaacaagtctctgtgttctccttcatctatcatactacccgaggtttgtttacgtggtaaagacaaggttcggagagaaatggttgaaaccagcatagcttcttgagacacaatgacacttatgccacatgctattggccagagcaagtcacagaacatctggattcaagaggagggaaatggattccacaccttgatggaggagatgcaaagtcatatcacttgggacatggatacagggaggggtgcaatttgggatgtttttgcaattaacctaccacaggcttaaggaggcttttaggatttaccttctgctctaatgagtttcaaccaccatggcttagagaacatttcttaaaactcagtcatctttcatgtatccattgttctccaaagggactaagttttgttccatggtcagtcttttccatgtgttcttggaccttatacaaaacccaagcctggaattacagcacctggatttattcatcaagcattcgccagttcctggttctatgcatgtgttcacaaaactcagaacagggcattcctctgaatagagaagaaaaatagagtcagtcagaaaagaaattttttgtctaagaatacaatccaccgtactaccaccagacttggttccctttcaatgtcgagagtaacacattccttttatgtgttgcttaatttgcttgttttaagcagttccttgtttttggagtgtcttttttgataacattgagataccacatccactgatcatgtctaaaagctgacaatttctgaaggaaataaactgttcaaaattaactactctctcactatatatatagcattgtattttcagtacacatttttggtacacatattcgtggtacatattttccagctggcttgtgctaatgtactagtgattagaaccaagactaagaaaaaagtgcattgccattttcaatcaacgtgggtagagctgaatggttgattccaaatcaagttattttgcctaaagcaagacagataggagagagagagagagagagataatacagagatagataatcacaaactgccatttagagaaaatcattactactatcaattataagagtgattagcaagtttatggatagcatgatggctagcaatctttatacaaatgtggctgattttcactaagtcttttaattctcagaattgtttcatgacttttttggagaaaattgttgaggcatgaaaagaatttcatgactgagatagatattgtaccttaggaaatataaaatttaacaaatctgtagaaaaggaagacttaggctttgactttaaaagcccattccacttacaagatttcattttttgtttattcaatttggaaagcacattttcttatataatcaataagaagatttttatggcatgctcgagtgtagtctgattccaggtctcataattcctttgcactcaaaaaaggaactttgttacatcttgccactcatgctcactcttcagtgggcaaagtgactttgccatactgtcaccatccttgagccactgcccggtccttgaaaactaggattcttcatttccttttgcatcgtcagcgtgaggaaggggagggggaggtaagattctggacagctggactgaaaacaatggaaaatccctagtaacagcttgaatcactcactagcaggaggaaaatgtgactcgtttcttttcctctttagcttttgttgatttttttcataatgagctcagaaagagggaaagatcaatattcatgttgagttggtatccatcatagtgatattcagtgattataactctccaattctcactaggacaaatataaccacgcaaactggctaactgcacttgctggcatggttcctttggaaactcctggatttctctgaattacaaacagaaggagagttatagattttgtctctttaattttctgtctcttgaaatctcagatcacaaaaattgagtctttcttaactggtgatttcttattcgtcaatgactccttaaaagatatgcagaaagtaatggccctctaacccttcacctttgtaagctctttaatcctgaggggatggacttcctgatttctgttctctcagattctaaggaggaaaagactagctgttgtctctcaagtctacctattgctgtcctacagagcaaggacccctcttgttctccagctcctcaggaataggattcttggttccctaactctaaaataggagctcacaaggttattgtcaaggacaaatgagggcagtgttaacgtattaaaaaaaaaaaactagtcagagattgcttgattttcaaacttgatagtatgctttcgaagttacataatcaaaattatagttgtatttaaaatgttaagttcagcttacaaaccttcttaacctatttgtaagtcaagcaaattttaaaaatccttcttaagggaagcttgattaatgatttcttctcattttcaaatgtagttaaacatttttaaacacttaaagcttgatttgtaaatttaatacatttaattttaagtactttagcttgtctaacttaacaaatgagatactcatgaatatttgaatagctcatcaattagatacttataaatatgaaatatagtttttaagttcttttaaagttctcaatgtacttgtaaacttgtaaggatttcaggtcaaaacgataagtttaaatcatttactcgatttaacattttaaattggaagcacaattctaattcactattattttaataggccaaaatatcttaaaattacaagtatataaaatatcagggccaggcacagtggctcatgcctgtaatctcagtgcttttggaggtgaagccaggagaatcactcaaagccaggagtttgagcccagcctgagcaacacaggaggaccctgtctctacaaaaaatacagaaattagccagaggtggtggcatgcacctgtagtcctagctatttgggaggctaaggcagaaggataccttgagcccaggagtttggggctgcagtgagctgtgatcacaccactgctctccagcttgggtgatacatcaaaactctgtgtctataaagataataaaataaaaatatgactaatgcaaaattatttgatactatgggtttcatttcatacagtcatatgaaatgaaataattatgtatacaattatatatatatacatatatatagagagagggtgtaaatatataatttattcttaatgctcaatcttatcagagctgaaagatggttacccatgaaggaatcaatgacaccatttcacatatgattgcagttaccattcccttgtagttgctgggctagctctctcagctttccgagatttttttgaggctcagaggacctcctctcctgaatgagaactgggttctaacgaatgaccctaactgtgccctgttacagtggctctgtcttatgcccacgtgaagtgatgtcacagaccatattcacgatatcgaagctacacattactaaaccttctgccgacccacagaagcccaaaactcccatcctcatagtcatatcaatggattagattttattatatttgctgcaaactctttttataatgttcttcctactcaccttattcttatgtctattctattgagatctaattaaattatgaatgtctcttaagactctatctggctttatagtgacaacatcaaaggatatttgtattagttagggttctgcagagacacaggatgtgtgtgtgtgtgtgtgtgcatgcatttgtgtgtgtgtacacaagtcccaagatgtacaggttatgttggcaagccaggagaaccaatggtgtagttcccgtatgaaagccagcaggctccatacccaggaagagctgacatttcagttccagtccaaagtcaggaaaaagccaatgtcccagtttgaatacaatcaggaaggagaagttctttcttattcaggggaaggtcgccattttgttctcttcgtgtcttcaactgactagatgagatccagttacatgaggtagggcaatctgttttagtcaatttatatttaaatgttaatctaatctaaagccaccctcacagaaacaccagaataatgcttgaccaaatgttgggtctcctcataacatacaaagttagccatcacgatattttcctggcatacactgtgaaaccactgacctggaaccctctgacttctgtcagctatttaatagataagtctttctaatcttgagtgtttgtaaagcagttggatataaatttgaaaatttttaaatgaaacgataaatcatgtgtgacctcttgagcctattaatcctaaagtaaaaagtccttgtacaaatttttatccactttttttttttttttttttttttgagacagagtctcgctgtgttgcccatgctggagtgcagtggcaagatctcggctcactgcaacctccacctcctgggttcaagtgattcccctgcctcagccttcctctcaagtagctaggactacaggtgcacaccaccactcccggctaatttgttcgtatttttagtagaaatggggtttcaccatgttggccaggctggtcttgagctcctgacctcaagtgatctgctggcctctgcctcccatagtgctgagattattgctatccactcttgatactgtttggcatgtgacttaaaacaagcaacagttgaaaatataaactagaaaatgagcatatatgttcattgttgctaaaggcttggtaccagcaccagctacaggagtttatagcataccttctcagagaaaggcctcttcattctgggtttagaggtgttggtatcctctgttgcaagatgttattcaatcaattcaatcctgagttttcaacatcagcaacattacatgtgcatttacaggaagaagaccagagtaggaacactttcattttttcccccaaccatctacaaaaatgaagattacctgaaatgtttactttatactatgatcttaaaactatttattttaataatatctatataacccagatcaagaaaaccagtgaaaattagcctattcaatcctttcaaaaggcttttttattccaaaagattgaataaaattagttactccctttatcctgaatttcactacaaatattacatttgcaaatgtcccatctgactgtaataaatgccagtgactttaactctgtggttggtgatatgaagaaaaccatatgtgatagattctaaatatataaccacaaaagccaaactgacggtttggaacatctcagcaactattattgattactacagttgaagaggttgaatcagtttgcatggcaattctcctcctcttcttcctcccatacccactcctcctctttcttatttttctctcttgctctctctctctgttctccattcgttgtttctttctaattcgcagtagcagtagcagcaaccagaaaaatatttgagaactttaaactaaatggttaactaataaggcaataaatagaaggtgtgacactgaacgaggagtaaaagccaatgcattccactacattgagagacatttatgaagtatattgagttacacagacactaacattcagaaacaataaaatagagacagtgtaaaaggctaaaaatgggctgggctcggtggctcacgcctgtaatcccagcaccttgggaggccaaggcaggctgatcacgaggtcaggaatttgagaccagcctgaccaatatggtgaaaccccgtctctactaaaaatacaaaaattagccaggtgtggtggcacacgcctttaatcccagctactcaggaggctgaggcaggagaatcgcttgaacctgggaggcagagtttgcagtgagccaagatcatgccactgcactccagcctgggcaacagagtgagactacgtctaaaatataaaataaaataaaataaaataaagactaaaaatggcccccaaaagatatcaggttaaatccctggaacctgtgattgttccgttatatgataaaatatatgatttagttaaggatccccagaggaggagcttaatctaaattatgaatgtagtaaatgcaatcacatgggttcttctaagagagacagggggtgttttgagatagacacacagggaaggcaatgcaaaaatggagcagaaggggttatagctaaaaggaatgccaagggccaccagagctgtgagaggcaaggaacagatttttccctggagcctccggaggaagcaggccatgctgacacattgattttgtccttctggcccccagatctaagaatatatttctgttgtgttaagccagcaggtttgtagccatttagcagccacagaatactaatatggacaatgatttctgagaaaataaaaagattattttgagaaaataacaacattccttgtttgatttttaggaaaagccattttattttaatttttttctatttttttatttttattttttacattgaggttctctttattttttactatttcttttttcttttcttcttctttttttttttttttttttgagatggagtttcactctgtcgcccaggctggagagcaatggtgctatctcagctcactgcaacatctgcttcccgggttcaagcaatttcccacctcagcctcccaagcagctgggattacaggcaactgctatcatgcccagctaatttttgtatttttgtagaaatggagtttcaccatgttggccaggctggtcttgaactccttacctcaggttatcagcccacctgggcctcccaaactgcttggattacaggcatgagctacagtgcacagcctatttctgactatttcttgacggccatccatgctgggggaacaccctcatgtgcctgtcaagcccaaatcccactctaaaaattcagattcccttttctgactccgtaggatgcctgtccacggaggtctcataaatccccaagcccacattttccccaagtcctccccctgctggttacctttcctttcccactcacatggagcaggtgtccgaaacaatgggttttgggcagaaaacgcattttagtcaactgttgtataaatattctaaactagtaattaagattttaagcatgtgctctggctggtcatggtggtcagattgcaaacagttggcaatcttatttcagcagtagactagaatctggtcataatttatccaagggaaaaaagacttgtcattaaattctctccaacggtcctaaaattttaatttatccacgcctaccttgtccattactgttttaaaacagctttttaaacgtctagattccagccctgtgtagaatcaaatatattagaacttagtcttgttacttggtctgaattggaaacatttccagtgcctaccagttgcacacatcattatccactcataattagttgtttaatctgaaaagagcaagttctgctccatcacctaacatctgttcacttttactcttagctctgttcaaccaaatcccattattgtcaggagaggctctggcagacttgtatcatttacgaatggtttctatttctttgtagatttctaattctttgttctcgtagctgctacattctctgataataaataacattatgcagttatttttcggaacttgtgcttgttttcaaaataacaagactaagaactaaagatttatttgtctgaagtcacacagtgcctcaaaacatatctcaaacactaaaaatattaacatccacaaactaacacctacttataaaaactctagcaattctgagagaaatggattatttacaatcctctctctgctgatgttactgttaaatgtcatattaactcccagttatactgaaaccattttaaatgttatagtactttgaccttggttgtgaaaataaagtgtctagtgtaattatttagggatagtatagttcctaattaagacaaaattttcagcaaagatgattaaaatttgataagcttttaaatttttgtgtaatttctccaaataatgaaatgatttctttttctaaaaaaatctataaatttccagactgaaatatgcatgtcagaataaaggaaaattttattatggatctgaagtttgctccattttataacacatctagaaaatttggggtactggcagagtgaacccacagaagagattctgatgaaactgaaagtggattggtaggaaaattgctttacaataatctctactacttgcttttcatgtaggggtttgggaattagtctcttatttctacaactttctatttaactgaaaagacctaacatcttataataggattacactttctggtagaattttcatgatacaattcatttaaactatgttctttgcatgttctgatgaagacatttcctatgatggcattttggtctttctatctccagggaagtcaagtgattggaaagaattttaaagagacttgggctgagtgcagtggctcacgcctgtaatcccagcactttgggaggcccaggcaggtggatcacgggtcaggagttagagaccagcctggccaacatggtagaacctcgtctttactaaagatacaaaaaattagccaggcagggtggcaggagaatactcaggaggccgaggcaggggaattgcttgaacccgggaggcggaggttgcagtgagccaagatcgcgccattgcactccagcctgggtgacagggcaagactaggtctcaaggaaaaaaaaaaaaaaaagagagagagagagacttgatggttttctcttgaaaaaataatctcttagccattttccactgccacgagtacatgtacattgaaattagtgatactgaatttatcattggcaagatatctaaataagatttactgtagattaccagcgcattaaggagctcctggacaaaacatgtgcacattttctggctgagaagtgcagtcattgaagatttgtagaccagaacataacatattgaaccccatatctatctatatgccagtgtgtgtacttacatattaatttctcctatgaaagaggaattaataggaaaagaaaagcaaggaagtaatgttcaaaacttccttaatggccaggtgcggtggctcacgcctgtaaccccagccctttggggggctgagaggggtggatcacctgaggtcaggagttcaagaccagctgaggtcaggagttccagaccatcctggccaaactagtgaaacctcgtctctactgaaaatacaaaaattagctaggcatggtgtcaggtgcctgtaatcccaactacttgggaggctggcacaggagaatcgcttaaacctggaaagtggaggttgcaatgagccaagatcctgtgccatggcactccagcctgggcgacaagagtgaaactttgtcccaaaaaaaaaaaaaaaaagcttccttaaaaacaaaaaaagcttatgttgccattatttgggctattgatttttttctagtgcaaaacatatacatatttgatatataaccttggaaaatacacaaaagacaataacaaaacactcaaagtcctgctatctaaaaataaacactttgcttctagagttacttttattcatatttttaaaacatatttataggccgggtgtggtggttcatgcctgtaatcccaacactttgggaggccaaggcgggtggatcacaaggtcaagagatcgaaaccatcctggccaacatgatgaaacccccactctactaaaaatacaaaaattagctgggcgtggtggcccgcacctgtagtcccaactactccggaagctgaggcaggagaatcgcttgaaaccaggaggcggaggttgcagtgagccaagatcgcgccactgcactccagcctggtgacagaatgagacgctgtctcaaagaaaaaaaaattatatttataattatagtgagtattccatttctgtgtcctgcctttttgtatttatctaaaatttaatttaaaaatttctagatttctctgtaaaatcctgggaaaatcaaggcaagttcatagtgatctatgagtaatctattgaaatagcttggcattacataaaagcaatcccttcaggtctgaataaaaccataaatagaattttccttttggcatttacttcattttagactcatttaaatagtaggtttatcaatgcagtttattctgagcagagggatgatgtaatgtataatcagttactcaagtcaaaatgccaggaaagtatatgaataggtagcaacaaggtattgggttgaaaagaaaatgcttggctggctcttagatggcttgccctttagttgctactttccttggaccctttccagggtctccaagcatgaaggacccatctctcaggaagaagtccttgcccagggctgtttatcttagttgagtacagccaagtacaaaccagagcgaagttgggtcttgatctcctattgggtgccactgtctctgctttcttttatggctaacaagcctatactaccacaagccacatttcatttgatagcatgggtagtggaagagagcatccaaagccagtcaatcctaaatcatgtctgcaaaaatatctgtaaggataaggcctggtggacctcaagaactgtctccctctagtaataatcatataacattattattttgcagtgaaaaattatccagtacacaagcagtctatgcaatgtaatgagaagaatgctttgcaactgtactactagaagcgaactaattcatgatttatttttaagtgattagaacccttagtttatctgtgagaacatcacttaaataaaatgttttaaaatatgcaatgcatatgcaatagcattaaagtattaaatagcatcttaaagagcaaaagaaactattaagaataattaagtggatttattggctaattggtgtttccacatgtagttatttctgcaattattattcatttgctgatttacatagagctattctctaaaattactctggcattaaatgaagttagaagacatctccagtttggaaaatctattaagcaaatccttttcaacttaaagttgaggtgatactgaatcaaggcctggcagaactgactacagactcagagggagtatgtttattgcttttaattcttcctatttctgtttgaactaacatggcaaaggctttcatcttccaaactacacttatccagtctataaaacaaagatgatattgtttcaactataaagcacagattaactttgggaggctgaggcaggcagatcaccagaggtcgggagttcgagactagcttgaccaacatggaggagccccgtctttactaaaaatacaaaataaccgtgtgtggcggtgaatgcctgtaatcctagctactcgaaaggctgaggcaggagaatcgcttgaacccaggaggcggaggttgcagtgagccgagactgcaccattgcactccatcctgggcaacaagagcgaaactcagtctcaaaaaaaaaaaaaaaagaaaagaaaagaaaaagatcgggtgcgggggctcacgcctgtaatcccagcactttgggaggccaaggcgggcggatcatgaggtcaagagatcaagaacatcctgaccaacattgtgaaaccccgtctctactaaaaacacaaaaattagctggggatggtggcatgtacctgtagtcccagctactcaggaggctgaggcaggagaattgcttgaaccagggagtcagaggttgcagtgagccaagatggtgccaatgcactccagcctggggacaaagttagactctatctcaaaaaaaaaaaaaaaaaaaaaaagaaagaaataaaaagcaaatactaccaaattcttacctaccagagttacgactgctataacccttaacatttaaacaagggaaatcatcatttgggaattgtatttcctcttcatacaaactagtcttccatggtaatagattggctggatgtttttccagtatgttttctagataaatagtccttggagccattgtttccctaagaattaccaaaaaaataaaaacagaaagcaaaaacatgtttgctttctgctggaacatacatctcaggcagtgccgaggactaaagataaatttgatacctatggaggaatacattctaaaaataagattttatatctgtttgcatgttaacaaaacttatttgtaaagacacacattctagaaagtaacctcaaaagtactcttataaagcacctcattttgaaagtcaagtagagcaattcctgggcagatgataatgatactgcagagacatgtgaagaaggaaaaaaaataataatttcgctccctgtgttagtctgttctcatgctgctaatgaagacatacccaagactgggcaatttataaagcaaaagagatttaatggactcacagttccacatggctggggaggcctcacaattatggtagaaagcaaaggaggcgcaaaggcacatcttacatagaggcagtcaagagggcatgtgcagaggaactgccctttatcaaaccaccagatctcgtgatacttattcactatcacgagaacaggatgggaaaaacccactgccatgattgaattcccttccactgggtccctcctgtgacacgtgtggattatgggagctggaattagagatgagatttgggtggggaaacagccaaaccatatcactccctaagactattacatttcagcagttagatgaagagagaaggacagggttcagattgaatcattttggatggaggagaacatataaataattgaacaataggagcaccacctagtttagagacaacctaccacaggcaaatacctcacatgacttcattgttctcccccacaccttctctaccatcagatttcacccagaaccctcatgtgccacagaacttcaagtaaataccagccctggaatactagtcagaaagctgaaaaaaacgtgcaatatgagtttgaacactctgagatcgttaacacttttttcaataaggttagataactaagatgataaataaaaatattttaaaacattaataaagaggaaatgattctcatagaattagtatagccaaattttatcttcttaattgttgtatttcatcaagagacatagataggattaattttggttttctactataactgcttccatcagggaaaatagattaatttctaaaataccaccagaatcttagagttgtttatccaagaatctctaaagacactttacattgcagagtaagtcaataacatgggcaaatataaagctagggaacatgtgaaaaataaaattatgagttacaaacattaaacattatttcagtagaaacagattggtggctgcagttgattattaaagaatgccattaagttgtcaggaataactgttgtagttttctgaaaatagtcattttgttgtagctttagattggattagctagagctatacacacgagagatgcacatcaggccttagacacaaattccttcaggaaaatgattcactggctatttagggggttgacagccagtatatgttgttttcgagtcacagagaaaattgtatggttgtatattctgctttaatttacatcaatggaagatgagctacaaagcagctattgatacaaaaggcaaacccattgtagaaaatgaacattttctgtaagctacatctacattcttcctgatcagaaaataatacagaaagtgacatacttgttcctttttcacatttgaagaaaatgttacaaatgcctccatgatgcaattctgtatttagacaatctaagcattgagtcttgggatacttattctgtaactattttctaagaataacctgaatagaaaacatggaatttggtagtaaaagatataaataatgaaaataggggtagggtcctgtgcctcagtgaagtttaaaatttaattgaacttctaaataaatgtttaaaaatagagcagtttcaaaaatacaaaagctagaatattcatagacccctgaagatacttctacagtatcccacagttccacaatctctgattcaggaaattacattaaaagttatatgttggcattttggaatttcatttggtatacatacctgcagacagaggcaataaaatcacatcaatggtcggttacaaatgaagtcatccagttgacccagggtatgctttggctaaattttgttttagatttgccctaaaatataattgcaatattgaatatctctaatagatctcaagggccctctattagtccattttcgtgctgctgataaagacatacccaagactggacaatttacaaaagaaagaggtttattggagttacagttccacacggctggggaggcctcacaatcatggtgaaagtcaaggaggagcaaatcacatcttaggtggatggcagcaggcaaaaagagagcttgtgcagagaaacctccattttgaaaaccatcagatctcgtgagactcattcgctatcatgagaacagtgcaggaaagaccggcctgcataattccatcagctcccacgggttcctcccacaacacgtaagaactgtggagttacacttcaacatgagatttgggtggggacacagccaaaccatatcaggcccactttgcaaaatatcaaaacagaggggaaaagtataagtaactgaagagaagggtgcggtgtgctgaatacaaagatgctgactggggggagtgaatgtacctgcatcccaatttgcctgggaggtctggttttacccattgtctgacattctgtctaatttagcatttgtcctgaatatttcatttagtgatgtattattgttattagttgcattaaaacaagccaagatggattaggtagacctccacgttgtacttccagtttcgtcatgttatggtcttgggggtgcaggaattcccaggtttccttgaggtgaaatctgaaagctgagaaatatagcacagctcacaaggaagaagtggataaaacagtgtcctcagagcagccagggaatcctaacccctgacgatcttcagtgaggcatttggtactccaacctgttgtgccttagccctgagccccagtctgtgaggtgcatatggtcctagctaataggtcagtgggaaaagggagaaataataaacgaggctgtgtgtaaacttacgtgtaggaaacaggttaagctgttctgccctgttgcatgcagagagtagtctgaatgctattgccacagtggttttatttttattgtgtgatgtaaccatatgccaatttttttctttgactattgactcactattttataatgcatccttctggcaataatgaaataaaaattagtaaacagaagtaactgtttaatgaaaatgaagtatttgtatttctatttatcaagaaagaaaagacgaacctgtggcatgcagagagtagtctgaatgctattgccacagtggttttatttttattgtgtgatgtaaccatatgccaatttttttctttgactattgactcactattttataatgcatccttctggcaataatgaaataaaaattagtaaacagaagtaactgtttaatgaaaatgaagtatttgtatttctatttatcaagaaagaaaagacgaacctgtggccgagcacgggggctcacgcctgtaatcctagcactttcggaggccgaggagggcggatcacctgaggtcaggagttcgagaccagcctggccaacgtggtaaagccctgtctctgctaaaaatacaaaaattagccgggcgtggtggctgatgcctgtaatcccagctactcagaaggctgaggcaggagaatcacttgaacccgggaggcagaacttgcagtgagccagattgcaccattgcactccagcttggggcagaaagaagagaaactcagtctccaaaaaaaaaaaaaaaaaaaaaaagagaaaagaaagaaaagaaaagatgaacatgtaacttacacaaaacacttgttgccatttaccatggggatataatgaactaacattcagaagtcacacatatgctgaagaagcatcaggatctacttcaaaagttaaaaacattaaaaaaaaacacagaaaaaaagagtgcatcttaaaatgacttaacacacacaactgcagaaggtggagctacagaacatgcttggaagcacgactttttatttagatcagatgattgttctttgacattaagttagctcattggcaatttcatgatttcttgtgcatatcccaaaatgaaatgacacctgttaaagtgccagcaccgttagcaaaagaacatttaaaacagaaagtggtgccagttttatttcaatgtcatcagatgttccaaacagaaaatcactccagttaattcttgtaatggtttcgttttctcatccaattccgaggaagaaactaaagctttttgaaattaattctgttgaatgtattattcatactattttaaattcagttaatatttagcctacatttctagcatttgtctaatattaacacagtttttggtggagtactgcatcatgaagaaacctaacactctgaaatttaaagatacgaaatttacttggaaatagtttttatgtacatataattcatacttacatccaaataaatgttgatagtctctcaattaaaataaaagctgtaagtttcaaatttttgaaataggtacatatacaattggatcatctgaactgtgaaattttgttaggaaggtaatgttgactacaaaaaaaactcagaatatcaggattcactttttctctctgctgcctttcttcggttggattttagaaacgttcatgagtgtttaatcttctgtgcttttaaaattcttctgagtgtcttaaaatagtactgaagttttcatgacagtcttttcatttttggctgaatattgttttaaaatcatctagaaatctttcatcaaagtaccagtgaatggaacagcaaaagctaaagatttcaaagcttttatcaaaatgcgattttcgcaaacaaattatgaaaataggaaggcatggatatgtatctgcaaaggcaagggagaaactaaagaattgtagaataaagctcaaatattataaaatatgtaatttgaaaactccaattgtgttttgaaatattcagtttgtgggaataatagtttgatgaagtttcaatttttaattaaataaatttatatagagcagatataatgaaattgaagacttagtaaaactttcaaaaaaatcctaaagacagtttatttgatgatttttgacttttaaatatttgttaatgaaaagtattcttagtaaaaaaaatataaaatatttgggctgaaatatttaatataaataattgaattgaaaatattttctgtttagcacaagctctgagcttgttaagtaccttgtgcctgtgggagaagctagtctttaaaagtttaaatattggccaggtgtggttgtctcacacctgtaatcccaggcgtgattaatttgggaggctgaagcaggcagatcacttaaggacaggagttcaagaccagcctggccaacaggagaaaccccgtctctactaaaaatacaaaaattagctggtcatggtagcccacacctgtaatcctagctactagagaggctgagaatctcttgaacccaggaggcggaggttacagtgagccaagaacatgccactgcactccagcctgggcgacagagagagactctgtctccaataaatacataaaaataaaaataaaaatttaaatattattgattaaagataagaatgaattagttttgtcactaatttcatacatattaaccatatcatgccactttgaagaagattgtaggtaatttatgaaaaatgttcaaataagactgtatttttttaaatacttttcttagaaaaatactagtgatatactattaaagacagataaaactttaaaaaattgattaaagtacttgcattctacttattttaatgttcagattgattttatgaagaatttttgcgttagtgaatgaagctttgtgttattttatattttagaaataattctagcatagcatagaatattttataggtatacgaatataataaaaccagaatgttgttcaccagacgaattcttcaaaaaaaaatacaatcttcacttttagtctactttcttactctcaaaagtatcctaattagtctagtgctgaagagtttcaaactcatttaaagagaagtagacaaataagtgacaggaaggattgccgtgtgtatcttccagtctggggtgatgtttaaattcctcagagtccacttagctttgtctcttcaccagccttggtttgccccagtgctgttcatcattttaacaaaaatagatctcacaggatgttcacccagtcacctttttgtagggacaagctttatagtcctagcacttgctgattctttaaatactgtgctttggtccaggggatgttaccttaagcccattttttgtagttagtaaataagacttcttcccaaagtcacgtgcatgttcaagttcttgcattgccagtgtgtaatggataaagacaaatgtatagtaaaaaaatcatgaggcagtctttggttctcatcccagccctgttggctgtgtgatatttggcaaattattttacttctctgagcctcttttctttccattgtaaaatacagagaatgatagttaagagtatttttgtggaaatgaaccaacacaatgcagctcaagtatcttagcagagtgcctgtgttcaataaatattaataaaatgacccttaactcccctcagcaagtttaaaaacaggaagtttccatttcaccatttactttccaattctttgttaaagatggccataataagtaatgagagtgtgcatttgtaaatgtctgtcaccaatgtgaatttacttgagatgactcaaaccacattctatactggaaaaggtgcatttaacgggcaaaagaaaagcccaggccagtttctttctgtatcaaccctgggtaaatctccttaagaaaaaattaacaatcatgatttattcatagggaaagaatttaactacttgttagcattcgaatgggtcctaaggaaactcccaagttaattaaatcagaactttcttcttgagtttgatccattatagtgagttaccagctgggtatcaactgctttcccagaaaggccccattgaaattaatggactcagggctttgttgagtctggacactagagaattggacaaatgacactgtggtttattaaagaattatgactgcaaatacattatatgatgctttctccctctctctccatttaattatgaatctgcctctcaaaagccttgactctgtattttaaagttgacataaatggtaggacgaggttactttttccagtaatggagaaaggaggagaaaggttgctccgaattttgtgatcttgttcattttccgatgaagtttttttgctggtccaaatattaattaatcgattgattgaaaatgctacaaaagaggagccattcatcaaagaaccaaatccagtgattcgtgatctggggttttatcacttatatttctagagcatccttttgcttttacaacttaaatttaattgaaattttaatccctagcaggtttttaataatgggcagcttttgagacattaaaaaacattgctctcacttcccagataaggaggttgtccagatatccttatgctttagggagcatttactaagtgatggtacttcccagcgcacatttttggttttgttaaagtatcttaaaccgcccatgtgtagtcaacttccccttatggaatccattgataaatcatggcaaaaggaaaccactctatggaaataacgtctaaaggagaccctctttatcccggagaggaaaaccagagagcagtcacaatctggctaacataaaaagaaccactccttgatgcaaatcaaaagactagatgtagctaattagacatgggaaaagggtggttctcctgaaaatctggggcctcaggcattttctggaatgtgtacagtcagaacgtgcaagttagtcagcaaagagaaaacaagcagccacacctctcccaaataccgaatagtcatccttcttttgtggttcagaggtgtttgtttgtcttagaatgctgcaacttaaaaccaattgattttaaataaaaatggtaacattataaagtgtgaaagtgtggggttaggaatcatttcccaccctgtgaaaatggctctatggtcacccaggggtttgtgtgtgtgtgtgtgtgtgtgtgtgtgtgtgtgtgtgtttgtgtgtttaacctgtgagataagaatggtcaaccagttgactcctcaagaacagtctagattgctacaggcatgaagttgctttgagagcaggttgaatgcccacacatgtaggtttggtagaggtggtggtgaaagcggtgagcatggctgcagggtactcatgccactcactcctttttgttacctctcacaacctctctctgtctccatctgacatgcctccctagactgtctctaataccattagaaacttcagcgcaaattgtgcaacctctccgacactgaccacaaaccctttccagcctcagaaatgttcatagatagatgagggttatcagggttgctcagccagtgaactccgaccacgctgggtgaggctacatttgtaatctgttctggaaaacgggaaccatgctccattttcaacctgcactcacccactcctatttctttctagggtgtctctgtttttttgcttttaaccttgggtttgactttttccagtggacatttctaactaggaaacttgatggtttccacttagattcccttattctccaacttaataaacatcaatacatttagaatccttcgctttccaagactctaactgatttgtggccacagtgatctttaaaattcattagactttcgtcattccattttctttattaaggcatccatatgagctgccatgtgtttgctctctttcatatatctgaatttactgattgttgtctccaaaacatgttctatcttagacactatctcatcctcttctctgccagatattgattattcatacattctctgatcccaaccaccagctttactcattgttatgtctttgtagctttttcttcccttaaatacaaggacaacctattatttccacaattcagcactttttactgggtcttttacctctctaaacccaacaagagcatcaaagcatgatgttgggcttggtgcctctcttccaccattctttctctttttaactccacatgtgtgctggactcttgcttatgatcttccctgtgtagctaccaccacaaaaatgtgtccccggcctttacaaatgaagtgttcagatgcaagccattctcttatagacatggcagtaaagaccaattaaaaaagggggaaaattggtgctacaatgtcactttgcgggagaatgatgtctgtaaagtgggagcctatgtcttgcaatatgctgatgccctggttgaatagaccaaactattcattccttcctctatggcctggggagatctctctccatcacacctcagtgaagacagctttgatgcatttgactgtggtgccttgggcctcccagttttcaatttttatttgtttttttctggtggctgccttcttgactgctgatgtgtagcttatgaaggagtgaaggatgtgccatcccaaaatatggcagattggtatattgagtatttcaagttgaaaacattggagacagtgtagtttcagaaaaggaagtctgacctgtctcttcctgcatgtagcacaccataaagattcctctgggaggggtacccttgccttaccagggcgagaaaatagcccttaattaccagagacttggaactggaggctacactggacctgatatatacacttaacaaagtaacgcttatgtgcctgtggttttacacccccccaccccaaatatctcctagtgactcccctagaaaatgtactgccctggccagattttctttttgctgtcatttcttctcaaatgtattatcattcattgtctaaaaaatataaaagccccttcttcagacttcactgtcttgtgaagatcttcatgtacacgtgaaattaatcaaatgtgtatacttttctcttgttaatctgcctggtgtcgatttggtttctaggtcctgctgaggagcccactaagagctaaaaggaggattgggggtgatcactggctctcctacagttatgccctattgttttttttctttaaataccttttccaacaactcgaagctcagcagtatggtggacttcctcccttgtgcatagatattgttgcatcatttctgtcttccagagaactacacttgctaagttcagaatactttatcagcttactttgtgtccttgttcccatggtggtgacaccgatcttgaagcttaaaaaatcccccaaattccgcctcccacctctgtgacactcttttgcaaaaatatgcaatttttctacacacatttctgacaaaaaggaaaaaaatgttaagtccaccctagttctgtccagacaagcacagagagaggcgtgttagatttccagacaaatattttcgcctagattttgctcaatgaacttgattcactgcagggctttttttcccacaagcgcgtggcagaggtgggctgccacaggagtggccagtgcccgctctctgcagggcactgctatgaatcaccattttcatgaatggaaagaataggaggaggggaaaaaggacaagcagcttgttgctaatgccctcaaacaaggcaaacattttgtgaataatttttagataatatatgacggtttggatctttggttttgttgttttgaatggaatgcatagaaaaaagaacttgtttcaacaaaagtttgatctgatatcctattcatgggctgattctttctcaaatatttggcagctcatccagggcacagaaaaggcacagtgttgaatcatgttgctttcaagctctgtatcagtggaaggcactggaagggattatcgatcccacaaaatacacaaggaaagtatgtgcccacttcatttctgaggaaatttagggttcagatggaccttgccatagactcagtgtctttagtagaggccaaataaataaataagccaacatagatgccaggcaacttaccatacagcatgctgaatttcttccctcatgtctggtgactggttttatagaacccattcagtgagaatgcaggagaagtctaagaattagaaggaacaaagaaaagagaatgagcacgggaataaaagtaaataataatcatgtctattcttgattctggggactggctaacttctgtcactttaaaccacttcacctcatttgaaagtccaggcttctcagcttgatgtccaaggttctccatgacacatatcttcttgagcacttcacttcatgccccgaccaagcttggacttcttccccctcacatgcttgctgtttcatgtttcatgttttagctcatgctgttccctctacctggaacatcttggttcactcaactaattctacccatcagaatttagcacaggtgtcctcctctcttcatggtcttcctaaatacctcttgggttcattattcctcttccatgttcatagatcaccctgggtattactctgtgctagcactttccttctttctgctatgtagtaccagtcaggcactcaggggaaacgactatgccattcactcattcagtcattcattcattcattcaacaaagacgtattggattactattatgttccaggcactgttttagggactgaagataaggtggtgaacaagacagataagattcctgttgtacaggagtatgcattctggcagggggatagattaaaagggaaatcaataagctaacacgttaagtgctaccgataagatgaaaatatgtcaatgggaagaagagtgcctgctgatttagactgggtggtcaggcaaagctttgccaaagagatggctgaagctgagagttcaaatgcaagaaggagtctatgaggatctgggcacggagtgtctgagttggaggaaatgcaagcacaaggccctagaggaagaatgagaactgtgagctcaaaaacctagaataagccatgtgactagtgaacagcatgtcccagcaaaagtcacacttagaaaatatagggcctgagggtcacaggaaaagttgtttattctttacctgatgggaaaccttgggacaattctaagcagggagttggaagacgtgatttatattttgcagaaatcaccaaggctctgcatgctgaatagattttttctttgcatccccagaacctagcacaatgcctgcctctgtttcagtagggcccagagccgtgctgcttttccacacaggaaaattgccttttccaaggtgcatggctgcccagtagagaggaaagctcaaagtcatatcaattcaacacgcagtactaagtctctcctcttgctccattttctactggcctgtgaccaactacttcctaaagttgaaattgcttccgatttcttttttctctatttcatggataatccatgcagtgtttgctcaacctgtttacactgagatgtgttgaggaactgtcccacggcaagaccacaaggtggggcagtaatgagtaattggaagaaaactgcggtaccttctaaagctcaaatgtggctttctagaacacgatgaagtggagccctacattcattatttgaccttgtttgtttttttttttttttttttttttgagacagaggagtctcactgtctcccagactggagtgcaatggcatgatctcggctcactgcatcctccgcctcctgggctcaagcgattctccagcctcagcctcctgagtagctgggactacaggcgcaagccaccatgcccagctaattttttttttttttttttttttttagtagagacgggatttcactatgttggccaggatggtctgaaactccggacctcaagtgctccacctgcctcggcctcccaaagtgctgggattacaggcatgagccaccatgcctagccctgtgactttttctcaagggcttcaaacagtccctctgcaagttaacctaggcatactcacagagcaagaaggcattcatgataccacaagggaggtgaggtttgtgccatttgctccatgtcactgaggcaggacagccctgtgtggctccattcccacgagagaccgtcttgctccgttaggactgcctcccacctgctaagggtgcttttcttccatggtacagtgatctttaatcatttgtttcaaaaatgtaccaacctcccgggaatgaaactaaccaaacttccctccctccctctctccttcccttccttccttccttccttccttccatccttcctgtttgccttccttccttccttttggattatgttgtttcattaaaatatatttagctgggcatagtggctcacacctgtaatcccagcactctgggaggcagaggtgggcagttcacttaaggtcaggagtttaagaccagcctggccaccatggtgaaaccctgtctctactaaaaatacaaaattagccgcgtgtggtggtggacgcctgtaatcccagctactcgggaggctgaggcaggagaattgcttgaacccaaaaaaagcagaggtttcagtgagctgagatcgtaccactgcactccagcctgggcaacagagtgagattccgtcatatatatattcacatgatttaggaaattctgtatttcagcatcacagtataaagacttaagttctaagagttgatattgctgtagatgttgggaatggaatcttaggagtaacctttaccggaggcaacttctactgcccttgctacctttggtgtgacctgaaaccccctttcttcattagtaccaagtgacttgtttgccactactcagctgtcccagaatagcttgactccacacatccatgcatttctaggaagaaattaggtgcattataaataacgagtcctctgaaaatgccgaagtgtcttaatcttttgaaaaaaattatctcaaatttacattcacaaggagccatgtcttttgccactaactgaaactcagtaacaacactgaagtatgagcttgggccttgtctgacaataaaaaggaaatgctaggtcccagggaccacttcaagatgtgcttgttcctttaaagcagggagttgtcacatccaatttttaacacatatgtatattttaacacatatgcatattttaacacacatatatatttctgattatactgtaaaactggtaaattatttttaaaacatcataaggcccccaaatcccagagaaagttgtttctattacaattttagtctatttgtctcttttaagtttctcttccctctgagcatatgtatctctaatgcatgtctgcttatgtaggcatatttatacatacaccctttcttttacaaaactgatatcaatttttgtattttaaataaaatacaaatgttttacattctttctaaacaagcagacactacttttggcacctcccaatgctggccaggtcatgttaactacccttaatcagctttttttcttgcaatatttgtaatatgcatcatctcagggcaagagacaaattagatcatttgaagattaataaatccttacctctgtttggttgcacttagccagcaaattcatcacatgcttagtctttgctttattctgggccatgtagactagctgttaagtggaaaaaaaaaaaattcttcttcggggcagagtggcaggatggctctttggaaagagtcttggagcaggagtcaaatggtctggctttacaccccagctatgcttacaaaagctgggtaacttgcagttcccttaccactaaagtggaaacatggatgtctaaagcttttttacagctagaaaagtctatgcttggttagcattgtgctgatgcaattctgttccagataaccgagggagggaatggcggtcctcgcgtgaagactaagtagacgtgctattaccctcctcggttggctccagcaataagcctaatgacctctacaaagctgttctgtaatacagaagtaaacacttactctgcacaatttctccttgcatgtgcttcccactggtagaacattattcatcttgttggtctttccaaagagattcattacttccttgctccttcttattcatccttcataatagaaatgctaaaagtctgaaagacgaggaagggagcacatttcctccctgcagtctgaggaatggctgtatctcttcatgagcaccaagaggaagcccccagatgggtccctgtccttacagccttgtttccatgtgcatttccaccccagcctcttccataatcgctccccatctctatgccccagcgatgccagttgttccatcaaacactgtcctctctgttctcagcctcggagcttctgctccctctgttaggggtgactgattctcaccaccaccaggctaattctgactgttctggtttcaccgcggatgtcacctcctccaagaagctcttctcgactttctgcctgcagaccctcatctaagctttcacaacaccctgtgttctgtgtttacacccacccaactttttcttttttaaattttattttaagttctgggatacatgtgcaggacgtgcaggtttgttacataggtaaacgtgtgccatggtgttttgctgcccctatcaacccttcacctagatattaagccccacacgcattagctgtttgtcatagtgctctccctctgcccacccccctgacaggtcctggtgtgtgttgttcccctccctgtgtccatgtgttctcattgttcagctcccacttatgagtgagaacatgctgagtttggttttctgttccttatgttagtttgctgaggatggtggcttccagcttcatccatgcaaagcactggatatcattcctttttatggctacatagtattctatggtatatatgtaccacattgtctatccagtctatcattaatgggcatttgggttggttccatgtctttgctattgtgaatagtgctgcaataaacatatgcacactcaccgaactttgcttcactgtctatcagaaaactgccagtttttcagttgcatttatctcctagaatataaaggctttgaatagatccaatggtcttgtttaccattgaatctgatacctaacatggaatctgacacctgctagacaccctcagaatgtctgtgaaatgatgtaactctacgtgatgtgtgtctactcatagctgtaaaatgagtgagccctcctgtaggtcacagtgtccagcagactggcagggacctgatatgaacatcacagaggaaaaaaacacatacgaaacaattaatgcttgccattgggccaaatgctttgtatgtgttatttcatttatatttttatttaatactaagcagacttcatgtaccctgtattttgctaggcagtggagtacatagaaaggaacagaaactgcgtatcttgtcttcccaactgaaaggagacgattaacctacttgaagatgttagaatacaaatacatgatatctgaggacagggtgaagaaaaacaaacaaataagaacatgaaaaactgtgtttgtcttgactattcaggatatgaaagtgccgcaacattcatgtatctagaaactccatgaaggaatctacacttagggcttaaagaatcctaagggaccgggcgcggtggctcacgcctgtaatcccaacacattgggaggccgaggtgggcagatcaggaagtccagagatcaagaccattctggccaacatggtgaaaccccatctctactaaaaatacaaaaattagctgggcttggtggcgcatgcctgtagtcccagctactcgggaggctgaggcaggagaatcgcttgaacctgggaggcggagggtgcagtgagccaagatcgtgccactgcactccagactggtgacagagggagactccatcaaaaaaaaaaaaaaaaaaagaatcctaaggattcctggttcctgacaggtgcttgttccttgaagtatacttgtgccgggaagcaaatcttctctctctcgttttgaacttggaggagacagcagctcccttctccttttcatacaggttattgtttataagagcaatgtgatgaaagcttcctctgctaagactgcaactccagcgttaccttttctttacctcaccttgatcctcggtgtgaaacttcactcattactgatgcattgcaattaacagatctcctctttcaagacacattagggtatgttctgactatcagctccaaaaaaataaaataaaataaaataaaataaaacacattaggaaatttaaatgaattagtgtaatcagctgagatagtacttgaaagggaccgtgtaggcttgtggtggaataggtactttcagacagaagtctctagaatattcctgaggaagtattttctcctgcccttcaatgaatagagtggtaaggtttgtgaaaagcaggcctctggcctgagttagggaaattatatattgtttgtccaaagtagtaaactctgtctaaaatgaaactctagactagatattattttttgatgttagatgtatacgttctctccatgatttagcagactttccagggaatgatgagtctcccctctactgaatactataaacatgttatctcagtgggaaaaatagaaagagatccagagaagaagagggaacatcttgcttttgaagcatctctgcttacgagtccataggaaataaattacatttcccagggttctgatttggtttttaataacttactggccctgctaaacaagacactcaggagaaagtgcatgtgaatagatggagatctacatttttagaaaatatgtttctttcttttgggatcacaatcagaacataggcatcattgaaacaaagccgaggaagaagaattttctcatgctatgcagaagttttctgttaaagatatcagaggctttgcaccctgagagctgtaatcttctctccttgagttcttcattgagatttactgcagaggcctcagatgtgtttatttctattatccagttgctcctaatattacttgcaattgttttggcatgagggttagaaattgcaagaactcctagctcgaaatcacagaacgtacacaaagacaaaacagaaataaagcagaacaaatgcaaggataaaatagataaaaatatctccccaccctaattgtgctcttttaaaggaatgctattgaaatgacaaatgaaggagatttctacctgttgttatatagctgggcagagtgacatttttggctgtattctagtgttgagcagttgcaaagctttctttccccctgaagcagtagagggtgctatgtggatataattgaagagatgctaagtttctatatgacgccagggcttagggactgccctctcttttcaagccacttgcttttcccaaaataactaagaaaagggagaaaaaaaatgagtacagaggccatgctagaagacatagataaaatattaagtcttaagaaaggtaggaaataatcagattctaaagttctcacaaggtttggtattttgaagtatttggcagaaggcaagggtatggaaaactttaagaaattgtaagcttaggactttatcgtaagcttaagacagagatgttatctgtctgaaaacagagggaaaattttgaacagagtgattcttgtaataagagaagacttttgacaagttatgaattccttgaatttcattattttttcttgctgtttaagtagtatatattgtatatttgatgacagtcagattttactgatagagatttgaaatatattttgatagggctacctcatgctttttgtagaatcaaacattttagagctgttcagccccttggagccattaagtacaatcttaatgtttttgcataaggagacattggcaccaagaagttaagtgacttaacctgtaacaggctggtccaaacatccgagcctcaactagaaccagtgtccttacccctggtccaaagctctctgtcttttgctaccctgctttgagttacagcattttatatgctgacaatacataatcctaatacatttatatattgttttcacttacaaagcagtttatgtacatttttccacacttatgtaccaaaacgtcctttgaaaatatgttatttgttgatttactcaaagaagacttgcccagttttatgacaggctgagaagttaagtctcctgttgcaattccgtttgcaattcagtatccattacacctggtcaatcaagtttcttattaatcccacgttttccctgcctgtaaactcccttcttagtgaccgattttgctattttgtgtgagcacttgagtaaaattcaactgactcagagtagggaatcctggctggattaatgggattgtgtaacaccttcatcacttgaggcccagataggagtgactgtgcgatgtaaaaaaggcttgccaacaccactgatgtttgacgtgaaggtgaaaagttcagtggcccagagaagtgctttaagggttcttcttaaatctaacacctgaggaacaccttcagattatccagcagttgtgatcccctatgcagtgtctatttgtctagacttcttccccaacacacattccctagtacatttaaatggaaagaaaggtctgggaggttatttgcaggggtgttgatggaaacaggacccatcacagctagggtcatgttatcagagtgcagattttgaattcctttctgcctttcctgcatgactttaagtaagaaaatggtcaccttaaatttgcccaataagactcagcttggaaatcattcttgggatgcagaaggatctggtccagaaagcttcagagaagccttgagaactgcctattcaagaggagaagaaggctgagagagggaacctgcaaagatctagcaggaaaagagtcttctatgtgcaaacaacactagaccctttcccagaattggggcactaacaaaagataatgcctctgaaatattgggaaaattgttggagaatatgatctcgttccctatgctgtcactccaggtaacacccatgatgctcaaaggatttttttaaattaaaaggagtaccactttatttaacaggtagaaaattatggaaattattataccaagaaaggacataggctaataacataaattaggcttaaggagagtttcataaattatgtatctccaatggattaatgaaggaaattaggaataatttttatattatctctacttttttacttatatatttggacttgaggttttctgcatataatatgcacactaatataaatattaatataatgctaatacaaaggaatactctctcagagattgtgcattaatgtatgtttcagtgacaaaatatagtgcgtgaccttagccccaggaggaagaataggatatgtgaaagaacctaagattttgaacccaggataacctggttttaagcccaggtctgctacttaagagctgtacgactgtgagcaagttattttaaattgctggatcttgttttcctcatttacaaaatagaaacactgatatctgcatcatacatcatactattgttatgatttttaaattaaaaatatatgccaatgaacctagcaattggtgaccatattgtaggtacttcatggatatctgcctcttccttccatgtgcaaaaggaattctggcatcatcttttataattactaggaattttttactgccttcagaaaatatttctagacttatcctgctaatttttgtttagaagttagcctctgtttcagtccattctctcattgctataaagaactacctgagactgggtaatttatagagaaaagaggtttaattggctcgtggttctacaagttgtactagaagcatggctggaaaggcctcaggaagcttacaatcatggcagaaggtgaagaggaagaagagaagtctcaaatgactgaagcaagaggaagagagcaataggggaggtgctacacacttttaaacaaccagatctcaggagaactcactcactatcacaagaaaagcaaggggaaatctgcccccatggttcaatcacctcccacagggcccctcctccaacactggggattacaattcgacctgagatttgggtggggacacaaatccaaaccatacagtccctgaatatatatgtgcagaaatagactgctcacctagacttcaaaagacatgtcatcattacgcacctctgagacattgtatggtcttggttttaaatttcttgagtaatctggttaattctgatactagcgatcaacagctttggtgtaaaggtaggtcagattggtgatatattgctacagcaatttgaggaaatcaatttcctccctaaaagttttgacaatcttgtttatttatatattttatggtggtgaggggagaaattattcttgagatcttgcttctttgaaatatggttcttctcaggaatatcctatgttattagatgatctaaaacactgtggcacttcttaaataaccaatacttaagataccatgaaaattacaacccccgtgagatatagtatcaattaaactatgccatatacctcgattggttgagttccatccactagtcaatttcaaaattacctcgtaaatcactaagacaataggaaagaaagccttactataacttgccttactataacttgtcttactcccaaatttagcaatatctttttagcttattgatggtatttcaggaaaatcaaatgtagttccacattataaggatggagacatgtgttacctctttatgttcctgtatggcaaattagttgatactctttggtcttgtcgacatctctttaaccttgtaagattataaaggttagaatcatgtttaccacctgtaaaaaaaaaaaaaatctgacagcagtgggttttttttttttcttcttcttctttttctccaccacatcccctgataatgatttccatgggctggaaatactgggaggagagaaatatttagttgaattcattttaaatgaaaccaatagcttcactagtgatctcataacctcaaagcactttacaaactgagtaatcattgaagatgctaaatatagtaaatacaatgtttaaaaccttcacaaataaatccatattaaagtcttattctaccacaaagtagctttgcttttgatataccttttaaagtcatggatttcttgatggagatattgagttgggttgttcctgttgctttttgtttctttgatttttttttttctattatataagctagacctcactctcttagtcatttcattatatgtagagacaagatgctgccttaactagagctttattccaggtgcccaaaggtcttcatttagttcctagctcaattcgtgagtaaatatttcttttccagctttaaaattttttaaatgacattgtcaggcacggtggtgcatacctgtatccccagctacttgggaacctgagatgggaagatcacttgagcctggcggttccagtctgtagtgcacagtgatcatgcctgtgaatggccactgtactccagcctggacaacatagcaagaccccatctctaaaaaaaaagaaaaaaaaagaatgatagcatttcctttacttgtggagattttctgactataacatgcacactattattataaaataatagactttacaaaatataatggttgtagtttcatttgcactaaataacgataaaccttatttaagtgcaaccttattttatatatatatatatatatatacccattaatttgattgtttttaatgtagccatggacatggagagttcacaaattataatttataaatgtattaagatagaataattgcagaatagaaggatttttaaacaatttaaatagtcaccatttctgccacccattaatcctatatattggttctaggacttattcctggagttatatcctgcacattggcttcaggcatgaaggacttgatcccacatcttctccagtgggattgtggagatcgtgtcactgctggcctgtcctgcaggctcttgtggtgatcattataaaagccagccctggggtagctcaggacaggaaaggaaggatattctgaaatgattttctccttttagttaacacattttggttccagaacactgagcaaatcatcaactgaagccccatgatatattttcaaagagtgaatttctcttacctgactgaggcattttattctataatagcaattctctgggttttttttttttcatacttataacaaagcggattaatatatactcacctaagacaccaaagatactgatggctttcaccactctatctaagcaggagtaaacacctgggaactagaaatctgagaaagaggacaacacccaacaccacctaactatggccctcgatacagtcatttaacttaataaccttccgtgagagtaaggtcattatgaaatatgctcggttttacacaaagctttaaaaaaagccacataaaatagtatatgaggtcacctctgattcctatgtaaagaagattcctcctcccttccctcattcattgttctccacactctactccacacctcccctcaccctgcaatccaacttatcaaaagtttaattttccctttccaaaagcaatgtacttgaaattcctattcttagttatgtgcattttggtttcctctttgattttcctttttttccaggtttcctgttgataccaacatgaatctcaagggcttccctttgcttcttttggaaaaaaataaagaaaagagactgatttagagcctatagggtggaaaatcacagccaggaaaaggcaggcatagcatgcagcagttcagagacagggctcacccgcccatctcttccatcagccacctccctggtagggcatcccttggaacagaagccagcaatggtcctgcagggattggagaattgtgagctctaaatgataaaacgttgagtcataggttatcactgtacagagtgatcctttggcctctgccttgagggcacgtaagccattttttccttacttgttggaatttgattcatttcctctttttctcctttagctctctaatctagaattctcagtttatctataaaaggattcaatatctgggttgatcctgaggagtcaaagggttggttttgtgagcagatgggtggcagacaatagcttttgtagagatgcctctgaatgagcccacatggtggggctttgagaagcctagtgtggaatcagtaacaaagtccaccttggaataatagtaccatagtttcagtaactgctgattccaaaaatgtttcctatcacacatcttcctcatctgcctctcacaacaatcgtgtcaggagaaagctaatccaactataaagtggctacgtgatcagaaatgacaggatgggttcattgcaatgtcaagcctcagtagtttttcatcaaagccctcaaaaaaaaaaaaattccaccccaaactgattgtgtattattcaaccagacttctggtatcttcaggcacactgtttgcaaaggccaggcatctcttatgtcctgctgtctgtagacctctgtggtttatggatgggaaaactcaaacagtctgctcttagatggtccttattgcagaaagcaggcttatgccctgtaagccgggggtatctccaaatcgtgcaggaggagaggtactgattgctcatttgcttcttctgtgccttaaaatcaccatccttgttaaagaaatgcaagcattgagtagagaagtgtcttgcttgggcttgcttttgagtaccgggaattcagctttcctgctttggaaacctgagttgggatgtaggtgtgtagcaaaaggaatgggtggaggcttctaactaatggggaaggcatctctgaaacaagctgagatgtggatctgggattctgggaatcaaataattcttcccagcaccaaactttgatgagagaatactttaatgtctgtggttgcagaataaatatgattcactctgaggattctgcactgcaattgaatatgtcagaaaaggcaaataaaaaattggaaaatttatctgtaaatagttctcaatagttttagaagagcttccaaggacattaatttcttcctagccattatttattaaaaccttcaggatagcatctcattttttggccacactaatgtagcaactaagtgtgcaggccctggattcagagctaaatctgactctttcaagctgtaagcccttgagaaatctacataaatctctctgtgcctcattaatgtcaactgtaaagtgaggaataatgatattatgtattttgtaaggttgtccgaatgtttaaattagattataatacttaatattaattgaccactttggaagtgagcattgttctaaatgctttaagtatgaattttattgtcatcgccatccatatcaattatccttatttattatgctgttataagaagctttgatttcacaaagaaagaaattcaacacttaaggaggaggcatgagaaaacatcttattgaggtttttaatcatcttctagtgaaccaagcaagactgaacctttattgcaatgttttactaggctttatagcacttttaaagggtcaggtaaataaagtcataattcaaaacagctgttacggggtggggcacaatggcattgatatcaagagactctagtactgaatcagttacttcctatttatataattaaaaaatttttttgttgttgtttgtttgttttgagacagagacagctctgtcccccaggctgaagtgcagtggcacaaacgtggctcactgcagcctcaaactctcaggctcaggcctttcccacctcagccttctgagcagctgggactataggcatgtgctgctatgcctggttaattttttatattttgtagagatagggtttcaccatgttgaccaggctggtctgaaactcctgggcataagtgattctcctgcctcggcttcccaaagtgctgggaatataggcatgtgcccacacctggcctatttgtataattttgaataaatcatttaatcttgctgagcctcaaaaagcaagctttaaataaagaataaattaaaaattaaaaggttgaattaggtgatatcaaaggttcctttcacatctatgattctaaatattactcagtatttactctgtgcagaatgtctatttccacaggctattgcttacagcacaacacagtgatcatattcctctttcgtaactagggagctgagcaccacgatgctggctactggcagagtttatccctcagcccatattaagtctagaaatgattttgtccaactgatgttttctcttcacatcagatgtcacttttttttttttttttgatatggagtctctgtctgtcacctaggctgggtgcaatggcgtgatctaggctcactgcaacctccacctcctgggttcaagcgattctcctgcctcagcctcctgagtagctgcgattacaggcgcacgccaccatgcccagctaatttttgtatttttagtagagacagggtttcaccatgttggtcaggctggtcttgaactcctggccttgtgatctgccgaccttggtctcccaaagtgctgagattacaggtgtgagccactgtgcccaggcttttttttttttttttttttttgagacaaggtctcactctgtcacccaggctggagtgtagtggtgcaatcaaagctcactgcatcttcaacttcctgggctcaagccattctcccatctcagtctcccaagtatctgggactatatccagttatttaattttaaattcaccacactcagctaatttttgtattttttgtagagacatggtctcactatgttgcccaggctggtcttgaacttctagcctcaagcaatcaatctatctgccttggcctcccaaagttctgggactacaggcatgagccaccacgcgcagccagccatcacatttttagataaaacatcgaggaagtacttatactgatatatacattttactatagcaactatagtaaagagaaaccagtgagtcctaaaactgaatttttaaaaaaattagaaacatagagttaaaattaagattatactcaaagttcttcagagataagtattaaagtcatatttccaaacctttaggcactataaagaattccataaataagaggttatttaaaattaaaaaaacctatgctcaagcaatatctttgatcataagacaattctggcaatgagacaaattcttgaaatctcaacaacactaacatgggctcagatttttgctttcaataaatagaacctcatcaaagaggtcttggaaattctgctagtcaatggaataaaataatgaatcggatagaagtcctccagccctgtgctggaccgaaatgtctctgactgcctgtcatatttcagaggatcgtgctcctcagagcagtgtggggctggcacagagatgaaagaaagaagaggttcctccctggtttctgtttatttgaacctgaatcagaatagagaggaagcaaaggagaatgaatggtgtgatccaacttttcttccatatgtgaacaatattgacttatatggcataattatgcccagatgctgtcgtgacagggtgtagagatttctgacttgcataactgaatatattttttaaagacaacaaagaaaaagaaatcagtcacaacattgctttagcatcttgagtcttggagtgcttctgccatggaaagttatagtctctgctcttttctgcttagactgtatcttaaaactagcttcaatattggatggcctattttaagggagatcctgacacttagtatccaaattacaaaagatgactaggttactgaggatctgaagattgtcccatataagttatagttgaatcttctgtggaagtttaacttggataaaataagcagagaaatgacaaatgtgttcacatatgtgaagatcatccttgtttttcttgttttgttttgttgttttatattctaggaagcacagtggaatttgaaagacagactttagatcaccatattggagacctttataacaattaaaacataggaatggggcaggaagccttattaggtggtgagattgtgagattcctctgctgttgatggagactagacagaggccagatgaatgtgtcaataatgttgcaagcactgcttccatattggctagaaatttggaaggttagaaaaagtcaccaactctatcatcataagaaaactgagttgagggcagaaagtaatatgatatctgggttttggggaaaccagttacctctcttcaaatctttaatgtggaaagaatgaaaccatcttagacctttttgagtacagaatgacttgaagtcagaggaaggagcatggcagacacagaatgtcccaaattgagacagcatcttttaagcaaattgttgtccctttgggtagagtgggaataataatatcgcactcacatttatctcacagatgctgtgagggtgtgtgactcagtgtttttaaagagctttggatacctgctgtggttaatgtgtcactcactgcgaagctttccaaggcaattattttgatcagaatgtcactcagagttagtaggctggcttcatgaatcatttggggagggtagtataattcaaatttgttatgtattgtcaaacatttaaaaagaataatagtataaaacaaaatacttgcttttacactaaaatttaacatcttttttttttttttctgggaaaatagaatgttgcctaaactgaagtccaaacaactttactttttaccttttcaaatatccatgtggcatcaagccaggccatttaaaatgacatccagttatttaattttaaattcattttgtagaaatcccacctctctggggagtatgtacagcaaaagtaaggccatcacaaaagctgaatgtcccaaagtggtgctttttagcagaaaatgtaatttttttaagatgaaacttgccttcagtgttcttagagagtgggttccatattggtttctgaaggagagtcaagcctggtctccacagtgcactaaatgcagtagggggtcaagcaaatgatgggaaaagcataaatcatcttggaattatagattcctctttgctgtttgactttaaattcaccatctgctggctgaatcttgatgggagttgaacataaacataaggccagtgcatgactgtgacgtggaaggtggaagaaagttccttctgacttgttaaaacccttaaaatctacacattattattattataatttagacaatgtctcactctgtcacccagactggagtgcaggggcacgacctcagatcactgcagcctcaacctctccagctcaagcgatcctcccacctcagtttcaagtagctggcactatgggcatgcatcaccatgcctggctaattgtttctatttttttgtagaggtgggttttccctatgttgcccaggctggtcttgacttcgtgggctcaagagatcctcccacttcagcctcccaaagtgctgggattacaggtgtgagccactgcgcccagctgacatctacagattatcatctattattcttgtatttgttaaccatgatctcaaaatgatttaattataaaactcaaaccttaaaggacaattggattccaaaatgtagattatatgtagataatatttctgttcacaagtctaggtgtacattagtatccattcagaaaagtgaaaaaaagtttaaaagcatttttaaaaacatgatgaaactataacactcaaaataatgtgatgggggataaaaggcagttgattgataaatgagtcattgacaggtcaatgctgtaaaaggccgagtctaagttgatggctctcagtcctggttcgtcactgctgttgtggaacttggcaacgagtccctcttgggaattataggcttagcatcatgctcttgctcgtattagctgcttcttctatcactctttcaacagtaacatattaaaaacaaaaacaggaaaaaaaaccctcaaaacttctcaggtaagtagtattaaggacacaaaaatatttcaggcttgatttagaactacatttatgaaagtaaactacgtgatatagagcaaaaccacaacctttaggttttggggggttttggtcttatttctctttttaaaaataagagatagggggtctcattctgtcatccaggttggaatgcaatagcttgatcacagctcattgcagcctggaacccctgaccacaaagggatcctcccacctcagtctcctgaagctagaactacaggcatgtgcctccacacctagctaattaaaaaaaaaaaaaaaaaaaaaaaaaaaaaaaaaaaaaaaagtgtgtagggaaggggtcttgctgtgttgctaatgttgaactcctggccctaagtgatcctcctgccttacctgggattacaggcatgcaccttgtgtctcactaatagatttgctttctaggtctttcctgtcaggtccaccaatattttagatggatggagcacttgattagatcaggagtcaaaattctattcctgaatctattacttaccagttgtactactttgaatgaatggcttaattttttagtgactttgaattgttccagatataaaatgacaggataggtctagagagttgccttagatgaattaggaaacagtttctgagatagagatgttagtgcagtaggtttattggggagtgttctcaggaatgcctgtggggaagtgaaggatgtggaggaggaagatggactggaattcatttgccagagtcctcagcagatcctaccagctctagagctgggatggcccttcagagttatcctgatccacaaggggtcagcccctaggcattcataagtcactttgtccagtcattggggttgaccccaggaaaaggtatggtttggggtaagaggactcttcagttgagggtagttcctaggaagctagtgagctatgagttggcatcaggcaacatttccagcaatttggtcaatgagttccccttaaggctggatctgggccacggaccatggcactcactgccatattcacagcgtcgttttcagtgtgaaattctactgtgttaaagtattgtacagtcactgaaatgagagtatttttatatttggctacccatgacatttattctcttctgattatattgtttctctcctgatctagagttttagattgttttgtttgttttgttttgttttcctgtacttttctgtctgttgaggaaaaagagttttattcttctagtatgagagtttctattagtcctcctttttagacagatgaacaccctgtgacaattccttttgcctttttgtggcgtgtaaaaaaaaagaaatccataaatagagtcgttacgcaagtcttcatgagttaatttctctctccagttttcttactactttttccagttttcattttcttcaacagaaagcttcttcttctggctggacacagcggctcacgcctgtaatcccagcactttggaaggctgagggggatgtaatcccagcactttggaaggctgaactcctgagttcaggagttccagaccagcctgggcaacatggcgaaactcccaactctacaaaaaatacaaaaaaaaaaaaaaaaatagctgggtgtggtgatatgcccctgttgtcctagctaaaggggaggctaagctgggaggattgctagaggctgggatgttgaggctgcagtgagttgtgatcataccactgcactccagcctgggtgacagagggagatcttgtctcttaaaaaaacaaaagtttcttcaaattgcccctttacaatttaatatgcatgaacacatttctttacaaagagaaggttatcttttatctatattcaaaatcatatgccctggggatctttacatcacaatgcaaataaatgttgagttaaccaaaggaagtgtgagtaacaagttagtgactgggttagggggtggttaggacagtggcgtgtgattaagagatgaacatctcagaccgatgcttagtaaaacctacagggggaagcatgatgacctagccttgaatatctcatttaggaagttacacacgtgtctgggcttttcaaaatgtttgcatgccattaatcagcatcttacatcagcttgctcaatgaatgatgactatgtcaaatggaagtaaaacatataaggccagagaaggatgaagggaagttttttttaatgcagtaaaggataaagaaggatggaagtggccaggagtggtggctcatacatgtaaccccaacactttgggaggctgaagtgggaagatcacttgaacccaggagtttgagaccagcctgggcagcatagcaagaccccatctctgttttttaaaaataaaaaaatataaaaaaaagaaggttgtaagttattcaaacccataaggagttcagccaatgtattgaggtttcacactttagatatgatcaatttgctgtctttggccttaaaggaaaaacacaaacacagcagcctcgtgttcttctcagacattggtttctcctcctttcttcctaagacagctcttttcccactttctctctggccaagtccatgctcagcattgcgtgacttcactgttagtctaggtttattctgctctgggaagtttccctgacccccttcttgacagctgcagatcctgtcagtcacttctctgtgtgcttcccttgccttccttgtagatttttattacatcaattaggatacaccattacaatgcattattttgtataataaacacctgtatagtttctaccatatgccgggcactaatctaagtgatttacaaatgattattcttctgaccctcatcacaattctatgagagcagtctattattttcaccaatttatagaaaaggaaactgaagcatagagaattgaatacattttctttgatgtcatagcaagtaagaaaaaaggctaggattctaatccagggagtctggctccacaacaggtgcaattaaccaccagaccgtgaggcctctctgtcatatgcaagctcgtctgttttgctcagaagactgtgttttactcactcactcccaacttcttatggtaaaaattgctttttaatgatttaaataatacatgcccatgtaaaagttaaatcaatgactaaagcattctgaagaaaggaaaggttacctggaatcccatgaccctgaaataaccatcattaaaattttgttctttatccttccatgcattgtttaatgtaccacctacccacacccatacacagtaattaaatgggacaatataaccatttttttaaagaaggatggacatcatctgctctcatcctaccagagttgtctatcccaaaaagacaggttaaaaatctatgtgttttttctataccttttattctctcataggcttgtatctctcatttacgttaatggaactcattggtgtttcaaaaacatgatcatcttaaatgtactcttttagatgttgctttgctcactcagcagtcaccccatgtcacctggcaaagccctaatttatttttttcactggccacgtgacattcattccacagtgtagatgtatcacaatgcattcaggtattctcctatggtattaacttggcttctagaatgcaggggctgtctttaaccctggtgtttgtgacattgtgatgggcataatgggatcccttgaataaatatttgtaaaacatggatggaagtcagattttagaaagaataaattagttttttcttaattatgcatggatatggtcttgaatcggttctcaataaatcaaatttcagtaagggactcacttaaatgtatgagaagagacccctgtaatcaatgtttttaaagttaaatgattgtcttttacattttaactggtgtaaaataactaattattgttccaaatagaatttttgcttaaagatacgtacaatggaacgttataaaaccacctatatttacagataccttgtgctttgtgatctggcttgtatttttcctgttcctttcctgttaccctgtgtacgaaatgtatgttcttcccataaaaaaactaaactacttccagttgtgtaaacacaacagattctttcagaccactatgccttggtgtatgtcaaccctcagctaggaataacatttccatctctgtgattccattggcaatttctgctcaccttttcctaggttgaagtgccacttcttctgcaaaacttttcttgaatctcctttcctgttaccctcctgcacaattaaaaacttgcatccatttgatcccatagaatttatgctgtacttacatgacaggtacttacatcttttattttaactcatttatatcacttacaagactgtttttttctttaggacttggaatatgaccttttcatctttttcactgcagtctttttagtgtccagcatggagaaagtgctcaaaaatatttgttgagtgaatgacagtagagaaaataaaaatgtcctggattggaatcatgaaaactgtctacttatctctaatattaaaaagctcagtgtaatcttagaaaaaataatctgagagctctgacactttccagaggccacttccacgggaaaggaggagcaaagtctctgatcagaagttgagtaaatatcctctgaggtccctgattatccagacattgacaaaagaaaggctctccaaggtttgccattattactataaggaagtcccagctcagatgattcatagttaaatatttgcatctcctctggctaagaaaaataaaagccacgacattccagagcctttaggcatgtaagatcttggtactttcccagttattgctccttagaaaccggtaactgaaaaggccctgtttcagaaaagcaagatatgtcaaatgggaaggaagtagaatagctatctggttggaattcagaaagtatatcaaggccaacaatataattgttgaaattggttattaatgttttgatactgtgacatatctgttttctgttctctaccacaaacaagaaagatgttgaaatatggcaaatgttatgaataacaaagaggaaaatacaaataagttcttttggcaaatctccgtagcaggttgaactcagactcctttaatgtcaataaacaaggctcagagtcaatgccactttctttggtggtcactttaagtgtatttctcttacaacagccctgcacgtccagtgttattattactgcttcacagataagaaagtggaggctcagaaaaataatgatccataattgatatagtggtatatatataatttatatattataccataggatttaaactgaagtggtaaagcaggtggtaatttgcagagaatgattttggaaatgctccgtagatacctctggctctaggcatataaaactattttcttattaactgaaaatttacaattacaacttgattcttgtggtttaagacaatggaggctttctacatggtgcatgcgaattttcccaaaatctttcccaaattcatttataattcagtgtgggtgagcttaccagttcctttccagaaaacaattgtgattaaggagttcacacagacaattattctgttattctcctctgtcctcaggtaggcagtgctcctcgagctttgggtggcaatccttcaccaatccattgtcagtgtgggtccagcttttcctccttaggccacaaagatagagttgctcatattttatttccaaaatatagtgttaggggcctgaaggccacaaagaagactattctgaaagctcccacactgacatcctccccagtactggaaaacaagtaataaaagagtaggaaaaaagacctcagggccttgcacataataggccttccataagtttatttcataaatgagattctgcttgacggactggcagatggagcctgagtttatagtcctgtctgttattaccttgctttgggccctgtcataacacttcctctcaaacacgtttgaaagaaatgcagcccaacataggccgtctcctcgctgtgctgagagggtcttgggtctcacaaagcaacacacacagccaggtcatgtctctgagcatcggatctagaaaactacaaagccaggaagacatggacaatgctaacatcctccctttgtccaccacatacatgcatgaaaacacacctaccctcactctccacccacccacacacacacacactggaaattgtatcatacacacaccggaaattgtacccaaaggacgctattactaactatgaagcaagtggcacccatggcttgtccagagaagacacccacagggtcagacttcacacaacaagcctatgaatgggatagcccacatttaggagtggtcttctaatccagaatcttctctttatttagttcaagataacataaacttcctttttgtaaatttgtccatcatccactcccttgctcttatactctagtgagggggaggtcagatgataaatgacaaggaagatcatttccagccgtgatgagtgagatgcggaaaacagggcagccatggagcagcgagagaacaaccaggtgtggtcaggggattccctagtgaggtcgtttccaaaaccctcatgggtagacctgaggctgtgaggaaaagaggaatccaggcagagagaatcaaaaatgaaaagtcctcatggcaggaatgagcctatttcaaaaaaaattaaaaaacaaaaaaatctgggtggcttaatgaaaaagaacaaagagacccaagaggctagtcagtttcgactggtgcttagaggccatggtagagtggacatttttttgtttgtttgtttttgagacaaagtcttgctctgtcacccaggctgaagtgcagtggcacaatctgggctcactgcaacctccgcctcccaggttccagcgattctcctgctgcagcctcctgagtagttgcaattacaagtgcccgcagctaaacccagctagtttttgtattttcagtagagatggggtttcaccatgttggccaggctggtctcaaactcctgtgctcaggtgatccacccgcctcagcctcccaaagtgctgggattacaggcatgagccactgtgcccggcctagagtggacattttattctacatacaatgggaagccatttgagggatttcagcaaggagattacatgatctcaatggacttcttatttttctttaattttatactttaaaaatttttgaaacaggggctcaccctgtctcccaggttggagtacagtggtataatcatagcccactataatctcaaactcctgtgctcaaagctatcctcctgtctcagcctcccaagtagctgtgactacaggagtacacaccatgcccagctaatgttttaatttttttgtagagatggggtcttgctatgttgcccaagctggtcttgaactcctgagctcaaacagtcctcctgcctcagcttctcaaagtgctgggattacatacatgaatgcacctggcctgaatgtactttttaaagaatactaaggctattgaatgaccaggtggggtagcagagaggaacactgtgagtctgtggcagtgtctggataagggattatgtaagtaccactaagatggctatgttgaagagtgagggagcatttagtttgtctgttttataagtagaggccatcagacttcagaggaattcagacttaaaattcatgtgcctttgaatggggaccacatacatgtcacatcacactaacactaatgtttcattgattcattctatcccttcccaggaatcaaattttgattaagagaaagaccctaagtggctgaaggaacaaaaagagttattgcaaaaaaaaaaaaaaaaaaaaaaaaaaaaagctgatgcagttaggaaagggaagcctgagctattaagaaaaacacattgcttcttacatggtagtgctaaaggccaagcctgcatatccctgcaatctataaagtctgttttctctgacagtgtcagagttggaaagatcaataggtgtcactcacaccattcatcatctcagaaatgagaagatttaggaaaggagattgaaatgacttatgtggggtcacagaactagttattgttgagaccaaatttagagtcttgtctcctggatctcagtattatactttaattatttcttttttaacatgtaacccaatttgctcctaatagacttggaatacacagtgcctgaaatgtaaagatgacttactcttggccttaaggcatcaaatctgccacacgaaattttaagataagcataatacatcattggaattactcctgcttcttgtacctctttcacatgagttaccatgaagtgaactctatcttttatggaggagaggatatggaggagcataggagaaaggtaccatgtgaaagaataaataacgtctttgccttggactaagttgcattgcagttatcaccggaagttgacagctttggataataagcatggatcttttttgtctttgttggagcctgttgcccttcacctttatgtaacatctaaattctttattctggttgacatgggttgctttacaattttaacttggcatgtgtcatacgatcataggtataatattctacagttacaaaatatgtttgataagtatgaggcattcatgctcattgtgaaagccttcaaaatgtctgtacgctaggagaatggtgaaaaacaagcagtcaagtgagtctcagtgggttgttttctcagaccacgtggactctcttctcaaatctggtactggttttacgtgactttggagaatcttcattctcaatgagccccaaacttttcagtaaaataaaaaaaggattgatattttatgaaacatttttataccctaaaatgcagaagcatgttagaaatatatagttgctatcagtcttcaattaaatgtttaccacttggcaaaaatgatactttggtaaatccaaacatgcctaggtatccactctgtatactccggagaatgttcctatttaagcttattattgtcttgagcattaagcatctcacatcagttgttacatctggctttaagtctccaatgagccctggggaactcaatcccatcaaaggaatttcgagaggagttcacagctcctatctaccatagaagggagaaacaggataaggaatagatccctgataaagcacatgaacaaattaaatccattgttaatttgagtgactggcatagagaggtggcccctacaaaattgtcactttttagagtcacggtggttcacagaagaatagaaatcatcttttcctcttaacattatttccatgtactacagttccctctccctaaagtggtctacttgcatttgtcaacactgaaagcaaaaacaaagttgaatatacacccatggtgcatattgttaataaagaagatggaggcaattcagtggtattctaattgtaatgataaaaacttacctatttcatcagttcctctcctttgcccctaaaccccaaatactcactttgtctcttagatatcttgaagtagagttaataactaacgagaataagcatctccatccatgaaatattttaaatatagtagtgtggacctaaaaagatagtgaaattggataggccatgaatagaacaagtcctcatgtcataggcaaacatccagaaagttgtgtgttttgcatttgtgttttgttgtttacatctgttgcataggaatgatcatagttacaacagctgacatttaatgaggacttttcatatgttagacactgtgctaagagctttatttacatgctttatctaatttaatctgtacaaccaatttatgaaatgggcattttccagacaaataaaatgacgtttagtaatttcattttgattgcctgtagtcaccgccaataagtattagagggaatattgcaacccagtcaactttctccagagtttatctttctgtattcctcagctggttgttggaggttgattgaaaaaccctttgtaagccttgaaatgctaaatagtctacataggaaaggcttctactattgtttctacttttttttaatggtttgtaatctcagcagggattgtgttatctaaaaatctgcttgatgaggtctgagatactggcttttagaggtcagacaggaatgactgcaagataacttgactttctccttcccctctgctgctaaggggtaaggtgggagtggttctaggacttctgccatagaactagatatgtgatggataggaaatgaaaaaatgtgccactactgcacaatgtcaagagattaattggcatttaatgaaatatctgtgccatattattttatagtgtgcaacatttaaaacaatacacatgtaaaaaataaaaaataaaacaatatgcatgtatgcatacatacacacacacacttttagctctgtcttgagctgtcatctcctggggcaggcttaatgacaggtgcaattctggcctaattcaacctcttgaaattgaaaagggttagcaccactcagtggctgctaaatcctagagggcaaaacagcctcctgtgtctcatcccttcatgactgtctcatgggagctcgatttctgtctctttccacctgctaaccagattcgattttgatgctgtaccattggtagtaaaatatacttctttctggtaaaaggagacctgagaaagtagaaatggcattatttaaaggaatttatacataccatataagttggctggatggaccagccaacaagctcaacactttgtattcattgtttcttttaatactcatttcaagctcctggattcagtatcattatctccatatcacaaagaatgagggactctgaaaaactcaagaactttcaaggtcactcacagaatacatgcctgagctgggattctaactcaaccccttaagcccgatatcctgtactttttctgctatatcaggggtcagcaaatgatagccaatgggccaaatcttacatgctgcctggttttgtgaatgtttcatggaacacagccatgcccatttttttatgcactgcctgttgctgcttttgctttacaacagtcaagatgagtgcttgaaacagaggccacatggcctgcaaagctacaacattgagtggccctgtatgagaaacacttgctgaacccaataacaatacgtgagagatgtattgttattgacaataacgaaacatgagagatgtagctcaaatcatttaactcagtgtgtctacatctttttcctgtatcttcaaaatccaacaggataggtctatagatatactgtcttaagcccagcttcttgtatacatttattttgttccaagataacgtgcagaaacccgaattccagataggtctcttataatgagtcatgtttaagagggttctattattccactttgcatttctagaacatacttctttcagaataattactttctaaacctgttcacttagcaggcagatggaaatccaacatcctttggcagagaagagagaggaattttccactcgggcaaagtgaagcactggtcagctcgtggctgaaattttttatgtcatcccctggttctacagaagactgtaaggacagaggaatgaggcatttcgccttgggatcttcagactcagatttctgagtcaggtttgaggttcctgctgtcctgtgggcagtgaggcccagggattacaccaaaggagcaggaacccaatgtcacaggtcccctaactcctgcctagttgcccaggccacataggcacaggcaggggagctggctgatctcatttgtttgttttccgtgtccgttctcaggcagtgataggcatgctatcatctcaattcttaaataaaaccaagttgtatcgttgaagagcagataaagcaaagacagaagcattttaaaaggaattttgtggcttccaaagtacaagtatagagtatttctgagttaatgaagaaataattacaaaatatttttgaaaaagtgacattttattcatagtaattcatgtaattccaactgaagtaattgatactttgtaatagtaaggacctattcgagtgaatgtttaagatactaattatatatcaattttaaattatttaatatcaaaaaggcttgaaagcagcatattttgtgtcattatgtgaattcttgctttgccatttttaaaactatttgttttctcataccccctcctctttattttttatgatgtcaaagactgtgtcagtcaagtctgtctctatgtcatttgagtttatgtttatgtgttagtgcatttttacaagttaactatccagaaacatgcacactctgggcagaataaaaaatgtctaagttaagtgaaaaccactttaaagcatggcagccaaaatagctgtagaaaagtttatgctctattatgtacaattttaatagacatgatatcttgtttcccagaatacaacagattgactatcagtcattttgtaaaaaatgaaagcaaaactaacaatcacaagagctaagatttgctggccctttgcactgtcccaggcactagtctaagtcttttgcaagtgtttcatttttacagcaacacaatacatttcctactgttgttatccatcttaaggaggaaactttgtacagaaggtttaagtagctaatcaagttttcacagctgataagggatagagccagagtccacaagcagtctagattcttaatgccaatgctgtattgtctctccagaaaagaccactctcacctttccccttgttcttgataatacagttaaattattcatattcatagcataaattttctgtatcatatttaagaatacagttaaatattggtgcatattagaaagatttcacttaaatatgactacatgaaagtagatttgtcttttctaaaaaataaacaagcatttgttttctaaaaaatttactggcgtgcaccatttcatttcctaataattcagaataaatgaggtgtcaccgtggtccacttcaacagtagatgggcttatattcaggcaggaagcatgtcacctatacaacacagatgtgggtgattaatgaaaactaaatcatggggatgagatctttaagaagaagaaaaccaagttgtcttccagaagtgttttcagaaccccctgttttgaggttgtggatagacatgacggttttacaatgccaaaacagtctgttctaaagagaaaaagttcaatcaaccatttcacctgcattatgccgaagagctagtctttacagtcatggggctttaaaactattttgatagcctgtttgggctgcctctaaatatatcctccaaataaaaacctcagaaaatgtatcagagaaatgtacataattaatatttggcttaatatattgtcaactttgattttacatgtcccatccaacttgttaagccttctttgtggccattagtgtttactagagaataatatcatatttaattttctaattatgtgcgaaccttggagtcaggattagttgatatttttacaccttcaaatttataaacctagtatgaagtcccatctagactaacaaatgttttataatagaaatttaaatagtactccagttttgtttatgcatttgctgatggtctttcttgctatgaactttagaaactttaaatgtccatttactcacaatacacacacagcctcaatgacctaataagcagatttgcagagccataaccttgctggcttatgtcagctcgaagtaaaaggggaggtggtagtggtgaatctgtttttattactcagtgtttaatcataatgaatcagaggcttttatgagaaaccttctacatcccatgaaagatttgctgatcaaagatgtagagatttctgttttattagaaaaaattgtttagcacctcattgtggatacagaagacattgtttgttgaaaagtttaagtctttttacgctacattggatgtcacactgttctgagtttagtggtatcaggtcatcagattctgtaagatgtgattctaaaaattcagtcctagtcctaccgagtccattagagaaggtctgcagtatataaaactgtgacttaaaaaatgctcaatcttccatgcacataactgcctgatgactctcaagctcaggtgtgaccttcatagacaggctgttgtaaagtctagtaattccttcaacacaaggtaacttagtatttaaaccttgaccacacatcacttcagaattactaaaggaacttaaatatatgtcagagctcctcttcggaatataggacaatggagcttatgcagatagcattactttaattttaattgtacccatctgggttcttcgaaatggcaagtatttcgtttatgtgcctttctcatcttgggtcaactcagttccatgcactttaaaattattttaggaaagagccacatcttttttttttccttctttctctttctttctttctttctttctttctttctttctttctttctttctttctttctttctctttctttcttttttgtgcatgcatgcgtgcatgcatgtgtgtgtgtgtgtgtgtgtgtgtgtgtgtgtgtgtgtctcactctgctcgcccaggctggagtgcactggtacaatcttggctcactgcagccccgacttcacaagctcaggtgatcttcccacctcaccttagcctcccaagtagctggaattacaggcacatgtcactacactcagctattttttttttttttttttttttttgtatttttagtagagatgggattttgccacattgcccaggctggtcttgaactcctgggctgaagtgatcctcctgcttcaaaagtgctaggattacaggtgtgagccaccatatttggccaagaaccacatcccagtgctgtagaaaactccaaaaatttattttgcaattcaaaatataaaagtttgttagtagacatttagtttgttagatatttaaatctactagacaatctattatgtattctgctcagaaatggttaagacctactgatctagaagacggatctctctgagccataatttctgctcaaggcttgctaggggagatccttctaacttggctttatacacaagaagctagctcacaaaaatgtcggtattctagtagctatgcgtttcattgaccagacctgagatttggcctctccatcacttcctctgcaggtgatgtagacatcatttctgctgacatctatgttgatgcagttctagagtcatctgtgtccctattatcctgaaaatgaaaattgatagcaaaggcagataatgtccatttagttctgggtgtaaatgtcttccttgctcttccattgtgcaagcactttatgatttgagggagtaatcaggttatattccttctgttggccagaagtgcctgttgaagaaagacttggctctgttgtctggaagctaactatgtagactgatccacagaggactccatattcatcttcttgatactgagggcttcatctgtgagttgtaagcctgtaaatcctctgtttcagtggtttcaaagttccaagagcaggaggaaaatccagactgcctctgctgctgtgcagagcaattagacagtttgagtgcctcaactgttcctatacaggccagtggagtcagagccttaaaaagaccctcttctcccagtgctttctcaagtaagtacagcaacctcaatgtcttatagtatcactacagcacaatacatgagtagttttacatttgaagtaggattaaattaaaagtaatacattcacatggtaaactcaaaagtatatggccaggtgcagtggctcatacctgtaatcccagcacttagcgagactgaggcgggtggatcatttgaggtcaggagttcgagaccagcctgactaacatagtgacaaaccctgtctctactaaaaaccctgcagagacggccaaccccatctctactaaaactacaaaaattagctgggcatggtggcacgtgcctgtaatcccaggtagttgagaggctgaggcaggagaatcacttcagcctgggaggcagaagttgcagtgagccaagatggcaccactgtactccagtctgggtgacagagtgaaatcctgtctcaaaaataataacaataaatgtatatatagatataaattatatattaattctatattttatatataatatatactataatttatatacttataaattatataatatacaaatatatatttatataaattatatacctataaattatatatataattatatataggtgaatatatacagatgaatagttatatatgtagatgaatagatatatagatggataattatatatagatgaaaatatattcacatgttatatgaatatataagtatatatttatatataaattgtagatacataaattatgtgtaaaattcacatgaaaaactctctccacctcattttaccctttattccttctctttaaatctgttgaccaaaacaaatcactgttaacatttgttatttaggggtccagaaatgttttgtgtataaccataagcatgcatatatatacatatcaacagctacatttagatggtccacttactacagccccagaatggaaatttcttcctcaaagcaaacattagaggcatcttttgggaaaaaaaaaaaaatctatatttatctcattctgttcttcatttaattagcataatccctgttggatattttcctcaccaaataaggaacctgtaattaagtgttatattacatgtgcttatttctcttcctggaagtccattttttaaaaatatttttaattgatatagcatagttggtacatatctttggggtacatgtgatattttgatacatgtatacaacatgtaatggtcaaatcaaggtgactgggatatgcatcacctcaagcatttatcttatctttttttttttttgagatggagtcttgctctgttgcccaggctggagtgcagtggcgtgatctcagctcactgcaagctccaccttccaggttcatgccattctcctgcctcagcctcccaagcagctgggactacaggctcctgccaccacgcctggctacttttttatatttttagtagagatggggtttcaccatgttagcccagatggtctcgatctcctgacctcgtgatccgcccgcctcagccttctaaagtgctgggattacgggcatgagccaccgtgcccggccaagcatttatcttttctttgtgtcagcaacattataattcttttcttctagctaattagaaatatgtaataagttattgttaactataatttccccactataatatcaaatactgtaagttattccttatatctaactctatttttgtacccattaaccaactgttatttacccctgctcttctccttcccagcatctgataaccatgatttcacgctctatggagatccttgctttgatgataaattcattaaggacaagaaccctgcagggtgttcaatatgcttcccaggtgccaaatagtctcaatacatattaacagaaagtcagtgtcaactcacctgcacctcacacagtaaattgatttaggcatctcagattcctaaactctctaggttaacacctcatatagtaatgaaagtataatcagttcacatgattgaaatcctctctagtttaatgtacttgttgcttttccatggactttgaaaacatgaaggtctgtagccgtgttgttgcttttccatggacttggaaaacatgaagttgtgtagccgtgtgtctccagacttttaacagcccagaaatggtttcaatgttctgcattaaataaatcgagaagggttagacaaaacagtgtctgaaagatttcatgctgtgagggtgatgagggtgatgggtgacattaatgaatctgaaatggtcgtgactacaaacttgtttttaaaatgtcactttctctaagagaacaaaaacttgaaactcaatgttcatgaatacaagaaggccttttcaaagaaaggccacgggcactctcactaatacacacttggcatttgggtatatccctaagctgtggactgtgtttacatatattactctttcttctcatcactctttaaccaaattgttgagtgtccaagatgccacatggtcaatggattattaccctgtggattcaaatctgttaccaattactctaggggtttattgagtggtcctgcacacccactttcctttgtttttctaattatcgctgcacagctaatcctagctcaaaaaatcaattcctctctcatatctacttacatatcctctttaagccccttctgtgtttttttgttttgttttgttttgtttttgttttatctcacttccatctatttcctggttatttcaggaaaagttcttttcacaccactttttagtggattccatcctgtctctcttcttgtgaccataaaataaaatttgtcataaacaaatgtaagagtctggatgtttctacaaacatttaagtggcaggaagaagctaaagccatatttttcagtcaaaatgttagcagagattttcctgcactgtgcatgatttattttctttctttatatttttagataccttataaattgtctaaaatctcaatgaacaacatttatggtcaaataacataaagaaaaatcctttatagccacttacttactcaattgtatagtgttttgacattctaactacactatcagtatggttttctgttataacgtagtataggtatagattttagccacatagtaggtgaaataggctatgtgttaatctagactaagacacagccattatctataacatatattttatgagaatttgcattccaaggtaaaaacaactgtttgaaaagttaccttttaaacaaatccagttcatatggtgcattactttcattttctgaaggtgattcatatggaagtattgagaagagaaacatcatagtttaaaaaaggccaatcagactttgaggacaagatccaaacattatgcaactttatatcttagcagagtgcacttagtaggtgttcaataactctttgttggataaatgactttatgagtaaatgaagaaaacctcagagctattggcttcctgtgccttgaattacacttttgagtgggactgccttctgcaagccagttgaaaaatagctattggctcacagagttcacctttattttgaggactctgtcaagacaccttagtgcatgttcctagttatgtgaaagatatgctgccaatcagaatcccaatggtctccttgtatgtttcatctttaaatggggctgcgctgttagggacaggatatatcttggcagactacatggatatgaaaatttcaaatcttcccatagtcctctatctttaaggaaaatcatggcacttgtttttgaatttttttaatccatcttccagattccaaaactaggaattccaaatgttgtttggacagactgaaaagagaacaaccaataggagaagtggtacactatgagtagtcaaggtaccatacacatgggaagtgtgaaggagacttacttagtatttacttatgtctctttgccaatatttgggagtttcacagagcatttctagataatgagggatggaagtgaagagtaggacaaggtattcaaagatctaagaagaatgagaaatcctcgatttcccatatgacaggatgacttggttacacgagtaaattgctttttgtatgtgaaacaggcagcaattggaggtagcaaaggaatacacaggtaagccctggagtccaattcccaaaattagtggtgttttctgattccctaactgactctatggtaggctcctggtcaaaagatccatcagggctgctgggcccatgctgacattccatatagccatcttctttctgattctctgtcttccagtgatgatccagctctttgcagcagcaggattgtggctggccagaagcacacttgatttcaaaatggatgtgacgggcaggtcacctccttttctgcagaagtgtacttgcatcaacaaatctttttcctctcaggttttgaggaaatgggatcaaacattccaacacagagaaataggaggcgtgggcagcagctctcctggatctctctctttccttgaggagatcaacttgtaaaagattacaaaatgtaccctaagtggtcctagagcaccctcctatcttctttcccaagcttgtcatgtggttgcagtggacatggaaagtaaacactgctataaacagagaataataaattgtaagaaagcaccagaatatccttcttgcttgaactttgaatcattagatccaaacattccccctctctcttctcaaagttccaaagtgttaaagagttttgttctccggtatcaggagttggccacaaatgctttctctataagttcataattcctgttgggaaacttggaaaagagctctccccttctcatccaaagaagtgatgacttctctttgttagtttacaactaacaaagtcccatttctggtttgaaagtcagatggaccttggcttatatttatttaacaaagacgtggaatttctctaacagactgaaagtttattagaataacatctagcattaggcctggcaaataggaggtcctcgttaagagatctgatcagatttgacttctaatcccagatataaggtgtttattctttttgagccactatttcctcatctataaaataagaaatattcataactattccataatatgtattcttatatcctgtataataaaataactaatataggaatataataaataactaggaattataaataatataagattgtaataaatatccaaaatcaagggcctccttgaatttgttatatattgatttgttgattttttgagggcagtaatcaccacgtctgtccagatcagcgcggtgtccacgccccactcagcactgtgccttgtccatagcagatgctcagtcaatatttatctaatcagtgctgtttgtattcaaagagaatgtttaacttcttactctttccattcccacctcccctttttgatctcatgtccactatcggtgtactgaggtctcctgggctctgtttgcaggaatctaaaagtagtttttttactttggtactgggacatgtaactccactttttagagaaaatatttcatgctaattaaaacatctcagggctggtctccctgcacttctcactttcacacctacatactcataccccttttctctttttccttactttgtaatgctattagagttgacagaatacttgctgcttccccagaaagtcttagccaggagttcatgaaaccctgtcaggccttgtgaaatgtacagatgtgtttcaaatgatccataaaccctgatattgtataaaatgtgtgtgccattttatggaaagaggatgatatgttttcttaaccaaaatctttcggggtacttcggtccataaaaggctaagatccactccactaatgagcaagatctagtcatttagaaaatcctgcactctctcctttgttactgcctcaatttccttaaaaagctcttataagataataaagaagccctctttacttcctacagttccactccacagcaataccagcttaagtgtgtgccttccagcgtccatcccatctctccgtctgaggggtccccactcctagtccacccaggccaggaaacccataactcatatgtaccagaaaacctcctttttaaatttcctcatgcttcctggcaccctgacctgacaatggactagtacctcatatccacttctaccatgacttctgagaaagtggtattttttaccacagtgaacttggtatatgcagtgtgtgtcaggggcactggccttactaaagtagaggcccattctggagaatagtaagaaataaggagcaatacattgatgaaatagaagggacattaagtgatggtcacagaccactcttaggactgccattaacttcagatgttaaagaagtgcttcagctctctgtgctttgtcttcttcttgacaagtgaggatgttaggattatctgccatgtcatccagcttcaatctctataattgtataaatctggttggcagtggactcgttagtgcaaagtcctaaagccttaaagatccgaagttttctcactgggcaagcaatttgcgggattacgacagtgaacttggtgtatgcagtgtgtgtcagggacactggccttactgaagtagaggcccattttggagaatagtaagtagtaaagagaaatacactgatgagacagaagggacattaactgatggtcacagaccactcttaggactgccattaacttcagatgttaaagaagtgcttcagctctttgcactttgtcttcttcttgaccagtgagaatgttagacgggattatctaccatgtcttccagcttcaatctctataattgtataaatctggttggcaatggactctttagtgcaaagtcctaaagccttcaagacccaaacttttctcactgggcaagcaatttgcgggaaattaaacaagtccaaaatattgaacaaatgaagaaaggggccattttaacagacaggaatacttcatactgtaaagatggccaggtgtagtggttcacacctgtactcccagcactttgggaagttgaggcaggaggattgcttgaggctaggagtttgagaccagcctgagcaatacagggagacctcatctttgctagaactttaacaattagctgggcatggtggcatgcacctgtagtcccagctatgccagaagagaagggaggattgcttgagcacaggagtttgcaactgcagtgagctatgatcttgcaactgtgctccatcttgggtgacagaatgggaccttgtctcaattttttaaaatatatatatacatatatatatatatagagagagagagagactatatatatgtgtgtgtgtatatatatatatacagagagagagagacagagagagagtaaagatctcatttcctccacaaatgttaaaaacattattctgattttaaaaaaagaatgaatttttaaaatttacaaatttctgaaatggacaaaaatatcctaggccttcttcctcaaaaaataataaataagaataataagaaattgcactggtatctgaaaaagcaacttaaagctataaaaattaaaatagcatgttatgccatgaaagagacaaatgagatagattcaagtttcaaaataacaattgttattattatgatacaattatattaattttgtacctataatttaaataaaataataataaataagaaaaatcactgaataaaggtaataatttaaataatttaaaatcttaaaataatgattatatgtataataaaactgtaaatttacaattatagagctataaacaattttatagttgtaatattttgtaactaatgaaacattatattttaatgattttattattgttgtaattaatataaagaagataaagaaaaatgggcaaggtttgaataagcacactttgtcgaagatatatggatagccaaaaagcatataaaatatgaccaaaagcctctggtgtttagagaaatgcaaattaaagctaaaatgagattcttctaaatacctatcagaatgtctgagattaaaatgactgactgtagcaactagtggcaggaatgtggaggaactgaagttctcatacactgctggcagaaatgtacgatgacacaacccttttgaaaaacattttggcagcttcttaacaatttaaatgtacatatcccatgtaagccagccagtccactcctgggtatttactcaagagaaatgaaagcctatgtccatacaaagacttgtatgtaaatatttataacagctttatctgtaacagctaaaagttggaaaccacccaaatgtctatcagcaggtgagcggataaacaaattgcggcatatacagtgtagatagtggaatactactcagtaataaaaaggaatgaacaattgacacatgctacaacatggatgatgcaaaataattacactaagtgatagatgctagacgaaaaagagtacatactggctaggtgtagtggctcatgcctgtaatcccagtactttgggaggctgaggtgggcagatcacctgaggtcaggagttcgagaccccccaggcccacatggcaaaaccccgtctctactaaaaatacaaaaattagccaggcgtggtgatgagtgcctgtaatcccagctactagggaggctgaggcaggagaatcgctagaacccgggaggcagaggttgcagtgagccgagatcgtgccactgcactccagtctgggagacagagtgagactccatctcaaaaaacaacaacaacaaaaagtgtacatactgcatgatacaaaattctaagaaaagaaaactaatctatataaaaatttttctctgttattctctactgagaggggatgaggaggattaccaaggggcaaggaggaccttttggaggtgatagatgtgtttattactgggattgtgttgatggcttaccaggtatctatgtaagtcacaactcatcatatggtatactgtaaatatgtgcaggctgggcgtggtggctcatgcctgtaataccagcactctggaaggccgaggtgggagaattaaggccaggagtttgagacatagcaagatcttgtctctagtaaataaataaataaataaataaataaataaataaataaatgcacttttttgtatattgagttatatctcaatgaagctgctttttttaaaaaaaaaaaaaacatataacataaaagagattaacagaagagattcaaaagtctagaacaccaaatattaaaggtagcttttcaaatcagtgagaaaataatgatattacagaaaatggcaaatcatctagaattaaatttctacttcatactatcagcaatataaattgcagactaatctaaattaacaatttaaaagataaaagaaactatagaaaaatacacaattatgtatctgttcttgaatggaaaaagattttccaagcgtaaatacaaagaaaaatttatatagtaaaacaatgattgatttaatttgataatttttttagaaagtttacatcaaaacaaattacaaaattgaaaggcaaatagcagtctggttgtggtggctcacttgtgtaatcctagcactttgggtggccgagatgggcagattgcctgagctcaggagttcaaaaccagcctgggcaacgtgatgaaaccccatctctactaaaatacaaaaaattagccgggcgtggtggtgtgcacctgtagtcccaactactcgggaggctgaggtgggagactcccttgaacctgggaggtggaggttgcaccgatctgagattgcatcagtgcactccagcctgggtgacagagcaagactcccgtctcaaaaaaacaaaatggcaaatagcaaaggggataatatttgccacaaatataaaagaaaaggatatatccttgctatataaaaaggtcctatgaaacagggacttagttggatatttctatttttaaaaaggcaaatcatataaacaagtgttttacccacccatcccccctcaaataaagaaaaaagacagggatggagaaagaagggggaaaaaaaaaactgagtaaaaaaattctttgcaaaagagtaaaaaagagatttgtttcctcaccttgatgttgtctttataagttgttttattttaatcttttgtttttccatattttcagagttcctacaatggacttgtagtacggtacctgggtgatcacaaacataatctagggagtagaaaagaagttcaatgactcagcatagtgttaatggtcttccagatgaaggaggggacatgaacatgtgtctgtcccaataaaggttgagacaaggtttgttgtgcacgtgcgcgtgtgtgtgtgcgtgtgtataacagtgaggagactgtaattagcaggaaaaattggggttttgaaagtagaccacagtcttgtcattgtaccatgactcaccaggaggacagaggacaagtaccctactcctgtgtaaatccagactgccaagtagagcactgagatttgatgagtacttaagaaatgcttgcttgattaattggtaaaagatattaaaggggaagattttatatcacattcaaacatatgaagagaaatgttaaaaatgtttaaagttccatttccagtctcactttccaattcttggttcaaaatacaaggggtaattagacatcgactgtgtagtcaacattatgatcaggctatataaaatcatgaaacatcatcctaaactttaaagaactttgagtttagctgggaaaatatgctcacaggaaataattatgtaggaaaagaaggcatcaaaagggcttaaagcaaccaatcacacagagtttccttgttgggaccccccccccacccgccgggccccaccccgttgatatcctaaatgttctcttgacatcttggatttaccatagagcctagtactgtctgtaaggtcctgggcctgttctaattagtgctgagtatctgttgatctgctacgtgcaaatgggaagataaaactaaatgttagattagggtcaatctttaaaactctttcctagattgtgatggtattcagtggtggttgaccatcatggaattgggagatatttgtgaatgtggctgcaggctgcatgtcctttgtgtctctgactcaagacacacccattgatctcatttgtcttcatttcatcattgggcagaatgcgttctaaaatgaagagactaaaaccttcacagaagcacactctttcaacatctaaggaaaaattgttgatgagaaaactgtgagaacattaggaggtctttaaattgcaaggggaaaggtctgttggtgaaaacagctgaaatcctatggattaaatcaacttgtaaataatgtattcttagagtctgcagtgatctcataggcatgtttaaatgctgtttcttatgactacagtttaaagtcatggtatggactttcagtttcatgaggctggcctgggggaaaagagcatgaggttgaggttgatggtgttaactagagcaactgagcccccatacagaccttctgaacttgctcattaacgaagccacaggatggaaattgtatagtgtccttgaccagagcattagttacaagttgtgagaagagaagaaataagtaagaaagaaaataaatgacttataaaaatcctcagaagatatagtccccaactgttagcacaaagaaaggatgtaaaatcatggaggacagcagtggagaagataacgttagcagacaataaaaggccaaagttttagaacagtagtaagtgtttaagaatatacataatatatcttcctccatttgctttttgtcttcaccataaatagacatgagttaacgtatgtttaaagatttatttcccttttattgagctcacccaacaaaagtttttttcatcatgtcctgcttttacaaaccaagatctaatttgacatgattacgtaattgtgtggccatttgtgcccttccttctcctcctcctttctctaaagtagaaagcctctctttcctagagcctatgtaaaatgtgttaattcgcttaatagcaataataattttcttatgacaatttatctattcactaaagtgttattaaggacctattagttggaagcctctgtgccagctgttgggaatagaaaaatttataagacactgtctttggagctttcaatctagtgggggattcaaacaattaaagagatacttttaaaagacagtgtaataagtactctggaagatgtggcagactgccagttgccttccccagcataacattttcccaatattcattaggaaaagaaccctttaattgtacccaattaaaataccgaatctcccagcctcttctgcagcagatgtggctgtgtgactaagttctgtccaataagatataagtatacatgtttggtgagatttccaggaaggatgctcaagtggagatgactaagtcagaagaaagttccttttagctttcctgcattcctagaattctgatgcaaaagctggagctacagcagcaatcctggactatgaggtaaccttgggagtactagggaattgggatgctagtaactttctagaagcaccaactcagccccagaatgcctcctgctgacttcttttacgtgggagagtaagcatttgtgcatttaagccactatagttggatatttgaccattgcagacaaaaataagatcaaccgatagaatgccatttatgaaaaaaaaaaaaaaaaaaaaaaaccatgggagtggttctcctctctgttatgatagggagaggtcagagatgctgtccctgaagaagtgacattcacactgagacttaagggagaaatgagtgagcaaggtataggaaagtatttaaggaatatcatctgaagctctgaattagaagctatctacaagatactaaaagaagatcagcatgacagaagtacaggaattaagaagaacatagtaggtgacaaggctgaaaaatctcatagattctccattttgcagagacttatagatcatcttcaagatagtaatagctgcagagcagaaggctagagcagagaaagaactttgagagataccaatatagacatggtttctaaagtcttaggagacaataagattacccaggaagagtatttaaagtcaggagagggccaaagacagaaccttgagatccaacacttaaagatcaagaagaagagagtttcctatcttctgtttcttaaaaaataaataaataaataaagcatatcagcataattcagagtcacaaattctaagaaatcatggggcagagggcaggggtgaggtagggtttgttttgttttgttttgttttgtttgtagataaccaaaggaagaaacgattgatgcaagatttcagggagggtgaatagccctccttgtagctttgccctgctagagagatggtgggtggacaattactataatatttacaaacaggataagtctacgtcagcccctaacattctcagtttcgttatttgtaaaatggcgtaatgatacttatcttttagagttgtttgaagagtacataagagacggaaaaggatttttaattagataaggaaagcataatcacctatctttgattcattcacccttttaaactgattaaagcttagaaaataatcacatatgcagattgatcttagtttgtccacctcttgacaatcagttagtagtatatatgtatttttttatttttaagaatttttatatccccatgcattgactaatcttgccccatcatagataagactagaacaaaatattgctttgagaagtccttgagttccaaagatttaccatgaagctaatgaaacctgcattgcagagtccttcactagtatggccttttccaatgtcttgaaaggagtcctagtcacatgttcacatgcttacacatttatgtaaaatatgcaggataagataattaaactacaattatctaagatggcagtctttttttcactctgattttctgtccaaaatattcctcttgtggaagtaggtttggaatggccctgaacattttcggaatctgaactgagagaaagttgagtgaaagatacattgatttaaggcatagtgagatgtctagtaaagttattgtaaggtattccagtgttgaaaaggcttccagaaatatgccaaaaccgactgtgctgactcacatgatgtcatgccagaaagatgaagggccagagattgtatgatgacctgagtttgtccttgtgcaacaagcaccaatggcatatgagtgttgatgggacaagttttgaaatgtatggagccaaaagctagcctgtggaaagttctaccaggcattcgacatgtggtaaggtaaccaggagactaagttccgtggatgtctagtcaaatggaaattttcttctctcaagaataaacatgataatttcgtgtatgcaattctaaattcaccaaattgtgttttctttttcaatggcaatttcaggaaattaaatgatcagaatccccatgtttccaggggccaaacctgtaatagtcccacagacagtgagtgtgtctataacaactaatataggcagaaaaattcaaagacgttttctgaaatttgccaatacctgtaaacatttttaggacattgtcaaaataagctgtgaagctgaaagaagtttatttaagtattaataataaaaatttaataagctatgctaaataccaattctctttctattatctctatagaaaagattttacaaaatcattctcagatgtagaagcaatttttaaaaattcagccaaaaaatagtagggtgaaaagtattataatgatagcaggtagttaattaatagcatgttctttttctgaattttatgatgcttgtggctttgacaactttaaacattttataattgtggaatttcttttgtcgttttacagaaatattcagttttgtacctcataatttgtatttataattttgtattcttcttcataaaaagggccattgaattgtgtttaactcatgcctcaccaaacctgaaccagcattttcctctgttgaatttctattgcctgcctacagcaaggcccacgtcttcctgtaacagttgcccccagttcccttaactatcaccagggagtcagcagttaatgacatgctcaaccttcctccaattacagatggttaggagagaaaacaaagccataaggccattaaactcatgaggttttgactggtggttcggaggtagagctggccctggctatatctgccgtgtacacaagaaccaaaaataccacacttcatttcagaagatccagatttgatcccacctctgccactggtgtatgatcttcagaaatgaacttggctgtccgaacttcaatccccttattcatacgatagacctattgtgatggccggcaagctgaggtatagaaacacatattatatagtaaggggttcttcaaatgtaatatctgttctcaattcctcttctctatcattaccaaggagccaatgatgcacagctacccatgtaccttcattgtagagacacaccctgaacaagcagacaacatggcgccacatcagagtattatattagaatgtgtgtttggcatttctttagcagaggggccaagtgtaggaagggagcgggtagaaaaggaggaccacaggtgacaagagtctcccctgaccttaagcttgcagttcccactgaaccaaacagaagccctgtatgcatctggaagtccttgcttagtgggctgtgcaatgtgtgttttaggggtctcaagccttcatcccatgtagccatggacaacatgttccaggaaaacattacttcctcacttcattacattccaagtgacatttctgcatcccttcttgacgaatgttgtccaaaattggttgtccctctctttgatccagctctgaccacagagatcagttttacatacttgggtacttccccttggtgattcaagaggaggcactttccttaaatagccttggaaaccttgagacagctgctgcatccatctatgttcattgctcaaacttcctgtatggtttgccaccaggcttaggttcaaatccaaaatcaaaatcttaacatggccacccaggcgcatgtggcctcagtaatacacagtttttgagcttcatctcaagcttctcttccccttactttgctctccatgcctgcttccagctcttctgcttcacccagtccttccccatccctcatgtcacacaggttagcttctgtgcccaagtagggtcctgcttcctttcacaaagctgactcccatgagctctccagagatgatctcaagtgtcacttttgtggggataactaccccagtgacaccctcctccagatttggttagcttctcccattccagcctagtttagatggaatcatattaagttgctggcattaatttattatgacctacaaaaccatcaatagtgtacagttctcacaactcccttgtacattgcagccctcatcaaaattgttatgaagtaattgatttgaataatgattaatatctgactccctgatggtttataatctttgtggaagtagacaacatatctatcttgtctactgctatttagcacatactaaataccacctagtaaatatttgtttaatgttacttatttaactgcagagatatactttttacattttctacatttaagatgcacacggaatatgcgatgttgtggagaaaagagctatttgccaaatggttacttgttactttatttttctaaggctttgggcataaaatgccattatggaattactattttattacaatggtatctgtagtactttggccctaatgttcttttttggttatgatgctgcactatgcctgtggaatacattctggatgcatgatgagactactgagacaatcacaatcttgtaagtttccttttcttctaagataaatctcaagcagagattctcttctcaggaagagtagaacttttcacaatctcgagccaagtaaacactctcaaattgcaatgcaaaagattttgcaaaatacttgaaaaaatgcaatttataaagcagaagttgtacagatgccatggaagatctaatgaaaaatcagaaaagattgcagcacagatttaactcttctcaagacagcaaaagcaccccacatgtgacagatactcatgagaacattgggagcctgaagccccgttttccagacaaggaaggaattacgggtctctgatcacagcagaggggccctcattagacccatcaaggattgcacgtgccctgtgcaaggccacatgcgcatggggtgtgcaattaactctgcccatgctgctgaagtttcagtccattagtctgagtgaatcttggtcatttgtatccctcttggtgcctcataaacatatgcctcatagtctgcatcttcaaactttttccatactgtaaaactgtcttcgcaaaatctcatcacaagctgaaaagtgatccctggtgataaacaactgagatggttattcacctccatgactagcctttcagggcctcactttctatatccatcaaatgggaagaacaatagatgcctcatcctcctcactatgttgctgtgagcatctgttgaagtagtggctattcgagtgcattgaaatgcatcagtcagtacacagatacaagggcttctgataactcatacctgaagaatttttgtcaaccctgaagggatttgcttcttggtatacgggtattaaaatactagtataatttctctaacgggagtatgatgtcactagttccagagtcttttcatagatggatgggttttatgataaataactcaccctcagtgttaacttggctttccaactagccaaacaggcctttgtggaacaaggttagcaaatagcatttgggcaaacgatcaaaagggtctccctctcttctatcactctctttatctctcttggtacctctctctgactttctctccctcctttaaaaagttatctctgttttttttaattttttttacattaaaaacaacaaatgggcccttcagaatagtcgaaaactttagaatgcaaagatatcaaaaaataagaaataacctagatcagaaaacagataaatgattgccaggggttgggattgggaggagttatttacaaggtgaatgaagaaattatgaggggttgtggaacttttctatattttgatcttgaaaattatataactatatacttgtgttaatcttgtagaagtgaacactaaaaagggtgaattttattataaacaattttttaagagaacaaaaaatgtactataatcccaccagccaataacacactattaacactttggcgtacttctgactagtcttttttttttttttttttttttttgctggtgtttcaaaatgtcattatgatcatataatacacaaatatacatatatgtgtgcatatagatatctacagatgactaagatagatgattgatagatgatagatcagtgaatagataaccaaactcaaaacaaaatagttaattcatgcaacttgcacaaaaggtacaagaaatatactatgaaaagtctccctctcccctttttccttgggcacctagctagttttgttttagtttttacctagctctcctgagacagtgtgcatatataagacaaaatatacatatacctcttttgtaatactaagacaccaaattcatacttctgcatcctgccttttttctttacttaacaatacatcttgaagatggttcaaattacacatatatagataatttttcatgactgatttttaatagctgcatagtatttctatattttaatgcactgtaatttatgatattgtattgacaaccacccgggttgtttttaatatttcatttttacaaataataatgtgataaacatccttgtacttgtgagatttcttttcctatatgggttatttatctttagtagagcttcttagaattggaattgtgaagtctaagtccacattttaagttttgctagataaagctacattgccccctttaaagttgtgccaatttttactccaactactgatatatcaaagtgtctgttcttgtatcattatcaaaattttaatatttaattatctgatgagtgaaaaatgacatctgatagtcctgtcagttagtattgcttttaatgtgactaatttttagcttttattcatgtttaaatgaataaaatgtactccctttactactttttttttttttttttttgagacagggtctcaccctgttgcccaggctagagtgcagtggcgtgatcatggcccactgctgccttgacctccagggctcaagcaatctgcccacatctgcctcctgcctgtgttgctcagactggtcttgaactcctgagctcatgcagtctacctgccttagcttcgtaaagtgctggaattacaggcgagagccaacttgcccagccctgtatttcctttactttgaactgcatttgtgtatccttggttcatgttctatttgatagccatttcttcttaattagagggatttcttttttttagattagaaaaactagcccttttggctatgataagtggtttatatttccttttgtgtgctacttgccttttgtctttatttggcttttttttggacttgcattatttatttaagatttacgtagttggatttctttctcctttcacatatggcctctctcacttcaatattatgtagaaaaaaacctctgaaataatgaattcctatacttttatgggttctttttttattttgatatttgacccatctggaatttattttggtataagaatgaggtagattttcaacaatttattccactaaatcataaattagtacaccttttttccataaatggctaaatagtaaatattttagacttcatggatgatacagtcttggggcagctactcaactctggccttgggcgaaaaagcagccacagacagcacaaaaaccaatgggcataactgtgatccggtaaagctggtgtagacacacaggcagcaggaggatttgaccctcagattgtagtttgctcacccttggtgcagaagattacttaattattctaacaaaattgatttagtaaataattttccccattgatatgtcttggttcctttataatacacaacattattttttataggtaggtcttgtacaaaactctccatttgattttattgttctgtctttctattcataggctgggtatgacactaatttggttactatagctttatgtatatttttaacattggatgaggtcagttgctcctcaaaactcttatttttcagaattttgtgcaggaatatctgagtatttctaattagattagaatgtcagaatacattcatggacatatgagtttggggttttttaaaattttttttagatatccttcaccttgaacatttattatttctttgtgttgggaacaatccaaatctctcctagatgttttgaaatatacaatgtattgttaactgtagtcaccctactgtgctattgaatactagagcttgttccttctgtctaactgtatgattatactcattaaccaacttctcttcatctgccccccacctccacccatctcagcctctagtaactaccattttactctctacctccatgacattaacttttttagctcccatatatgagtgagaacatgcaatattttgtctttctgtgcctggcttatttcacttaacataatgacatccagttccattcatgttgatgcatataacagatttcattctttttatggctgaatagtaatccattgtatgtatatacacatataacgtctgtatatataatgtgtatataaaatgtatatccataatatatgtatatatacacatatatgtaatatatattgtgtgtgtgtgtgtgtgtgtgtgtatatatatatatatatatatatatatatatatatatctcacttttttttttgagacagagtcttgctgtgttgcccaggctggagtgcagtggtgcaatctcagctaactgcaacctccacctctcggttcaagggattctcatgcctcagtctcccaaaaagctgggactacagtcatgtgccaccatatccggctaatttttgcattttttagtagagacagggttttgccatgttggtcaggctggtcttgaactcctgacctcaggtgatctgcctgccttggcctcccaaagtgctgggattacaggtgtgagccaccgcatctggcctcacattttctttatccattcatccattgatggacatttaggttgcttccatatcttggctgttgtgaatagtgctgcagtaaacatgggagtacaggtatcattttgatatactgaattcctttcctttgggtaaatatgtcatggtgggtttgctacatgatatgatagttctacttttagttttttgagaaacctccgaactattttctacagtggttgtactaatttacattaccaccagcaatgtataagagttcctttttcctttttccacatcctcactgacatttattactttctgtctttttgataatatccatccttactgagggaaagagggtatctcactgtggtttcaatttgcatttccctgatgattcgtggtgttgaacttttttttttttcagatacctgctagccaattgtatgtattcttttaagacatatctgttcattcctttgccctctttttagtgcttttacatatttggcttttgtttttttgttttcgttttcattttgctgttatgttgttcctggatatacaaggaactcaaactatagtcctttgtcagatgaatagtttgtaaagattttctcccattcctcagattgtctcttcactatgttgattgtttcctttgatgtgctgttagtttttagtttaatatggtcccatttgtctagttttgttttttgttgcttttgaggtcttagccacaagatcttcgcccagaccaacatcctgaagtgttttccctcttttcttctgtagctttatagtttcaggtcctaaatttaagtcttcaatccattttggtttaatttttgtaggtggtgagagattggggtctagcttcattcttctacatatggatgtccagttttctcagcaccatttattgaagagaccatcctttcctcaatgtatgttttcagtgcctttgtcaaaaatcaatcagctgtaaatacatgcatttatttctaggttctctattctgttccattggtctatacgtctgtttaaacaccaataccatgctgttttagttagtatagctttgtagtatattttgaagacaggtactgttatgcctccagttttgttttttgctcagtattactatgagctatttttaaaaaatacttccaaagaaaaaagtgcaaaagtttatattagcttactatagttttaataggttaaaattagtagcttctgagtaatgaagagagactgagcttaatttctcctgctttgaaagtacttctagggtctgggtgtggtggctcatgcctgtaatcccattgttttggaaggtcaagacaggaagattgcttgagccccagagttcaagaccagcctgggcaagatagcaagaccctgtctctaaatttttttttttaattaggcaagaatagtggtgtgtacctgtagtcccagctacttgggaagcttgagcccatgagtttgaggcaggagcacgctatgatcatgccattgcactctaatttaagcaacagagtaagtcctcatctttaaaaacaaacaaacaaaacaaagcaaaacaaaagaaagtacttctatttatttcttcacctgctaatttagcttgttcaagtgtagaagctggaggatgtttccctgcaatgacagagtagccaattttgtatctcctgattttttccttctctcattcttctttgctcaacagacactaaattgaggtttgtgtccttgtaaatagtagatttcatttaccctctgccacctttgtcaaaaaataattttaatttaaaaaatgatgtaaacttattttagcaaaattgaagactatagaaagctatgaaagtgaaaatttaaatcaccgtaacactgcactcagagataaccactgttaggacttttatttctttctttctcttctctatacacctgtaacatgcatgtacacctactgcatgcatatgtgtatgatacatgtgcaaacagtgcatgctaacattttctaccctgcttttccatgtgttatttttatcctgtgttccactattttggaaaccgtcagggttgacagagggaaattgatcaagccctttgtcttcattgatgtcaagagtttcagtcaacttggaggccgtggcctcctccttacaggcttcttcagcctttggtttgagtttgggttttttacttttcatttttggaggagccacgttctctctcctttcctattactggagagccgcttcctctcttcactcattcattgtgcagtgtgggggagtcaggacccagatgggaaagaaagcatcttgccacactcaaatctcatcttttttgccatgtttgccccatggcatttctctcagcatcttcttgtgctttttccaaaacatataaaggacaattctactctggaaagtcactgggatactgttctctgagaacaggtattgagaagaagatggtttcctcttggaacttggccaactggctcacagcgaacgtggtgtggactcttaccagctctctctagtatgctaagggcccccaaccagggaccctgaaggcatctcaagagagcagtgtccaggtctgcccttgttggaaggaggatgatgtgaggagatcacctttattaaagctgcaggttgtctgccagattttcaaatttcaatgtaactttttatttaaccaatgctgattaatagtagtggcattgttgaaatccattccccttcatttcattttctaatgaaatttcggatttctacacagacatggttttctggcataaaaagcttgcatttgcaacctgtcatattgggactgtgcagaacttttccatgttttaaaactcaggagaaagaagtaaagatggtaagagtgcacttgagcagaaacaaagggctgtgatcccaaaacaggggacaaatgagctgcaaaggagagacaccaagagcggagagcaagaggcaaagtgatatgaaagactccaaagtgctggttcagagaaaagaaaaaaaagggacataggtcaggaaaggggagaaggactgacatgaactggcaaatggcaacagatataaaaagccagctttctctggggagtggaaatgtttctaagcatttttgttcatgttagtatgatttgttttttcctaagtaagcttgaaaatcatagagtgaataggagaaaccaaagattagggaaaatatttttagaacaagctcagggaagtcatataggtttaaaatatatagtctatgcaaataatggcacacatttcagaatggaaacaaaaataagtggcagataatgtgtccaagtaatattggtagcaaatggactgttacgagagcaaatgatattttgcagagctgagagtgtgacctgtcttcaattatttgaatccctatcctacaaaagcattgaaaaaggaagatctggagccaatgactgtgtattacatatattttcattcagtacaagcagacatcatcagtgtgctatatactactttcattattattattatcttaattaaagctgtcttacgagccaggcgcagtggctcacgcctctaatcccaacactttgggagaccgaagcaggtggatcacttgaggtcaggagtttgagaccagcctggccaacatggtgaaaccctgtcgctactgaaaatacaaaaattagccaggcatggtggcaggtgcctgtaatcccagctacttgggaggctgagacaggagaattgcttgagactgggaagtggatgttgcagtgagccaagatctcactgctgcactccagccaggatgacagagtgagactctgtctcaaaaaaaaaaaaaaaaaaaaaaaaaagacaacaacaacgacaaaactgtctcatgatgaaatgggatgctttcactagccgtggttgctcatgcctgcaatcctagcactttaggaggctgaggcaggtgaatcacctgaggttaggagttcaaggccagcctggccaacatggtgaaaccctgtctctactgaaaatacaaaatttagccgggtgtgctggtgcatgcctgtaatcccagctactcaggaggctgagacaggagaattgcttgaacccgggaggcagaatttgcagcgagccgagattgtgccactgcactccagcctggacaacagagcagaacactgtctcaaaacaaaacagaacaaaaaaagaaaagggatgctttgtggaacagggagattacttgcactggaattgttcaagccaagttctatcaacatttgacacagaaacacatgaccatcgtaaggtctttcccagctcagcattctgtgactgcgtggtctttgtactgagttttacatgatatggatttcttaccttagaaggatcagtttttaaaagatgggctgaatgaatcaaatcagagaacactatttgcctacccaatatctagtctccacagctagctggggacactttatagccacgttaaaaaaacaacagcaaaaccccactgcatttctcaacttctgtagcagatggaggtggtcaagtgactaagttttagccaaagagatattagtgagaattgggagaaactttgagattccttaagaagggagacagaggatgctaacatggaacttgtcctttgccttcccattctcctttctgccatctggatcaggatatctggccatgctgaaatcatgagacaacatgaaggataaaatcctcaaactaagaatagaaatcagaacattaggacctggtctgagttcattgtggagcttccccagcccgctcaggctgcccccagtcttcccatttttagaaaaattaaaactatggtttgttaaagcttctattctgatggtctctgttacttgtagctgaacgcaatgaattgtgagatacgatttaccacaatttttttctttctttctttcttttttcttcttcttcattttttttttttttttaaaagggttgtgccatgtcacccaggctggagtgcaattgtgcgatcatgactgactgtggtgtcaacctcccaggctcaagcaatcctcccacctcagtctcctaagtagctgtgactataggcatgtgccaccatgccaggctaatttttgtattttttgtagagatggggtcttgctgtgttgcacaggctggtctcaaactcctggcctcaaacaaatcctctctcctcagcctcccaaagtgctgggattacgggtgtgacccagtgtgcccagcgctgtttactgaaatttttttttttatgattctgactatagctttaaacccaggctctgccatctccatgctgtttaacaagttctctgcccttcgtctgcctcaccagatgtattatgtataaaaaaaagtcacaacctagattgcagaatttcatgtaaatcgcttacaaaacaacacagatagaaggcagcaattggtgagtttgatctttggtgcccaaatacagctgtgctatttggtgtatacaaatgtcaccaaattcctgcacaaatttgcgggcgggataggggaagaaggaagggatgatgaaggcaatggacacaacagtctaaaaagttttaaaaaattgaatgtaggtaaaatagagctcagaattcctccaccatcatctgcatttgaatctggggagaagtcagccctcccaactttcacttcctactagaatagcaagacacactctgcctccagacagtgtggattatctgccacccgaactgaagtttcaatcactcaaatcctggtgtcatttacattgtttctactgggaaaggtcaggtgtctgcaggggctataagcaaagaaaaacccatcccctggaaccaccagtgtaaaggagagggaaggcgagtgacagcatgtgtcgatgctggatcattttcaggggtaacagaccactacatcctgaggctttttagcaaataggaagctgaaggacaaacatctgaaggagaaattaatctccgtgagtaggtgacaagctgcgataagcccttggggtgtgtgtcagtgtagcacagatgttagtgtgagaactattacttgattcaagggaaaggggagaagggcagggaggggggaaatgacaatgaaaaacaaaacagtgaaaaccacaatcatcttcaccaggcagctgatttttttaaaaaggcatatatccatcaaaggaacaaaacattaaaatacacccatatggcaaagacctggtgtaactggaattttcacctcctgattttgacagtgtaaatttgttcagcccttttgaagagcaatttggcaatgtgatttcagagccatagaaatatgcacatccatctttcaaatgtcccagctcttataaatgtatctttaaaaagactcaaaaataatttttttaatttatatgcctgaggtgtttatttcagcatctctacaacgagaaaaatgaaaaccgaaggtttgacatttgagacaatattaagtaaatcaatacatgctaatttaatgggatggtattaagtaaatctaagaccagcctggccaacatggtgaaaccctatctctactaaaaatacaaaaaattagccaggagtggtggcaggcacctgtaatcccagctactggggaggatgaagcaggagaatcgcttgatcctgggaggttgaggttgcagtgagccaagattgcaccactgcactccagcctgggtgacagagcgagatcctgtctcaaaaaaattaaataaatcaatatatggtaatctaatgggatgctatgcagcactaaaagtatattttaaaaaaaacttgagaaatgcttctaagatgaataatacacaattaagtcaattacctgacttcaaatattattataactgcatgtggacaagaagacaaaaccttcaaggaaaaaaagttttgatattatgagattatgggtaacattgtattcccagccttgaatttctgttattgttactataatatgtgtacaatttttttttagtgaagtaaaacaaacaagtaaaagaaaggttgaaacttcacaatgtagagatcaaccagcctgaacctctcattttacgggtgacaagttgaatacaaaacttcggtggaattgaacgggcttatttcagtggaaatagtgagaaatactcattttcccaagtgcctattagaggtgctgtcattttccaggagccaatagaaaaacacataaaagcagtgcattggtgtgatctgggctgtttctctgaaatcactcagctcgctttcaactgctgcgttccacaacacaatgtggttctacattaaccacattacatcataaagagatcattaaatgactccttatggaaagggagggaagaaatgatgtttagagaacctggtagtatcggaggcatcatcctccttctctgctgcctatctgtgtcgcactcactcttgaggttatgcaaagaaaatgttgacaatttaggtgccagctgttgtttgacgaatagcaaataaatgactgtgaagtcctttggaaaacagagcaaaaccaaattagtgattcccctcttctgcctcccaacatcttcacctccagggccttctttacactgactatatttcctctgatttcattgtcccaatgagacagtaatcctactgagagaacagatagggttcttggagactagaaattatgtttattgaatggttaaggcattgtttttttatcataagctataatttaaagttactaagaaaacaggccaggtctctgtaatgtagggaagcagagatcagattatcttctgggggatagtggaggagggttgtaaccaccccaagtccttgagtgaggatggaacctagggctcaacagcagaaccctaagaacggatatttttgcctaggcctaagaatgtcatcagcattttatttatttgtttgtttgtttattgagacaaggtctgcctctgtcacccaggctggagtgcagtggcgaagtcttggatcactgcaacctccacttccctggctcaagtgatcctcccacctcagcctcctgagtagctgggactacaggcacacaccaccacacctggatatagttttttttttagagatgaggccttctacattgcccagtttggtctcaaattcctgagatcaagcaatccccccaccttggctcctcaaagtgctgggattacaggtgcgagccaccgtgcccagcctcatcagcatttttagacagctacccctctgtggtactctgtggtgagaaataagtttaagagataagtatgcagttatgaggaaaggtgatagaaccacaccatttttatgaataatatactaaaatatattcttaaaaaacttgtcagttgtatatttgataatagcatatttttacttagtccttattaaagatctcgggaaattcaaatctgtttcatctttgatcaggagagaagatgttgcccatccttagcccagagttagaaaggagaaatcatgtgattggccaaggtggtgatgagagtctcttcagaagggaagacttccagttgcaaggtcaggtgacccaatcaactgcctttgaacatctggaaaaatcttctaaaactcttccttctcaagaagtcctgcaactggagctactaatgaaagctctttccagtagcccttacagctaattttctgttcacatatttgtcttctgctgtaaagagctgtgcctcatagtgtattaagggctggcttttcctttcattgtaagggactttccaccacaaacacaaggccaccatggccagcaatgcacaaaacagcagagtatggtcggcccttaaagacaaggtttgacttactcctctcttctcttttttacagacatgtttctctactataaacttcactcttagctttattttcaagaataaaatatttctgttttcaaattggcatcttacgattcagcagactaacccaagaaataattttatggaataatcatatttcaatatcttatttcttttcaaaggaacatttaaaagcttataaaactaggtataacaatgaagctgtaaaagaaagtaagaaaacacaatcaaagttaaaatgaaccaagctaaaaggtaaatataattattggtgttaggctccatatttgcctacaggcttcctaatattcagagcaaaatggaaaacaaactgttatcctagctcaggtcacagatcgctctggccattcccttttatctgccctgtgtgctttcttgggctcttcttctgttaacaggactctttttttctttggggaggttcttctccaccctctgcctagggctgtcaatcaatgtgccccatcttctacccttctgcataggacccccattcccttgacatggtgattttccagaggatgggtacctaggtacctggccaataagagttcgagatcaataagagtcttcccagaggttaatacatatgctttggaatggagtttattgcccactaaagatgctaagctggaaaaatataaattggggctatccattggctaaattccctgccctgaggagcaggcctgtctccagtgggaggaagaaaactgaacagaggagaattgcaaatggagagagagcaagccctgtgtactgagttctggcttctgtccctgaggccctgaaacctggctgctgcagcttttgattctgaccatgatccaagagtccttccaagcagtgagagcaagtaaattccattctttgattagcaagtctgagtagaactctgccacttaaaacaaaaaaagtccaaattaatacatctttcattattggaaaggaatcagaatatcagtttaacaaggagcccattttattttctaaaattaattttgaaagaattttctcacatgggacttaatagcgcatattgactgatgtaatggacaatgccctcaaccacatttttacagtaaatgcagaagcgaatttcatctgatggtttctagtataaaccttgaataaaagccaagggcataacattaaagcaaaattgagttaaagccattttggaagaattagcccagtgcacatagagtgttcaacatttgagtggctcaattcacccaagaaagcttcaagaagttgaaggacactttttaactttgacagctttcttcatgtgttcctttgtttccccatttacccaaacttctgataaaggttgaataacaagtattttgagattctaattttcaaccagagctaacattttccactactaagtgagaaagggatctaaatgcttcagagactgggggaaattagaggagagcaaagttatgctacttgtatctaaatataagaccacttgtctctgcacagaattgacccctgtgggacctttggggatacctgcaagatatgcaggctgtttttttctatcaataaaccttggattttcaacaacacaaaaacacatcatcaattagatccccagagtcatgaaccaaaacagttttcacatgaaatttattcaaagtaaggatttgtagttacctgttgtgatatgggaaaaccacacagcagcttggcttccagtgtgctttccagagtgaattagttttaaagtgtttattttctttattccctcctccccaatttcacccagtatctgaaccaatgtatccatcaaagtagtgtaatcagagagtctgcctagaaatgtattttagttaatcatggctaataccaagcccttctttctcccagaaatcaggatgatgtccctcttggaattacttttgatttgtgactggttttgatcatgattacacttccagtacctggcgtaatacctagaacaaactcccagtaaatatttgccaaactaatgatagaatcagatttatattttgaaatgagcactctgaatatattctagaaattgtattggatgaacacaaaagtagagtgggaatgcagatgaaaggctctgtgcccacccagaggagggccgcttgtggcttaattcaggcagcaataatgggaactgagagaattgagctggtttgagagatatttaggaggtcagttggtgttatgaaaagataagggagaaagaaggaacaaggccagctagacatgttgtggggcccagtgggaaatgaaaatgctgagtctctcattaaaaaatcattaggaatttcaagagggtaatagtagagcaccaaactgtgcattgtacaggacttttactcataaagccagctctaagaataaaacatcctatattcattatgcccggggcgcttccatttactcactgagtgcctaccatgacagccactgtggtaggtacttaattctacctaaaagcaataatacaggattaggatagaagcccaaatgaagaagaaaccaaacatagctccaatttatagcacctaagagcattttcacctgtaaggaattttttctatttttacaggaaagatcaagggatttgccctgattcttggagtacttaagtgcaaattttgaagcatttcaattgttgaaaacatatcttttttttatatactttaagttttagggtacatgtgcacaacgtgcaggttagttacatatttatacatgtgccatgttggtgtgcttcacccagtaactcgtcatttaatattaggtatatctccaaatgctatccctcccccgtcccccaaccccacaacaggccccagagtgtgttgttccccttcctgtatccatgtgttctcattgttcaattcccacctatgagtgagaaaatgcggtgtttggctttttgtccttgtgatagtttgctgagaatgatggtttccagtttcatccatgtccctacaaaggacatgaactcatcattttttttggctgcatagtattccatggtgtatatgtgccacattttcttaatccggtctatcattgttggacatttgggttggttccaagtctttgctattgtgaatagtgccgcaataaacatatctttttttaaaacttagcatatatctatttgccatctcctgggtcaaaaagccaatggaaagctcaatgaaatctccaaatattcttaggttcaccttgacagatttttttctgaagagcaaaagagactataaaaaaacacttatcaaacatgagagattatgccttaaaaccacttaactcttatttaagatactactctgaaatatgtagatctgaaaacagggaagattaaaactcattttgctaatgagggcttagcccttgaggactccctgggtaaaattgtattatgggcattatctgggtccacactctgccctcaataacaagagaataaaactctcctctggtcataggtggagaattagcagcaccttgacattttgaaagaactagtctatcaaaatatataacagggttgtgacaaaagaatgaatggaaaaatcctctggtaggggtaattgcatatgattgatataacaaattatgattcagcatttactgagctcctacaggatgccatccattgtgtcagatccttctgcatgtgcactgagttaaattctcactgtaagattgacatagaccttatcactgaagatattaacaaatcctatcagttgagggaaattcaggttatgagaggtaaagtggtttatccagggttgtgtagctggttattggcagagccagaacttgaagctcgatcaactccacctataggtcaatactgtcctaagatttctggatacaagtttctgtattttcaaggacttcgttcatgggatttccccgtatcatgaatacctctctcttctgaatcatccctaatgcttgtagacatgttccaatatccctcaccttcaaaaacaaaaagaagatgaaacaaaaccttcttccttactgcactgctgttctcatttgctctgctccctttcacagacctacttcttaaaaaggcatttgtcatcaccatctccactttctcacccaaatttatttattacctttttgcttctatctccacattgccaaattcagtcacttttctgttcttattttattatgtctctggcagtatccaacaaagttggccattctctcctgcttgaaatactttttttaataatatattttgtcatctataacaccatatatcctcggtcttcctcttacaatccttttcggttttcctcttaccatctcctcgtagattcttcttctggaatacttttgccagttcttctgtctttgcttaacgaataaatgtagagtgtttctggaaatctttttctatatgctctttttaggtgacccctccagttgcttggccacctgtgtgagccatgtatctatgactctcaagcatagtctctcccctggacttcagacttgaccacccaacacccaaccaccaccttgaaatccccacttggatgtccagaagatttctcaaacttcacactaataaaacagagtcctagatttctctcctccaatcctggtccacctcccctgtgcttctacatctcagtaaacattaccactctccacttaagaaccttaagacagaaatctgaattattcctttttacttcctcatcaccatactaactcaatcagtatgccctattgcctctacctgtgaaacatctaagtccgttcactttttaaaacattttttaagttttttgttaatgcataataaatgtccatagttttggggtacatgtgataatttaagacattcatctaatttgtaaagataaagtcagtgtacttgggatatccatcaccttttaaaagtatttgtctttttataagctagaaacattcaaattattcttttccagctatgttgaaatgtacaatagattattgtaaactatagtcaccctactgatccatgtaacgctagatcttatttcttctatcaaactgtatatttgtacccgttagtcaacttctcttcatggtcacttttatacatatccatttctttcacccaagttaaagttactatcctatcctgcccgggctacacatggtctcctaacttcaacctcattggtctctttcgatttcttaaatataccaagcagattctttccagcttggtgcctccaaggtaactgtttcctctacctggaacactcttcccttgatccttgcatgatttgctttgtcttgtcattccatgaaaataacttttactctgaaaagccttagccaagcccctaaagtagccccacagtcacatccactctcctgagcacttgttaccatctgattatgtttgttggcttgttcgtttgctgactgtttggaatataagcttcacgagggcagctgtgtaccctgttcaatgggacatcctcaacacggaggcagggcctggtacagcacagtcctcaataaatacttgataacaaaataaataatttatgttgcattttggaataataattatattcttagttacacattagctgtatctagaagactgataatactgggggaccaaattaccttttaaaattatatttaagcctactaaacaacaacttctgagttaacaatattaagacaaataaagaatgacatggctcacaattataaatcagctatggttaaagatactcttaaatagtaaaaaataatcaagaaaatgttatggatttggcctctcaaattatgaccctgttgaactatacaaaatataaacaaagaacaatatctgaaacattattgaaatttactttataactgaaagttagtataagcagttaaaactgaaagtaaatatagacaaaataattgaacatatttgacaaaatatagacatctaaaagtgaaaagcattttaaaagtgagaaaactcctagagagtttgaactattatatggtattttcacctttagattatgaatagcatgaatgagatgataacaatggtaataacaataaattcactataagttcttagaatttagaagataccattctagaagctttccatgaattatctcattaactattactgcagtcttatgaagtgagtattatgatcatttctaatcttatgcatgacaattgagatttaaagagtataactttccaaggtgacaaatttagcaggtgtcagaatccagttctgtcagaagaaataagtagaaaataaaggtgggtttgttggcgactagataatcataataaacattgatataatcgtttataatttttcataaccgtagaaattatacaacctgtgtaaagccaaaatactttggtgatttctgggttcagaagataatgccttttgtagctatggagcttagatcttgtagctatatgtgtttgactgagggaagtggaaattctctaactgggatatcataccaggatgatgaattacctgtgcaaactctcactattgcaaggtcctatctacctggaaatataagattaaggtttgcaaatccacttgggtaagtgtgtctcaagattttaacctatttacttataataattttcgtatttgccacctaagttttatacacaagactaccaaggaatagacataagttgcaagtggtcacagcttgacctgaaaacctatatcagtaaaccagtggagctctccttagaacagtaaggaaaagaagtgtaagatatgacttcagctgatacagtcagcaaatacttcttggatctatctgtcccatacactggtccaggccctggaaattgagcagaggtcaaataacccacttccctcatgaaacttacattgatggaatgaactactttttatatatttaaaataaaaataatatgaaaacttgaggtaatgaatgctgggcacagtggctcacacctgtaatctcagcactttggaagactgaggcaggaggatcatttgaggccgggagtttgagatcagcctgggcaatgtagcaagatttcgtccctactaaaaaaaaaaaaaaaaattagatgggcatggtggcacatgcctgtagtcacagctactcaggaggctgaggtggaaggattccttgagcccaggattggaggctgcagtgagctatgatggcattactgcattccagccttggtgatagagcaagaccctgtctctaaaagacaacaacaaaaacttcaggtaaaagtaaacctttctttcctttcatgtcagagaccacatattgcaatgagagtgaaatcacatgaaacttataaataaaactgcccttctatcagaatgaaagaaaggacaggaacaggtcaacttggttattttctctctagacccgtcattgagggtagccaccagagggctacctagccatacctaggtcacatacctaagtaacctgatacaaaactttctcctacctcctcctttttcccacctgtgaacctaacaccctgaaatttagcatctagaagtatctaaatgaagacagacatataatttttgcccctgagctcccacccttttggactggaattggacatatctctggagccacaaatcagagtcacatagatgtgactgccagcttttgtgacttggactcagtatctttttactgcgccaccttacgtttcactcagacaccatctggtgatggattggtccgtcatgcggtatcagtctgcagaatcatcttcagtactttaaggacagtgcagactagaggaaagattccaggttagatgtcagctatttgccaattagatgacctgggtatgtaatgagaatgcatagccccacttcgtctggtaaattgggactgtaattcttactttgtcttagcccacaggatgatatgtatagaaagtgagttataaactgtaaatgaagctgggcacagtggctcacacttgtaatcccagcattttgggaggccaaggagggaggatcacttgagcccaggagtttaagatcagactaggcaacatagggagaacttgtctctagaataaaatagaaaaacatagccaggagtggtggtatgtacctatagtctcagcaacttgggaagctgagctgggaagatagcttgaggggaggagttcaaggctgcagtgagttgtgattgcaccactacactccagcccgggtgacagagcaagaccctgtctcaaaagacaataatattataaataaataaataaacaaactgtaaatggtacaaatataaaagagcaatactaacgacaaataataatacatataatgaatgcattgataatgacagtgaaagttagaagtgattcttttagcacagagataagagattagctcatggctcaggccaggcctcacagattatctgtctcctggtgggactaatgcaagatctgaagtttggtctgtaactttgtcattttggtttgttctatggaccaaactctggagtactgattaacatcattgtctagcagttgaaagctctctgataaccttggggagtgctagatagaatagatacaattttgccttttgattttcctttgcccaaacaagtggttcacatatgaagatgtcttttggaagggaaaaataaaaattacagattcccatgtaatagggaaactgagtcttaaaatccaacaccaccatcttatttctaagtcgtttttacattagggcttgttataaacctaggttattttgttttgcctacgtgtaaatcttgatggattcaaaaattccccaagtaacttagtgagatttcaaaaagatccttgattttagcagcgtttttataaaactgtcagttacagtagataacaatagcaattctattctcctccattttaaactggaatttactgattcaaatttttaagagaaaaagttcctgaacttgtccccttattctaggggaaaccattttggtgcctgtctatagctacttatggcctctctctcttgttttttgagacggagtctcgctctgtcacccaggctggagtgcggtggcaagatctctgctcactgcaagctccgcctcccaggtgcatgccattctcctgcctcagcctcccgagtagctgggactacaggcgcccgtcaccatgcccggctaatttttttttttctctatttttagtagagacagggtttcaccatgttagccaggatcgtctcggtctcctgactcgtgatccacccgccttggcctcccaaagtgctgggattacaggcgtgagccaccgcgcctggctggcctctcttttttgaatgaggtaaaaaagaagcttgagaggcaaaacaaccaacagcaaataaccctagtgtattcattcattctcacactgccataaagaaatcctggagactgggtaatttataaataaaagaggtttaaatggctcatggttctgcaggctgtataggaagtacagtggcgtctgcttggtttctggggaggcctagggaaatttacaatcatggcggaaggcaaaggaggagaaggcacgtcttacatggtaggaacagaagcaagaaagagagccaggaggtgctacacacttttacaagaatttactcaccgtcacaacagtaccaagggggatggtgttaaaccagtcaagagaaaccacccctatgatccatcacctcccaccaggccccatcttcaacactgggaattacaatagaacatgggatttcggtggggacacagatccaagccatatcacctagtaatcatcctcaccttcagttaaagcagcctgtgtgtttactgaagaaattagctacttgacaccaatcttttcagcaatactgctgtcagataagagaatcattgagtaaaatgccattaattgcaaataataaaacgtcattcattcaaatcacgtaatgagaagtttgaattctgtctccaaaaccaacccttacttttgtttatttatttttacctagtacccagggcatgattctgtctatgctgtcataggtctttagattttagttgccattagcaggcattttcattcaatttatttatttatttagagacagagtctcactctgttgctcaggctggaatgccgtggtgcagtcatggctcactgcagcctcaaactactggcctcaagcaatcctcctgcctcagcctcccaaatctgtggaactgcatgcatgtgccaccacatctggccctggaatatgattttataagaaagctgtctctctattaaagttttatgcaaagaggaaaactaaatcagtggacagagctaagagttagacgacccagactttcctccctccgttgcctctgtttctgtctttgcaaaataaggaaatttgactagcttatctttaaaacctctacttgctcattctatgatggtgccttgagatggagattcagtgagagattcttgtttcagtgcttttatatatttaacaaattttcaccgagtacctattacgtgtcaggacctgctctaggaaatgtggatacaacaatggacaaaacggacaaacctatgtcctcatgtagtttacattctaaggcctataaagtattgtctatttgaacacataaaatgtattctcccagtttgggcagaaacaggacttctgcaaggcctggagaagtaaggaagactgaagcaaatggaatccatggcactttccaattttgtactttctctttctgtctctccttactttcatttcttgacctactcctagacccatgcagataccaaattttacaaattttactaccagcaaatagttatctattatgcagttaaactgtgctatgtgtagggatgcagagcaaatcaagacatagcatatgccttcaagaagccaatgatgtccttgtgagaacaaaactcacatatgtaaaaaaaaattgctagttcaaaatgtcagaggctgagaaccaggaatatggcctgaacagttgtgtgctctatcaggagagattcactaaaagttagtagacttcaggaataattttcagtgcacataaagcttgaacttaagtaacataggtagttttcagattttaaaagcaattttcagtaaatacaagtagagatatggcctgcaaaataagagtaggatatagcaagacacatttcttattcttctgacaaggtagtacacagttcatcactttattgacaagatttattgatgtgactattgtgatgtcatcaacaatggctttgaagttcagaacatgagaaagagctaatggtagggactgacttgaaagcctttgcattctaagaatgatgattaggtttctaatgtattattaaataatgtccagcccacaaaaaagatgaagtctgcaaaggtatacacaataactctgtgccttgctatggtcctatctgatctcaaacaagaagctctttgggttgtgttgctggtggttggatgtgttctgagccatagctaggcttatgcacataacaaagtctgattcccaggaatctttttaggaaacacctcccagattaagtaatatttacctacttgtcctctttgaacagtgctcctactgattctttaccctaatgaagttcatgtcccaacccacacccttttcctaaaacaattaagcttttagtggtgacatgatgaaaaagaaaaaaaaaaaatagatgcaatggctgacttttggaaagttcccagcaaaaaaaaatcccggtggctttctgagtctcagcatgtttcttcttagttctgtgtacactgagataaaagtagagtgggagactgagtttaccacctgtgctaaagcagcagctgttagcattggtgacattcattgttacatggatatcaattgagctgggattaggaagccgcctgtctcctcaagcttgttacgattcagtcacttggaaaaaaacaaaaacagactttcggatgaggattctaatgcccaggtgacctgaaagccaggttcagcgtagtcaatgagcaacatgaaatgaaatttccaatcagaattctcattagccttattcagcactacccagatggatgttccttttgatgtctttgtcatagcagcctcacctatgcaaatattgccagtattaccccttatagtaagttgaagaacttttaagggttgtgaactttacataggtaagtgaatcaagtatacttgaagagcctctctgttgacataagtaattagattattggacaaagatctgatctagtaattttcttagtatgtatgtgtgccaaagccaagagaggatatgttattaattagcaagcaaaatttctaacgtaggggttttcccacatcttaagtaaaattctcgaaacctggaactatggctggctctctggaggtgtttcataaatgcttgctgaattaatgaatgtatccacaggcatcttttaagtggctacaatgacattaagaagaaataaggtcacagagtgtagttgccgcctcaggctctgggaaggatgggtctggaaacaaccccacagtagaccatacacattgtttttgagactttcagctcatccatttggttactgattacaagacggtttttttttttcgtctcaaaaaatgctttatttctcagaatcccatttcagcattattggtttttccctcaccaattctattttcagctttctgccttttctcataatgacctgtaggtgataaattagtaataataaaaatcaataaaaaatgataaagttttttttgggggggaaataggaatgagtttcatgttaagaaaagaaggaacgttccagatggaattttctgtaatgttaaatgtacccatatggcttctgggaaatttaggggcatccttttgtattagggtaacctaatgccacctgctttaaaaattcatattaggaaatagccacattttgaccttcttgaacgatgttcctttatcaatcaaaaatataaagggtgttttatttattagtcattgttgaaatccgtaatctctttctatcgccaaattgtcttaaaacgtctgtccagcacatcattgcaaccttgactgtcccttccactgtgtgttgaagagtcacaggtcccagggggagctgcgaagaaacgtaaaccaaataccatttcagtaactgttaagggacaattgtgacgattttgtaatgcttggcatgttttgcttataatcttgtcctacaaagaagcctatcagcagagatgagagatttttgctatgcaaagattagattaatattgatatttgcagaactgggttcaacctgtgggagacctagtcgcaggtcttgtagaatttatagcatattaagaagatatttaaatatttggcttcagtgtgatggcctcatttctacatacctttctaatatgtgccaactctctcttcttcatttcacttgtccgctgaaagatgagtcatcaagtctggttgaacctatctaatatctcttgaatcagtatgtctctgcatctgtattgccatcaccctagttctggccatcctcactgaccacctgactttctgcctaaatggtctcctactttctggtcttgtatactttcaaccctttctctgcaatcagagtgatattgcttccaatgttgtacagacaattcttacaaggtcctgcagcttttctttcagtctttctttctttttttttttttttttttgaaatggagtctcactctgtcacccaggttggagtgcagtggcgcgatctcagctcactgcaacctctgcctcccaggtttaaacgattttcgttcctcagccttccaataactggggttacaggtgcatgccaccatgcccagccaatttttgtatttttagtagaaagagggtttcaccatgttggccaaactggtctcaaactcctgacttcaagtgatctgtccaccttggcctcccaaagtgctgggattacaggcgtgagccactacacccagctctttcagtcttactgttcgtcatttttttccctcccctttctgcaccctcttcactctgctttcccattctctatgcctgggctacatcttaaaagacgccatgttctcctggggtctctggtgtccctgattctggaaatgctttcctgtctcttctctctaacccatttcacttagataagtcctatttatccttgagatttctcataggtggcagtctttttcccataagacttttcctgttctagacctggtggctcacacctgtgatcctagcactttgggaggcacagccagggcgaatgaacccaggtgtttgataccaacctgggcaacatagtgagactccatctctacaaaaaataaacaaccaggcgtggtgatgagcacctgtagtccaggcatggtggtgagcacctttagtcccagctactcaggagcctgaggtgggaggattgcttgagcctgggaggtcaagacttcagtgagccgtgatcatgccactgcattccagcctgggcaacagagcgagaccctgtcttaaaaaaaaaaaaaaaaagaagaagaagaagaaaagaaaaactttccctgatatatttaggttgagactagacaccctcttatctgctcccacaatgcccacgtcctccatcactgtactgaccatactctggtaattggctgtttatctgtccaatgccttccctagaccagaagctcctaaaggacagagcctgtattcccattcgtagtaccagcgttcagcacagtagctggacctgactaagcaccaagtaaatatttgttgaattaagaaaattaaaaaaaaagtgagaagtcaacagtctcttaatcaattgtaaagaaacactttactaggatgttctgacagctactccaaagtatcaaatattttaagtgaaattgtgatgtctggtgacattttttcaatattttagatttcttacacacaacttattttattttcatccactgaagctctcaagcatcttgttaaaataaaataaattagcttggtttctgtatgtgtgtgtgtgtccttttttggggggaggggggctggtggcaggacagggtctcactttgttgcccaggctggagtgcagtggcaggatcatggctcactgcagcctctacctcctgggctcaagtaatcctcccacctcagcctccctaatagctgggattacaggcatgcaccaccatgctcaggtagggttttttaaatttttcatagagacaggttcttgtcatgttgcccagtctggaatatatatatttttttgacttttattttaggttcagtgatacaagtgctggtttgttatatagataaactcatgtcacggggatctgttgtgcagattgttttgtcactcaggtactaagcccagtacccaatacttactttttcttttcctctctccaccctgaccctccacgcccagatagacaccagggtctgctgttcttgtccttgtgtccatgtgttctcatcatgtagctcccacttaaaagtgagaatatgtggtatttggttttccattcctgtgctagttcactgagaatgatggcctctaactccatccatgttcctagaaaggacatgatctcgttcttttttatggctgcatagtattccatgctgtatatgtaccatattttctttatccagtccaccactgatgggcatttaggttgattcctatatattttttaattgacaaaaataataacccacagaatcactaagtaggggaaagatcagctgctgatattttggatgtacttttctcgagtccaaaggataattcagtcaacttaaaatagttatttaaaaatgtgaacagaatttgtggatgttgagacagattcacagatccttaggaaatattaaaacttttgaaaaatggccacaggctctgaaggaaaagagcagttgggcacttaatgccacaagttactcttataaatcattatgctaatgatagaactgaggtggttcatttgggaaaaaaattgaaataacatttaggaaaagctgagaggctggcgatcaccattatgaagagagcagcctgcactatgattagatgccaccaataaggggaccatatataactgaaggatgactttaggagtcattgtaaacctgtcttctgacagcagcttgagacaggaattgcattcttcctctaaatccttttaatttagtaaagccctttattgaaacatttacaagcaaatgtaaacttttaaggattcttacatcccataaaagcagtaattttggcatatagctcatcaacatgaaatgagtaaaaacatgggaaggcagtactttttgaatgttgtatgccatttggcaaatctacatgttcctcccttttttcgcatctccatgttcctcctaaatgaaggagttgttgttgatgttggtttactttaatatgtccaattataccattatcatctatttatcaaaatagtgccatttaattgccttttgctttaagctgtattttatatgaaagattcctagtgttatttctgtcctttggaatattatccagcagagggaattttaggatctacttgataatacagatttgctaatttccacgttagtacttcagtgttgtttagttacacagtttcgggcctcatgatgtgtttgatgatttgggagtgataaaatgagtcttaagtaaaaatcttttaattaaaacaaacaaaggatcagtttttatgggaaaccagtcagtcagcaagtacatgtgttttaagtccagaaggatgctcaagtggaggggtagagagagagagcccttgggatccagggattgtagagtaactgctcccattatgccaggcctagcagggctgtcccactgtctctgccctcacactgaccacttcattactggttgtttttactgagcatcttttcagagatttctgagaacatggtaattttcccagaccatacacctgagagatcaggtactatgttgcctttaaaaacaacaacaacaacaacaaaaacctttatatttttcctctttttatggtgaaatatggcatactttattatttggagaaagacagaaaacatggtttttttctcccacaggccacaaaataccatcttcctcttacagggaatgagacttttgtataaagaggcacaatttcctgtcccactaggagaaaattattctcttgtctgagtctcaacagaagcttgtgttagttgctgttataaattaaactactactcaacccagcagtcccattactgggtatatatccaaaggaatataactgttctaccataaaaacacacgcatgcttatgttcattgcagcactgttcacaatctaaaagacatgaaatcaacctaaatgcccatcaacagtaaacaggataaagaaaatgtggtacatatataccatggaatactatgcagccataaaaagaacaaatttatgtcctttacaggaacatggatggagctggaggccattatccttagcaaactaatgcaggaacagaaaaccaaatactgcatgttctcacttacaaatgggagctaaatgacgagaatacatggacacatagaggcaaacaagagacactggggcctattgagggtggagggtgggaggagggagaggatcagaaaaaataactgttgggtactaggcttagtacctggatgatgaagtggtctgtacaacaaacccccatggcacaagtttacctatataacaaacctgcacatgtacccatgaacctaaaataaaagtttaaataaataaataaacttggtctccagtgttaaatatgatatgtcatcatcctcatttccttcatccagctattttatattcctcccatctgctctgtcctaatatttatattctgtaggccttatcgtgcatctcttattccttctaaatatgttttactctgcctggttcctccactcttttggctcttgttttcctacttcctttaatgtaacagtaacacagtgagcacttaatagcagtctagaataaactctgtgttcctgctttaatctatatctggtctttatctctcacctttatctttacctctgtcactgtgtggacttacactgaaaacagaactataccatgcccccatctccatgctgagtagctggtttataaatcaggagagacaatgctctttagatattcttaaatttgttataattctttcctgttatccagctcctcaacctcccttcccagctctgtctaccactttgtatcacttaagccacgttttatctacgtcttctctgtcactaacctttagtcccttgaaacaggcacaaccaaacaggactgacattttgcaagtcccttgagattttgcctaatccttcacagcaacctacaaagtcaatctggggctggtggaaattctcctctttcagccttttccttcttttggaatttgggggtgttttcacagagtgatttaccaagaaaacattctaaatcctcaaggatcacttatcccttacctcgtggttgtttgctcgagaccaagcacaactggacatttttgaacttacgtctttctccctaccctctttgttctccttctcccccttcataaaatctgacttcagtttggccttcaagtgagattgacttttagccccttccatttggcaaatccttcaacaaaaaaacagaagtgtcatttttacggggtgacaaagcattaagaagatcgctttttcagccttgctgtgcttcattataggtaagtcctcatgtggcaccttttacaagaggaagtattgtcatgctaacaaaatggtttcagatagtatgaaatcagtggtgagaagaatggctataaggaatgggctctacaattactgtcactctcagcaaaagagaacgcaaggaatgcatatttcatctcatggcgacctgaggatcgtcctcaattccatatgtaatactttctaaataatggtgacctttttcacgtccccttcctgtatatacaaagtactatgtggataatgcagcctgagtgagcttatgagctaatgcagggatttttattattaacaataatcatagtgaacaacagtttattcatgtaagatcaagcaactagtaagtggtagaaccaggactgggtcatagggtaggtacatgtgtaccacttttaaatattgccaaactactttgcaaagtattgaattattttacattcccaacagcagtgtctgggaattacaataatccttatcatgcaatgactggcgtattcattctttttaatttttgacattctaatctgtgtgtagtgccatctcattgtagtttgaatttgcatttcgctagtgactaatgatattgagcatcttttcatgagcttatttgcatatgtatgtcttctttgctaaagtgtctatgcaaatcttttgcccatttattaggttgtttgttttcttatattgagttataactttttttttttttacatattctgcaaacatttttaaccagatatgtagtttacaagtgtgttttcccagtctgtttcttacctttacattcccttaccagtatcttttgcaggaaagatgttaaatctgttgaagtgtagtttatcaagttttttctttggattgtgcttttggtcttgtagctaagaaaactttgcccaaacaagataacaaggattttctcctatttttttctaggcatgttatggttttaggttttacctttatgtctatgatccattttacattaatttttatatatggtgcaagttatggatcaaagtttagttacatgtggatatccaagcatcctaagcatcttttgcccaaaagataatcttttttatactgagttacctttgctgctttgttaaaaataaattgactatgtgtaagtctatttctggtatctctattctgttctattgatctatatatacttatccttaaaccagtaacacgctgtcatcatgactttagctttataataaatcttgaagtctggtaaattaagtcccccaatgtttttctttttagacattttttttggctactgcaggttctgtgtattttcagaggacttttaaaatcaacctgtcaatttctaataccaaaataaagttctttagaattttgattgggattctcacgaatgtgaagatcaacttggagaaagctaacaacttaatattgagtcttatctctcaacttattttggttctttaaaacttctttcaacaattgtttttcacatagagatcttgtatatattttgtcagagttcgcccaaatggtacatttatttatctatttatttagagatggagttttgttcttgttgcccaggctggaatgcaatagcacaatctcagctcactgcaacctccacctcccaggctgaagcgattctcctgcctcagcctcccaagtagctgggattacaggtgccagccaccacacccggttcattttgtatttttaatagcaatggggtttcactatgttggttaggctagtgttgaactcctgacctcaggtggtccacctccctcggcctcccaaagtactgggattacaggcatgagccactgtgcctggcccaaatagtacatatttttgatgctattattaatgacattgttttattaatttatatttcaagttgtttatttctattacagagctttctctactatgctgacatccatctgaggtctcttctcaacagaattgcctttaatgtccacatttctaccaagcttctcttcaaggaaatctatattttttctattactcaccttaaaattcttgtagcctctatccatttcccaattccgaagccatttctacatctttaggtgtttgttagaggagtaccccactttctcgcatcaaagtctgtatcagtcagtgtttgacagagaacagaaccaataggagatggataaataggtaggtaggcagattagtaggtagatagatagataggtagatagatacatagatagataatctatagatatctaatgcctggaaagctaatttttctatatattttctctattattttagttgtttcagatagaaggacaaattggatccctgttactctatcttgaccagagtgaaaatctgattaacttttaatcctcagtctcctcatttgtaaaatgaaaataataataaaatctatttcatgaggttattgggatgttagttttgttaatatgtataaaaacttggtgccttgtacataataaatactcaataaatgtatttaaattttgaacaacatatttgacatattgtgatttccaagtatctatactcttttatgtttgttaatgttatatatggaggcaatctgacttaacatcaaaaaaaaaaaaaagaccattcataagatgtagtcagtaccagtaaatgagagcacattttcctctaattgggtgtgtggatattggttttcaccctacttggagtttctgactatttgtcctagtgaccatcactatattcatttataatattattaaaatcaatggatgagtcattggttaccatgtgtattccggttctgaaacacaccctcctcttccccagccagcactcacctcagtgatacccagtctattgcaggttttttatgcattttctaaattacatgaaagcaagttgacattctttctttgtcttagtcttccataccattattttggcatgtttaaagtatcatccatctgattatgtttggaaataaaagcatgaatttgttaaagacatgtaccttccaaactgcacacttattgtgttttcactttcttatcattgtcccttcattagagaaaaaaatctattctgtgaagtatttggttttttatgcagtctgctctgctctaatatacacaaacacctgattctgcaatgagaattagttggtatgtgattgttgagcagggaaatagtactatttcacagaatttcctttagtttatatatggatttttcttggctgaagaagccagattactggagtaaaattataatctccagcaaaaataaaaaaagaaaagtccacagctcagcccctcctctaaagagttgtacagcgcagccttccacggctcatagcttacagcaggtctcccttccctgccaccaccctcacagcaaccccactggctgagcactctgtttttatttattgtctgagcactcatcagtgcagctctgtttaacatgttacctgtatttccacccaaattttttttttttttttttaagaccaggtctcactctgttacccaggctggagtgcaatggtgcaatcttggctcactgcaacccctgcctcccaggttcgagcgattttcctgcctcagcctcccgagtagctgggattacaagtgcccgccattatgcccatctgatctttgtatttttggtagagacagggttttgccatgttggtcaggctggtcttgaacccctgacctcagatggtccacccacctcagccttccaaagtgctgggattaattacaggtgtgagacactgcacccagcctctaatattttttagaacatccattgtggtagcctcctgccatgctgaacagttggcctgggtggtgcaagttatctcccaattattgggaggtatcaattatcatttttgtttggactttacaaagttttataggttctaagtgatatatcccttctgcagtttttctcataagttctgtttatacagtatgtgattttgcagaatatgagttttttgagattatatatattgcaatatcatagaaacctttttgtttgataatctttgcttaaaataacctcatttattttgtacgaatgtacaaaaataaaacaatgtagtacttattggctgtttttgtggactgaggtagagatgtcaagaagttcaagccaaaaaaactgaaaatagttaacagaaacaggcaaatctcatatatcttgccctgattattttttcattagagtccctcctattgaggaaggttcattagcatgtgatgaaacacattgagggggattaattaggaaatataaaagagtctcaaacttctgatataaggtaaaacacgttaattttatgtgtctttaaaaatgtaattagaaccttctgtttgtcttttctgagacacgtatttaaaatttccctcgactcaactgataatctgtgattttgattttcatcccaaagtgacttttaaaaaagttttggggttagggggatgtggtggctcacgcctgtaatcctaggactttgggaggccaaggcggggcagagggcggcagatcacctgaggtcaggagttcgaggccagcgtggccaatattacaaaaccccttctctactaaaaatacaaaaactagccaggtgtggtggcaagtgcctgtaatcccagctacttgggaggctgaggtaggagaatcacttgaaccccagggcaaaggtattagtcagcagagattgctccactgcactccagcctgtgcaacagagagagactttgtctcaaaagaaaagttttgggtgaaaagtagaaaaaaagtcataactttgtgtagagacttttccctcctgtaattctttttattatcaaatatcaggtattatagggtataagccagtgttcttttttatgatttccagaagtgttaaattttccatgtcttctgcatttgaaagtaataggtttggaaagagaaaagctgttcattcttcaagtacatgtaagtttaagtaccttgcagactttgttttgcaggaagcttccttgccttctccccatatcacctctctgcacctcttcacacccatgagggtctttatagcagtgcagtccataaattgttttgaggtaccaataccagtttcttggatattttcttacttaggaacataaatacttaggctgccattgcgttaataaggaaatgctggatagtcagaatcctacattaacccgagcctaaaatctgtagtatcgcttcaaatatctatgtagaaagcatagtttattaaactaaacatctcctgtaatcccagcactttgggaggccaatgtgggtgaatcacttgaggtcaggagtttgagaccagcctggccaacgtggcaaactctgtctctaccaaaaatacaaaaattagccaggtgtggtggtgcaaccctatagtctgagctacttgggaggctgatcacttaatttaaaacttaaaagacctaatatccagaatctataaggcacttaaacagattcacaagcaacaaacaaacccattacaaactgggcaaacgacacgaacagacacttttcaagagaagatatacacatggccaataagcatatggaaaattacccaatatcactgatcatcagagagatgcaaatcaaatccacaatgagataccatttcacgccagtcagaatggttattattaaaaggtcaaaaaataacagatgctgacagagtaaagggaacgctcatacactgctggtgggactgtaaatcagttcagccgttctggaaagcagcatggcgattcctcaaagaacttaaaatagaattatcatccaatccagcaatcccattactgggtatgtacacaaaggaatacaaattgttctatcatgaagacacctgtacacatatgttcatcatagatagcactgtccgcaatagcaaagatatggaatcagcctaaatgcccatcaacagtagattgaataaagaaaatgtggtacatatacaccatggaatactatgcagccataaaaatgaatgggatcatgtcctttgcaggaacatggatggagctggaggccattatcctaagcggactaacacaggaacagaagagtaaatactgcatattctcactcataagtgggaactaaacaatgagaacctatggatacatggaggggaacgacagacactggggcctacttgagggtggagggtgggaggagggagaagatcagaaaatatacctatagggtactatgcttattacctgggcgatgaaataacctgtacaccaaagccccatgacacgcagcttaccaatataacaaaccagcacatgtacccctgaacctaaaatacaagttaaaaaataaatacataaaaatttaaaaataaaaaataaaactgcaaacgtgccctgctttctggcagtaccccattccctgttccttagttttctctctggcacttatcatttatctattttattcattgtctgtctcccttcactagaggttcatgagggcaaggattttcatgttctgtccactgctatgtccctaacacttaaaaaaaggctttgcattctatagtcattcgatgaaataggctgaatttagctaaaagggagttcatgtcctttgaagaaacatggatggagctggaggccattatccttagcaaatgaacacaggaacagaaaacaaaataccacatgccctcacttatcagtgggagctaaacaaagaaaacacatggacacaaagagaagaacaacagacactggggtctgctgagggcagaaggtgggaggagggagaagatcagaaaaactacctatcaggtactatgcttcatacctgggttacaaaataatctgtacgtcaaatgcctgtgacacaagggtacctgtataacaaacctgcatatgtacccctgaacctaaaataaaagttgtttgtttggtttttttgtttgtttgtttgttttgagacagagtcttgttcttgttgcccaggctggagtgcagtggcgcgatcttggttcactgcaacctctgcctccttggttcaagcaattctccctgcctcagtcacccgagtacctgggacaacaggcgcctaccacaacgccaggctaatttttgtattttttagtacagatggggttttgccatgttggccaggcttgtctcaaactcctaacctgaggtgatctgcccacctcggcctcccgaagtgctgggattacagttgtgagccaccacgcctggcctaaaagtttttttaaaaagagaaaacactttccttaccctttgtagctcattgtctatctaacacaccctgtcactctcatcagccttgaacttcttacaaagccattcaataaaatgaaaggaaataggtgcagtgggccccctctgattcgtggctttgatttctttggtttcatttatccacagtctaaaaatattaaatggaaaatttaaaaaaaaaacaattcataagtgttaaattgcatgccattctgagtagcgtgatgaaatcttgccctgtcccactctgtcccatgcgggacatgaattcttcccctttgtccagcagttcctcactgtctatgcctccgacctgttagtcactcagtagccctctcagttattagatcgaccatggcagtatgggggtgcttgtgttgaagtcacccttattttacttcctaatggcctcaaagcacaggagtagcaatgctggagatttggagctgccaaagagaagccctaaagtgcttcctttgagtgaaaactcttaataaggaaagaaaaacattgaatgctgaagttgttagatcttctatctgttgaactgtgaagaagaaaaaagatatttgtgcatagtatataaagggtttcgtactacccacggtttcaggcatccactgggtgtcatggaatgtatcccctgaggataaggggggattactctatgtattttcgtatccttacatcacttacattatttttcctcagccttgttgaggaaaataaaaacacagaagccaagaaagaaatgagcaagcactggccgggcacagtggctcacacctgtaatcccagcactttgggaggccaagacgggtggatcacccaaggtcaggagttcaagaccagcctgggcaagatggtgaaacgccgtctctactaaaaatataaaaattagccaggcacagtggcaggtgcctgtaatcgcagctacttgggaagctgaggcagagaattgcttgaacctggaaggcagaaaagttgcagtgagccgagatcatgccactgcactccagcctgggcgacagagcgacactctgtctcaaaaaaaaaaaaaaaaaaaagaaagaaaaaagaaatgagcaagcactgaacacctactgtgtgcaaggcacttgatagccttcctgttatttcttcctcactacaatcccatgaagtagttcttatccccattttacaagatacaaaaattgactctcaaaaagcttaagaaatttgcttctagttgcacagtcttatagattttcacttttataagataaaagagcttattcaaatccaagtctgtttgaacctgacaaggaaagccttctctaaatagagtatctgaatccctccctgctcgaaagtctcctttatacgctcatgtttcaaaaatttcacattttttgagatatagatagtacccacccacatcacctctgtttttatggaaaatttacacttaagtggcaattattttaatcagatcgacatcctagagagtgagagttcattgaggaaagaaggaaggtacatttttggatcataatgaggagagatcttgatatttttgaaatttgttttgtcttcccatggtacaaagttttaaaagtacaaaaatatgaacagtaaattctcccttctctcccatccctgtctctagccacccactcctcttctgaggcaagagcagattctgttgccaccttcccaagcaggtagtgcctttaaaaaacaaaaaacaaatgttcacctactatatgcattaccatgcaccttacacttttcatttaataaatataccccagcaatggtgatagcagattttggaccagcagtggggataaagaaggtcctggtcacctaggtgcctaaagagaagcagatgaagagagaagaccctggagaaatgttttcctgttttgcacctgcaggtgcttgacatgcctctgaaaatgatctcagtgctgtgcagttccacagctgcagtggtacccacaatgccaaaacttgggatgcaaaggggcgggggtaatgacaaaaatcagggaaggaggaaccatagcaaccacctgatctgcacactcatgtattttatatacctctcttcaatgcctagtgtccttagacagtaagctccctgaagacacaggctatgcctactttattcatcatcgtgtcttcagtgcctagcaccctgcttggtatgcattcggttcatgaatatatgagggaacctgctgctgctgttcagcattcacacctccatttcaaccccatcagaacctttttcatgcttcctcttttgtagtgtctcagaaactcattctgttttcttcttcatctttttttttttttttttttaatggagtcttgctctgtggcctaggctggggtgcagtggcatgatctcagctcagtgcaacctccacctcctgagttcaagcaattctcctgcctcagcctccctagtaactggggctacaggcttgcaccaccacacccagctaatttttatacttttagtagagacagggtttcaccatggtggccaggcttgtcttgaactcctaatgtcaagtgatccacctgccttggccttccaaagtgctgggattacagatgtgagccactgtgcccagccttcatcttcatcttaaaacttcttccatgttcgctgtggctggggacatgatattcctctttccctcccagttgctcctaaggatgagcaaaaagctcttttcacgtcaggggttgtaccgccaatcactaaaaggaacagttgaaatatcaaacatggagaaattgcagtgattacaaaggaatgcaatggggcaccatacagatctgaatttgccagtttgccatatccaggctgtccctgttgcctctggtccaccttaagctaggtgcaaacccagttggaggaaagaaaggaagttatgtgttctctcttcaaggaagaaaccagataccagcctcaaactcttgttcttaggtcacttctttccttggtccatttcactcctcactctccattcaattaaaggacttgcagattaggttatttgcaagtatttctgtaatttattctcctactcccatttgaagccaccaagcctgtttaatattaaataagcaaatgcttcaagtactatggtgacttcttctgtgcctttgcaactaaagccttccaacagcagaggggagaaatttatatctgttatatacatagatgagtaatttgggaatataaaacaaatatccttcttagaaatatttaaacacagatgcttgattttgtctgatctttctctctcttttttttctctccaaacaactggttacccacacttgtacagtcatgtagagacaaaatgctcatttataattccagataccccatgtaattattgcctatgataatcaggtaatctttatgaaactattcctatacaattttcaaatctcagtttacaatcatgagtattttaccataatcttcataatgccctcttgaatatatttgcttaatatcattttgaatttagtgatatttaagttaacatattttatatgttttcatttcattagtaggcttttaaaaatttacttttttgtgagaatctgatttttgtgagactctgtgaacaaatatcctcactaattctttctaatggtataatgtgaatttgtcattgacaagtgttacaaaaaagacgcatagaaaataaaatattttaggtaatcctaagatagctcttccgcagccagggcaattgggctatgtgtctttgggttgattgttagctctgtcctaaatctctgaatttggagaaggaaaccctggatttgaattccagttcctcaacttactggctccatgttcattccttctttgtcaagccccctaacttccctaaacttcagtgccctcatcttaaatataatgacataatagtgtctctcataagattggtagaattacatgggataattcatcttgcatggtcaggggcacggtctcgggaaccagactgtgtgggtttgagctgctcagtcttggacaaaagattaaatatatctatgcctttgttttatcatctataaaatgggaataaccatagtaccttattcaaaggttgttgtgaagattaaaataaattaatcctgtaaaaatgcttaggtttctggcacatagtaagggcttagtaaaaactaggtatttttacctggtatgtgcaagcactgtatatatcctgatatactttctcatctataattctgtttctgtgcactagtttatatatttatttaatggaattatttttacagatttagtcagattttagaacacaaagcaagtggatacttagtagccataggggaatctgattttgatgtctcctacccaaagtttattcatatttaatattatatatacataagtcttattctttctcttcgtcctttttttttaaaggcaagatctgccttcatcttcggttttctttagtgcttagaagattgccttgctagtgataagtatttttgcttaataagtatatcttgactgtgaaatttgtcaccagttttgaaaggaactctggcagcaaatgaacaaacttaaatccttgtggccagggatcaaaggcaatctcaaaccgaattctataataaagagaagtttggagagagaaagggagtttagtgtaaactcaacttttgaaatccaaaggtatcaggctatcatgggaagagtgtgggattcagctttagccctggggtcacaaagtcatgggtatgctcttatataagtaacttaatcagatctctgtttcctcatctgtaatattaattcccttctcctatttcatagaaatgcttaaaatttttaacagaggtaatatatgggaaaatgctttgtaagctataaaattagtgtacaaatattagggtcactgatactctgtgacgcaattcaatgatttggtagaagactatatatatatgtgtgtgtgtatatatatattatatatatatatatatattatatatatatatatatatatatattatatatatatatggccaaccatatatctattagtagctctctctatatatgttttaaagccaggctggtcttaatcttgtctattgaattcattttgacaagaacagtgtaggatccattagtcctttacaatgaagaacatattaggtgagtcaatacttaattccaaaattttactttagaataagagggatgtctaacatcaattgattgaaggctggaggaaagagcgtggagagaaagaagtaacacactgctctgtgtttttgtgcctctgtctccagaataaaagtggacatgcccttcttcctccttacctctctctctctgtatccctttcagtacatatgtccaacactgccatacacagcctcgctgaaagtatcaggcaaagggagaaacagtgagcattcctacctccagccttgacaacaactatgaagtgtgttgctctaagctctgatcataagggaattagaagcactatgattttttaaaatcaaaatatgcctgtagctccaaaaaagaagaatttgactatagggtctcagctcactgctaggagaggtgtaactgattaaactctggtgcagaatgtatcaggatggaaggaatctgagaagtcaccaagttcaaatccttactttcagtccacagagtcatcctgctgcatttcctttttatgcctgcaaacaaaatgtttctggaactcatttattgtcagtgagtgctccctgggctctgaagcccagagatgttcctccataactcatcagaggcttgggtcatttctgagacaataagttactgctaggtcactgaacatacttggggtaggcagtggggaaggggattctgtgataagaaggtgatcatgtgttctctatttataggaaaatgaatcattctcagggtgatgagcatgtgtcattaaactgttttcctgatcatgaccttgcaccaagctgtttgccctctttgccctgttccctcaggctcagtggtcagggagggtgggccagctggccgagatgtgcagtccagtccagagttcaagaacagtttgaactgtgagactgagagccaagctgactaggtcagagtgagaagccattcctcagcatatgggagctgttagttagtgccctgaagctctctagttatttggggaaggaatgggagaaagcacttagatccctgctgggctcattacctttaattagcttgcttggtctggtggctactgcagagggggaaatctccaaaaactgcaaaaagattgtgcatgatggtgggggaagatactttaagaagggaagaagactctgttgagcttccacaaagaacaggttgttcatacctgaatgcacacagggaatgcacaaattttataaacaagaaggctgggtttgttttttttaagtttttctgtttttaaatttctgtttatttagcgggtacaagtgcagttttgttacatggatataactctggtctttcagtgtaaccatcactcaaatagtgtaccttgtacctattacgtaacttgtcattcctcaccctcctcccaccctcccatctttctgagtctccaatgtctattattccaccctctatgtccatgtgtactcattatttagttcttacttataagtaagaacatgcaatatttgactttctgtttctgagttatttcacttaagataatagccttcaggtccatccatgttgctgcaaaagacatgaattgattcttttgtatggctgagtagtattccatggtgtatatacgttacattttcttgattcaatcatccattgattgaatggtgtcctttgacttatcaaataaatggtgctaggaaaattggctagccatatgcagaacaatgaaactcgttcccctatctctcaccatatgcaaaaattcactcaagatgaattaaagatttaaatgtaatacctgacactataaaaatcctacaagaaaatttagaaaaaactcttctgggcattgcctagggaaggaattcattactaagaccccaaaagcaagcaaatgcaacaaaagcaaaaataggcaaatgggacttcattaaactaaaaggctttggcacagcaaaagatataatcaacaaagttaacactcaacatacaggatgggtgaaaatacttgcaaagtacacatccaatgaagggctgatatctagatatctagaacctatgaagctgtttttaagaacagaatgaggacatgagccaacacccaggattccagtggaaagtgaacagagcaggcacagttaatggaaaatgaacagagcaggtacagttaatggaaagtgaacagagcaggtacagttaacgtcatactttacctttttccatttgcacttcacgaagagatgagctttgatagttaacttctctctctttttctctctgttttcttcttgtgcaaactgggtgatgacattgactctcttcacaggaaagcactaagtgaggattaactaggtaatgagagcaaattggaagggtgatggagatgctccgcaaccttgctgatggatttctcccagcgagagaatctcttcaatgcatctttcatctgtgtcttacaggcagggtgtaccatcgttatctctgcattctgcttaagccatcccctccaaaccctgcctctaaggagctttggcctattccttgaaaggattcttcagttatcccaccaacaatcagaggcagcaggactcaatatccccctgtatggagaaaaactgagacaggagattgggctaagttgtcagtgattcacccccattcctgccctaaggaaaggatctttttctttccttttttttttttttttttttttgagacatggtctccttctgtcacctagactggagtgcagtggcatcatcatatctcactgcagcctctacctcccaggctcaggcagtcctcccaccttggcctcctgagtagctgggactacaggtacatgccaccatgcccagctaatttttgcattttttgtagagacagggtctcagcatgttccccaggctgggctcaagcgatctaccctgctcagcctcccaaagtgatgggattacaggtgtgagtcaccatggcaggccaaaagcatcttctcaaaaatctttcttccaaaatgtatattatacaaactttctggagaacaatttaggaaaataagtattcaaaattcttagaaaggtgcatgattcttgcccactgaattccactttcagcacatgaccattagtctttcatttcttcttctcttcttcacaccagagtgtattgccttcaacaaagaaactaaccacttttagacttgtaattaacctgtcccttcccctcatctgcccacctgactactgaaagtccccagagtctgcttcttagtgggacaccagccttctgcaaggcacttattctctggttatgaacctgtttaaggaaatctatatatttgcacagaaccatggaaatatagatgtgaacaggcttaagtgatcacaacccacattttttttttttttttgagatggagccttgctctgttgccaggctggagtgcagtggcgcaatctcggttcactgcaacctccacctcctgggttcaagcgattctcctgcctcagcctcccaagcagctaggactacaggcacgcaccaccatgcccagctaatttttgtgtttgtagtagagacagggtttcaccaagttgaccaggatggtctcgatctggtgacctcttgatctgcccacctcagccccccaaagtgctgagattactggcatgagccaccacgcccagccagcccacactttttatcagatgaggaactagagactctgagaagacaggtggcttatccaagagttcatacttattcaaggctacagaataaaccagaatctggggcctgtaactcccatatgggcccttctcgagttatggagacttaacggtgtgggacacaaaataggaagaagtagagtaaaactttataaagtaggaaaagaaataatgtttgtactatgtataatggcacttcaaaatccaccattaggagtgtctacagtttcctctgcataatttagaggctgaggccatgtacctcaattcagtccagttttctatccaagaggtgcaagctctaaaataaaggaaaggaatattctttatcagtcatcagcttaatctcaaaatattgtgtgctccataattgaccttcattagggcattatggacaggggcttactatatgctaagctatgtaaatacagatgctcctcagcttataatggggttgtctggataaatccattgtaagttgatccacacataaccctattaaaagtcaaagagcatactgaatgtgtattgcatttgcaccattctaaaatcaatgtgtcccttgtgtaaaatcagttgcatccgaaaagcctgaaacgtgtacatattctttgatctagccatcttattctaaaaatcaaaataaaatcaaaataaaatcaaaatataggtaagttgaactgtcataagttggggaccatgcgtactctgatagtcagtgttatgtatgaacttgaccaagccgcagggtcccagacatttgtccagccattaatcaggtgtgtctgtgggaatgtttctggatgagatgaacatttgaactggtagattgagaaaagcagattcgtctcccctatgtcagtggacctcatccaatcaagaccggaatagaacaaaaaggctgagtaagagggaactactcctgtctgactgctttgagctgggacatcaatcttctggccttcaagctcaaatgcaaatatcagctcttcttgagtcttgaggctactggttttcagactagaatttataccattggctctcctggttctcaggccttcagatttagactgaaactacactatcagcattcctgagtctccaaattgctgactgcagatcttatgactttccagtcattccattccttgtcataactctctttctctttctttctctctctctcctctctctctctctctctctctacatatatatatatatatatatatatatatacatatatatatatatatatatatgaacagatacatcctattggttctgtttctctggagaaccctgactaatatacagttatgtgtcacttaacaataggatatattccaaaaatgtgtcattaggcaatttcatgatttgtgaatatcatagaatattcttacacaaacctggatggtttgctgcacacctaacctgatgcacactgaggctttatgggatagcttgttgctcccagactagaaacctgtacagcatattactgtactgaatactggaggcaatttctaacacaatgacaagtatttgtgtctctaaacatagaaaaacacagtaaaaatatggtattataatcttatgggaccagttgtatatgtggtgtgtcagtaaccaaaatgtcattatgcagcatatgactgtatatatacatttacacttaatcctcacaaaaaccctctgaaataggtactattgttttgattatcaacctaactttaaaactgggaaattatacatagactggttaagttcctcgcccaaagctacacactgcatctggaaggagtctgaattcacccagataccgcgtgctccatctgtttgattcacattctcctaattgtgtcccaaaagcctgaaacatgtgcatattctttgatctagccatcttatcctaagaatttaccctaagtaataatcatggatgtattcaaatatatcgcaaaacatttataacagtaaaaatatctaaacaacttaaatgctaaacaataataggcgattggttaaatgttctatgatgtagttactcagtgaaatactaccttcattacaaaccatgccctcaaggactatttatttacttgggtaatcattcaagctatatagatgagagtaaaaggcctgttacaagcctgaggagagatggtaactaaatatactgtatgctcgatgagaccctgaaattacattttaccatgtttccttaggcttgtagcattccatttttacttctattctgaagcagaaaaaggagattagataaaaactaagaaaaccttaataaaggccgggcgcagtggctcacgcctgtaatctcagcgctgggattacacacatccctgtttttaaaagtgaaatctgccttctatagaacacattcccccacagaaatatactacagaaaacagacctaataaagtggagttttgttcaaatgcttccctcacaatgatgctttaatttgctgaggaacatatgattgatcctagttcacctgctgaacatgcataggcagtgtgcatctctagcacactgattaaaatgaatacccagaggctcaacatgatttcttattaatcagaacatacacaactttgtgaaagggaccttagagccattctctgccccagggtgaactgggacacaggtatagaaacctccaggactctgttggaagagtttttcttctaggttttttttttttttctgttataactgtcctttccaagattaaatgatgcctaggatatcacatcgttcagaagaggttgaaagagggagttatttataaatcctgaaggttctaggaggtttgggcttagaccactttggactcagagaaggctgtgaggtaaggcatgttctaatcttgttgatggaagtcctaatgtgtcttagaagatttctggtcatcactgtctttagggactcagagtcttcctctaagttagtttcaggaccctttgaagtattggcattgctggctcagtccactggctctttggccttcacctgtctgcattatggttatagctgagatgccaggaaaaacacaagatgagtctgttcagctcgaagctgactcaactggtttctaccacctcaattcaaactaggaatgagatatttttcttcctttgctttttagggcaattaatgttcccacatatctccctttttcttgccatttcttagcatcctaaacactaattttgcaaaataatgttgtaaatgctttgcatagtcactatcttatgttgcccttcctgttcacaagacagccgtccgtgtcagttgaagatttctatagatatgcatcatctctgatagataaaggcatgtttcagagactatcctggtgggagtattttacttttgaaaccaactaaatctggttttgctcctgtttgtggtactttatttctccctgtagcaggagagtagtgccaacgtgcctggaaaatcaagtttcaaacctctattgcattttaagccatgttttagaatcttagggtcaattaatattagagttcgacaaaatctctgctctcaaacaaaattatatacaaaagctcagtaagtaaaccaggtaaatgttaaggtgcttcggttgaatctaggtttaggagtccagagaatctaactcaaacctggcagctggaggatacccaagaaactccctgggcttagtagtgtacagtgcgaaaaacagcgatctcatccatgtccttcattttagggagatgatacctaaactttgtgggttttatttcaaagtcacatgttaattagtggcattgtgagggaagcatttgaacaaaactccactttattagatctattttctgtagtgtatttctgtgggggaatgtgttctatagaaggcaggtttcacttttaaaaacagggatgtgtataatcccagcactttgggaggccgaggcaggtggatcacctgaggtcaggagttcaagaacagcctggccaacatgatgaaaccccgtctctattaaaaatacaaaaattagccaggtgtggtggcacgtgcctgtagtcccagctacttgggaggctgaggcaggagaattgcttgaacccggaggtggaggtttcagagcaagactctgtctcaaaaaaaaaaaaaaagaaagaaagaaaaagaaaaaggatgtgaaaggaaagagtttgcaaaaaaaaaaaatgcggcaatcacaatacatttatgtctattcatattatttgaatttgtcattttcttcagtgattttttttccttgggttgttcttatttctacatcattatgtttattatatgaaggaagcagtcagcctcatgtttattctctggtagagaagaggaaaacagtaatttttgagcatgaatgcataagaccatacagtttatggaaatggctgtagcttctctaacctttcccctttcatacatacttgtttccatgtacacttcattccccctttttccccctttaactctctttgtatttgtatccctccttccctatgccctttttactcaattcattccctacatcacaacctgtggtttttgtatctgatcatagttttcaccctattgaaaatcatggctggccaagtacatgttaacaggaaaattctggacagtccctttgtacacaaaccttactgcttagtttcatctgtgcagattgctgtatactcagccctgcagcagagagaccacactgcagcctttagtaggaaaaggataggaatgacaatacactgcagacactttcgtgagtaagttgctaaagcgtcagtaaaacatcatggtgaggcctctgcaatcagcctgcttagatttaaatgacaattctgtcacttacaaatatataaccatttggatagttatgtttgcactttaagcctcatgttagttatctggaatagtatataatattacctacctttagtgtcatcataagaattaaatgatttttgtgatataaagtgttaagtgtggtgccagaccctggcaaagttggtaattgtccccttccttccttccccgctttcaccttccttcctccctccctccctcccttccttccttaattccttctgtccttccctcccttcctcctttcacctccttcccttccttccttctttccttctgtctctttcacatgccttctttctctcttcccttccttccttcccctcaccattctatgagggcataactgggagggttaatagaatggatatctaaagcagcgattctcgaatataggcttttaaccagcagaatcagcattacttgacccgaaaacttgttagaaatgcaaacacttaagtctcacccctaagctcctgattcagaaaatctagggttagggtttaactgtctgtgttttccttgtttttgtttgtttgtttgttttgtcgttgttgtttgttttttgtggttgttttgttttgtttttgagacagggtctggctgtgttgcccaggctagagttcagtggcacaatctcagctcactgcagcctcaacctcctgggctcaagcgatcctcctacaacagcctctgaagtcgttgggaccacaggtgcaccaccacgcttggctaatttttgtatttttggtagagacagggtttttccatgttgcccaggctggtcttgaactcctgagctcaagcaatcctcccaccttggcctcccaaagtgctgagatacaggcatgaagtcactgtgcttggcgttttaaccagcctgccagatgattctgaatttgaatatcctggtgagaggttttaaatcatgcaagtggctgtctgcctccagttaaggtaaaaagggaaaggcctcagcttacactgtggttgagccatatgacaggacatacaaacactattaatattactagagaagcaaccagcaccgttttgaatagctcagtctattgggggtgtgccttctactcaagatgtaaataaggataggaaaaatagcactagtatcaactgccatacaattatttagtcacccttgggtaactaaacagcataggtatgttgatcaaaatgcccttgagtaattgtcagtggaattttgaactctccccaattcaataagatactgctgcaggtattggtgaggtacagggagcatctaaatggactgtctttcattgtctttcttgagggttctaattctttggttttctggagaatattataggatagaatgtatatcagaagtgagacttgggagacctgtgtgacctcccaagcatgacaatattcacagatattcagatccatagaacacttcaggaaattgtctttatgttcaaagatctcatagaacatttagttggatacacttcccacacacatctctccatttgatatagagtcattatcttttcaaactttctttttggtcttttacagaagaacctgttaggatattctcaagatttgttctagtcacacgggggtggagggggagggggggtgtgttatagaagtagctctagatcatttagcttaagagttaaattttttgcaaaaatactttgtggtggatttctgatgccagtccgcataggacttttattattgtaatagtgttttgtctttcttttttaagattaggaaagtatattcaccataatatttgttgttaatcacttattttttatgcaccttttccaaagcaactatattgtccttatcttgaaaaatgaaaataatagcttccagataaatccttatgatagttttgctatcactagatagtggcagagggaaacagaggaaaaggagatctatgcattgtctttgaaagtcaagattattatactaaatgtttttgaagcattttgaaaatacagcgatatttacttataattctcaactatattacagttactggatctaaatgagaagtttgttcatctgtaaagtatttgaatgctaatggtattcttctagtctagtgcattcaattaaaatataacgtgtgttacatatgaagttaaaaatgtttagtaaccaaattaaaaaggtaaagagaaataagtgaagttaattttaataatatattatctttaacctcttttaataatatactctctttaactctttaatatatttaataatatattctcttttatatacatagaacattgtcatttcaacatgtaatcaatataaaaaatatcaattagatattttacattctttttttcacattaagtctttgaaatttagcacgtattttacacttacagtacatcttaatttggactagatgcatttcaggttcccaatagccatatgtgtctattggcgttcgtatcatatttatcatggcagttttaaatgtattaaaatgataagtctataaggtatcttcttaagtaaattctcccaagtataacagatatcagaggtaatatacacctacaaataattattgctaaagtaaaatttgtaaagctattgactgtcagtaaatatgtttaagaaacagtttttcgtattactctaagattgttcttaaaaccagcattgcagttcagtagacaagtgcagatatttgaaataagatgtttttatactacctatgtttaaatttcatgagcttcatccagcactggattttctggattctgagatatgctattcacatttcaacatttatgaaaacagaatacatcttacaattaatgtgttcatttaatgtaatcatacttcttgttttcctgaaactgagttggaaatcatcatggaaaataggttcttctcaacacaggaagagttctcagctattgtatagttgtgtttttgagaacatgcttcagcacttgagagatggatttcctagagtttttcttaaggatcaaaattaaaaggtggaaatatacaaacgctaaataatggaattaagcattggccttggataacagaaggtgaaggagataagagacaactttctgttccagctccactttaaccacaggggacataaatatatgggaccttgtagtatttaaccttgttaatatctccatactgttttgcagtaggcgttggaacagagcttcacatttttctggtggaggagccagtgatctctggatggtgaaaatattctctaaaacagactccacaactacaatgaccagtacaatgtgttttctatgccgctgtcctctgtcaaggggcatcacaagtggctggcctatattcatgtaaaggtagaactagaccccaatcaatgtgccctataaatacccaagtctttaaatacccttagataataaaggtaaaagatgcaagaaaaagaggactgggagagtgggccaagtttatagttctttcaaagtctatttgaattatttaaaaccattctttttttgttaatagattttaattctcatacatgtcacatgtttcttttgcagaattcaaaacatttttaaaaacacccatttcaataatattgcatgcaaggtaaacaagaggttagaataactagtacaacataacgcagcttgactagaatacctcgtcataacacaagtacatcttcttttacatttatgcaaagtgaaacattgtctgtctctctccatagtccagaaaaatctgtggggtaattgctcattgtcccttcacaccctgtttatattgcgcgtcttctattttaatagtcccaataaacagatggaaccacaaaaacacagccgggatggctcagttggtcaatggcatcagagaacttaaagtgcctgatgctgatgactcttccagaaggcaatcctcttatgagggtcagggtctagagagtccacgttgctgctcgtactctctgtgtttaattccagctaacatgacaaagtgcaagcgtatgacaaggactttcagtgtgaccatcagctggaagaagccaagtgcgtacagctcccggtggggtggcacatgctcctcttgtgacttaatggtggcttgtggctccacttcccttgggggttgtttttgttgttcttctctcaggaccacatttattttgatgttttaaaagagaaagaaaagttccaaaaacttcctttctcgtatttcctctttgagatccagcaaaatttctacaactggccttttccagatggcttgcccagaattgctgagagtttgaggcacctcaagctctgggctcaacatcgaaggttctttaaatgtgccttttatcctttagtttctgtcacttgatgatgggtgaccaccctcatctctctctctctctctctcttttttttttttcctactaaacatgagattactggaaatatttcatgattggatacatgctattggttaatccatttaaccaaactcccatcaatggatgtggagtgtttacaacatttttgctctcataacagtgcttgacaatgtagggatttgtcaggttttaatccaaatagggctttatgatacttgccattatactatcagatactttttcccactgatatggtttggctgtatgtctccacccaaatctcaccttgagttgtagtcctcataatccccatgtgtcaagggcgggaccaggttgaggtaattgaatcatgggagcagttttccctcatgctgttcctatgatagtgagtgagttctcaggagatctgatggttttataaggggcttcccccttcacttggcactcactctgtcctgccccttgtgaagagggtgcctgcttctcctttgccttctgccatgattgcaagtttcctaaggcctccccagcagtgtgaaactgtgagtcaattaaacctcttttctttataaattacccagtctcaggtatttcttcatagcagtgtgagaacagactaatacactcatcttttgaatacattatgtgaagtacaacaattttttccaaaccaaaccagacctggctaaatcctttactatagaccccaagattgagagagagggaaaaaggaattgatctgaatcaaatttgctgttatcaagaagtagggtagggaagggaccaatatgagatgtacgaaaattggctcccaaagtacagaaaaataaagatttgacttgcctactcctggcataccatttgtaggttctggccaacatctgcccttctctgagcctggagcttctctctttcaaatgggagataattgctgggcagctagagctcacaggcacgccgcatgatgagtgaggtcatgttaataaagccctgggaaagaaaagcaatgtgaaacagcagggctattaccgttccaagacgattttatacaagtgaagcttaagttcagtgtgatgattaacaagctattagagccaagttattgattcctctatctttagagtagctaatgcagtgtgcaccaataggccacagaccccaagctttccttcttcctgtgctcctgttctttgtaatgatgctttccttaggaaaatgaaaatcacttcgcatacacagtgcaacatctttaaggcaggtgccagcagagaggaaaaacacctaagctgattttgtgtgtttttattattttttctgataataaagattaatgcagatacatgaaaaaaacaaaacataaaaagtaggaacagaaagtcaaatactgcatcttctcacttataaataggagctaaataatgtgtacagacaggcataacagaacggaacaatagacactggagacttggaagggtgggtgagtgagcagggttgagggatgaaaaattaccttagaggtacagtgtacattatgtggatgatgatttcactaaaaccccagacctcatcactatgcaatatatccacataacagaactgcacttatacccataaacttatatttaagaaaagaaatagaaaaaagataatttttttaaagtagaaagagggaaaaaagtaaagcatcatcccaatttctttcaccctgaagcagctagttttgctaatatgatcatatacctatccacacatatgtatatgatcatattaaacatattagtttataacttgttctttgttccttttctaacatactcctcacaaaataatatcattgatagtttcccatttcaattaaaacagatatcaatataatttatcagcaaaatattttatggatgtgtgtacagttttggttaatccatttaaccaaaatcctcttgatgaacacagagtatttacaacatttttgctctcataacaatgctctgatgaacctcatgcattcatctttgagcttttgaccaattttccttctgtggtaaattcctgaaagtagaattgttgggacaaaagatttagagattttgtatctttaaacatattaccagtttgccaacccaaagggtcatatgagattactttctgcctacagtgtagtaaagtgccagcttctcccaacaaccttgccaacgttgggtattgtcaattttttggctctttgccaagctgataggagaatggaatgtctaatggtttttgaattacattctgactgtgctgcatcagactgtaactgaatgcagttgtgatgtatcaggggacctggtttaactcagcacactgtttgaatctgtgtaataactaactatgatataatcaggctttcttgcagttttgaaaaagaagccaaactttcacatggtttaaattactctctcatttacactctccatgtgtgagatcacctgggaagccctttggagatgcccccagtgacccagtacaagttgtcaactgcactccccatgaaagagagattgttctggtccaaaccctatgctctagaggagcatcttggaaacagcactgccctataattgatattgctccattgggtggcctgtggtattcaattcactggaaagtatcaatccctttgccttcagcaataatattttcacagttttgatgtgttttaaaggttattgtctccaggacaggtaattgaggaggcctcacacttcatcagaggccatttcatctttattacacagccacacacaaggcagcattttctcctttcactgatggattatttcaagatttataaggtctggtctacatgaaagcaaacacatgtttgggtacacagtcaaataattcaaagatatagggtcagcaggatcctaatattaaagtcaggacttccagcctgggcaacaaagtgaaatcttgtctctacaaaaaatacaaaaaattagccgggcatggtggctctcgccagtggtcccagctacccgagaagctaaggtgggaggattgcttgagccccaggaagtggaggctgcagtgagccatgttcatgccagtgcactccagtctgggccacaaagcaagaccttgtctcaaaaaatgataataataaataataaaagtcacaactttttcctcttctacctgtgccagagacccactacctaacccacatacacacagacacacacaaacacaccatacacttattcctttcttaaaatgtggctttcaaatatttgctttgcatgcagttttctctgaagatatgaccagtttcaagattatctactctaagttttctgactggttgtcagtcagtcagtttggaaccctgccataacatattttcctcaaattccttgcagatactggaataataatgaatgggaatgttattttgagccgatatttggaaagtccttatttggaattctacaagtttatgtctcctgcccagttcctaagccctctttctagataaccatccagaagataatcatccagcagctatccgggtacattcggctgacttggttagttgggtctaagcagtatatccatgagttctaactcgggtttctcaaactctttttcctttgggtttctcagactcttctctcaaactcaaactgccttctccagtccattgctaaagcttgtatgacctttgctttccctccatttcttgacttgtggcatccactagtcctacattgtaggactagtgtgagcaggtcactcagcctgaaagcactcaccctgggcctctagagctaagttgcctcaacacacttcactatggcttctcagagcacactcaccttgaatgtttagaaaaggtaatctttttggggttcaatgagatcaaaagcacggataccaattttgggatcaggaatcaggaaaatctgggaaatgaagaacgaaatgaggccttaccattttgatacaaagttcatattcaagtgagtcaggagatctggtttaagttccagatctgcctcttactagttttagaatcttgggcaattctaggctggacgtggtggctcacacccataatcccagcaatttgggaggccaaggcaggtgaatgcttgagcccagaagttcaagacatgccttggcaacataggaaggccccatttctacaaaaataaaaattagccaggcatggtggtgcattcctgtaatcccagcaatatggaaggtgggaagatcacttgagtccaagaggtcaaggctgcggtgagctatgatctgccactgcactccagcctgggtgagagtgagatcctctgttaaaacaaaacagaacaaaacaaacaacaaacaaacaaacaaaaaaacaaaaaaaattggagggaatttagttcatatatttgagtctttgtttcctcatctagaagatgtagtaaagataaatgaggtcatatatgattgtccctggcataatattttggtacttattgaaaagcagctattgttttaagtcctttgcatatacatttctatgatttactatatatcagtagcatttctccaacccatcttggctaggcaagcaccactgaatatgaaggaggccaaatagaatgatactatccaagctgcaaagaaacaaacaaaagaaaacatctaaatgcatgcctctttggaatggcatttgcatccgttgccaatatccatagaacaaatgccttcaggcaggagaagttgggataatgtcaatgtttttaatagctgtagtagagtcctatttagaaagcagtaattatctctccatattgattttttacatcccctcaataaatccagaagaaatgtgaagaccatctgtaagtgtgatttttaccaggatcagactctaatttgcaatggctatgtgtctgtttgatttagatcaggggttagcaaactgcagcccacaagccaaaactacctcccccatctatttttataaataaagttttattggaacacacccatcacacccatttctttatatctgtggctgctttcatgctaccatggttgttttatttaattgtaacagagatctaagagatctagagcccatattgcccacagagctgaaaacatatgtacatctaaccctttgcaggaaaaaacttgttaaatcatgattgagattatagtagtattatttctgattgactaggtagtaattggtcccagcatgtaaagtttctaatattaaagtcacacgatagaggagctagaggcttaagaaaagtatacatgaatttatttatttggaataggaagggaaacatccctggtatcatcatgatggcatatagaggcagggctgagagctagaatacagaatacgtcctttgctagaaacagtttctcgggctgggttagagtgggtagaaactatggatcatcctgccgcaggtccaagtaaacaggatttggcgctctacataatggctataaagaaacataaaggtgatttctccaagtgttatgctaggtgagaaatatttaataagtaagagcaatcagaattggtcccatattgagaaagtctgttttggagcccagactaaatagactgtgcagtgagaaatgaaaggtcaatttaggtaacttcatttagggcaaaatcatgacttaggaaatcatgactagataaatatccagtgaagagcagggagagaagattcatcaatggccgtaggttgctgtgaactacagaactgaaacatcaatgtatgaataaagtgctgtattgatggacagatgtgtgcatttttatgtatatgccataaaaaatctgaatcaatttctatttgaaatagagaaaagctagttcagatgttagaaacttttctgacgcaaaatattgtgtaattcataaacaattccttgtgttttagtttacagtatgtccagaatataggacttgcctactgtaatgtataaaacaaaagaacttcaggttgatttatttgttaagtagtagacattctcctaggatgtttatgtttgtgaagatgataaatggaagaatacatccacagaaaatgtagacacaggcccttctctcccagtctcaacaccacaccctacacacacacaatgccttccttctaaccttgtctatactgtctctgcaacacacaaagcatatgcccaggataagcttctctttcaaccacctatcaggctttcaacatgtggtttgaaaagatagtgacattgctatgctctgacatacaccgtaatgtcagtacagcagaagcaagtggaagattctacttttccgataaagatcagttgctgtttcctgtcttgaagacgaaagttgagcaaaagcaaaggtcatctgtgtttatattaacaatgtaagagttatactacattttcgcaacaacatcaggtcattatttatccacttgtcctttttttttttatcattcctttgaactgcctgcatttgcttatcgtgatatttctcagtctgtaaacagcccgagtagctgttctatttctctaaatagagtcttaggtcattttattatccagaattgtaagtcatcagaatgcacccatctgttgtccttccacatctgggctaactttaactctttaagcccatagaaaaagtagaaaagccattgtgatatgagtttgatacttttttcctaccatactgctttccagcatatggttttccctgaaaaatcacaaggaaatatttacaaatatcttatttttctttggacatggcattaaacgtggtagatcctccatctccacttggctctttctgattttctgttaccctaattatccttcctgcgatcacagctgctcagagcctcttcttaccaatttaaaaaacctctaaagatgtgacggctgcctttccagtggccaacaagcagatttccatagcagaggagctgcgactggggcagagagccaaagacagcttgtgccaacagccttgtcaatatgccaatcatcttgttacagtttattacatgcgtgacttgattttcttgcatgtgcgttttagaggtaacaacatattggtaaacctgttttcaatccttttgattaccttcaatttgatagctccttcagtaatgaagaaaaaaatgggctattgtgtttgaattacatttatcaaatgattctaagattgttctaacgtgtgcgacaggataagctctcttttagtcaccaattggagaaatatgctcagtgtcaaggaaatggagaaatgcctcattatttatgttgactaatgtataaatacaatatgaacaggggcggtttcaaccctgcaaacgttttcttccaagttgctctgtattttagctagactagactagattgttcagtggtcacaaactaccccaaaatcttaacagtttacaacaacggaagtttattttctaaatatataacatccactgagtgttggccagcgttgactgggggttgttctccacatcacgtccctaagggaccaacagtgttggaggagtctctcttctcatattgatgttcaccatggcaaaggcaatgatcacagtgaaccacatgctacattttaagcttctacctggacaccacacaagtcacttccactcccatttcggtggtaaagcaagtcaattcaagtctgacttcagcatctttgggaaatataattccaccccaggaggggaagcagatatgggtgaaatgtaataaaattcacctctccataaagtcctagtagcattgttttatttgagtgaattctttttttttttttcttccttacagatcctctttaaaacatcagcctggaaacagtatctgtagaaatcagttttgttagttctaaagcagggcttcattgttgggatgtgttgtctgccttcgttagcagatttcaatcatagccctaaatggaagacacattttagggctgttgctgctatagaactccaggtctttctgcttaacggtttcacacttacgtgtgaagggaggacacccttggccaaaagaaccaaggctgctcagttagctgctggttgtcctccagcaaattcctagaactaaatacctggtgctgaggtgtcacgactcagcaagtcctagaacctgtgcttatgacagcactctgataattcccggttattgcatcactccctgatggaaacccagcttttatttcagcaaaagtaatggattgttccagacccctgacctcccttgaagatgtctttttgttggatctggccctgtatattttccagttggttcaagacctagagaaatttctacagactctctcataccaggtaggtttttgtttgtttgtttgtttgttttgcttttgggataggacctagtcatattcagtccacattggaaagcataaattagtgtaacatacataagcttgttcattccactccatgtgttaggtttttgttagtgaacactgactgcaaaaataccaaggtatagccttatgcaagccaacatagtcacgttggacattagtgatctgagggtggaagtgaaatgaagtacggttttttttttccaagtcaactaaacgaacaggctgtatgttttacaatatgaattgggttgtgatatacaaagtgtttatccaaagttaccctcctctttgttttttagaatgacaagacccaaatgggagaattaggccagaagcaacaatgccctcaggcttagtgaaattgaccaaagtttgaaggtaagtgttttcagaccctggtttcctaggaccaagtcttggcctcatcaaacataatcacagtctccttttaccactttggcccaaacactatgaagccttttgcccactggctcagcttctcttgccatatactgattattaatgccagtaaaatacctaggcaccttggcagtaacttacgcaaatatgtatatttctaattacagggaaattgttagaacatgacttggattagagatacacagctaataattcaagaagaaataatgctttgttttcagtagaggaaaataaaagcttcatttgaataatttttcctcctttctctccctttttgttttgatacttacgcatgggcaataccgtaaactggcaataaaagaagttatcgcaaacagtgtggccatttctcctcagacactggacatcctacatctgttatatggtttaccatccatccacttccttgctatagctccaggtccacaattctttgtcatgtcattgctcttgacctataccatgactgataaccatgtacatttttaagaaaaaaatgtaaattaattaaaataatttaaaaacacatatccatatggtgtttgtgcatatattttgctttttctaatcttatctttgtagttcaaaaaggttaaacctgaatgtgatatgtgtgtgtatggaaactgaatgcactataggttcaaataggcaaggaagttgcttagtaacatcctgttcttgactgtgctatcataatttgcattttccaataaagtgtgtttccagccttaggacagtgctactattattgctggtggattttgtaatgtaagcttgactcattcagtgtcaagatcacctaaggccaaattcccattccacacgaattctctttcaagggatgtcctacccttcaagatgcccttaagaattctggattccttaaatatagaactatttatgcttactcataaaacagggaatgttataatatttctctgcttcactgtgtccaaggaagtagagaaatctggtaccatatttatgagcagcaataaaccatgtgttttgctttttcctaaaacaagcctggcaaactgtttaagaacacatgtgcagagcttgggcacagggtgagagtttggtggcacggagtgaggctagaggtgggcgtgtggagagtctgatatcctgatatcaaagcaattccattcagacttaggcctgagctgctcccagtcatccaagtcatttttactaatatctgacaacttgcaaatattgtgttacgttcaacactgaaaatgaggactgtgcatttccttttgtctaaatgatgattaaatggtgaagcagctacagaagtattgactaacgacagcatccatttactagaaaatatgtcatttgctactgcaaacatttatggtctgattatacctcatgttacactgcaatggtttgggttttttttttttttttgtatttttggtacatcagaaacacttttcccaatgtttgttagtttaagcattgttcaacatttatttattaagcattgactttataaaataggtaccaggaatatgaaaatgagtaagatatgttccctgacatccagtagctcatagtctagagatgtcaccataataataactagcatttattggacaccacctgtgtctcctgaagcctgttacctcatttaattttgacaaaaccttatgaagtgaatattatcacacaaacacacacatttagagaatgaatgtgaggctcagagaagttaaacacattgcccatgatcacagaaccagttagtggcagagttgggatttaagcccagatctttctgattctagagcgtatgttctatctatgaagctcttaccgattttattttatatcaagtgaactgtgtaatacataaagtcactcaggaaacagtactggatggggattatgatactaggcagtgcttactctagcaaataggtatcagagccctggcataggtcctcacttttgctaggattctgtcctactccacccttgctgataaacgggaagccacacgtcctggtccagcacttattctcaggcctcccagggacactcactctccatcacgtagtctcttccctaagtagtctgtgtttccctctgccttgcgggtaacttcatctgtgtgtaccaaacctgtcacccctcttagtagtcctcaaaagacaagacttcaagggagagttaatattctcagagttcatcagaaatacctgtttccaaggtcaagacccaccttagaaaggaggtcttcatataccctgtctgtgcttattttgtgttttcacaacacaaaatattttaacgatgatttaatttagttgtgtattgatagtctctgtcaatctctcagggttttttttttctgagggaaaaaattacattttgtaattttttaatttagaaacaacagcaataacaacttgagtcggtgacttctgaaccatttttgttctgattatcactgtaaacctaaatgtgtgaacactatcagtagggataatatttaccctatgggactgttaagcaatttaagatgagataagaaatgtcacagggaaaaggtgttactccacacatggtagtcgttattatttattgggttgaagtgttggcctcccaaagggcaatggtgatttaatagaatataagcaactaaatcccaggttaaagcagtgaattcctaattgtagaattttcctgttaaactatcaggtgggaaaggcctgtcaagatgtatatggaaggagtgagatccttgaaataattaatacacctggtataactcccatcattaggtaaacctgggctcatccctactagacagtaatagaaaattagaggataaaaggatagtcacaaaaataaatagaatatattgaaagctaactatgtactaaacagtgttctaggcatattttacatttattaattcatttaaacctctcaactccctataaagtagacattactaattatctcccttttacaaaaaaagaaatctgaacctaagagagtttaaaaaatttgcccaagaccacataatcagaaggaagattttgaatctgatttttcctcacagcaaagtccatgcattttccactttatcacaccggtttttgtttttgtttttgtattattatttttgagacagagtctcattctgtcacccaggctggagttcagtggctctcagctcactgcaacctccgcctcccaggttcaagcgattcttgtttctcaggctccagagtagctgggactacaggtgtgcacttgtattttttagtagagacagggtttccaccatgttgcccaggctggtctcgaactccttttactcaagcaatcctcctgcctcccaaagggctgggattacaggtgtgagccaccgcacccagccaatcacactgtatttaatatcacaacgaagtgcagtctgcccttctcaggatgatcttagatctatttttcagcaagtcgcattcgggtggagcaaaagcttttaaatggtggtcaattacacaatgattaaatttagtttaccattataggtcaaagggaagtgggaagagtttgatgactgtgtatttgtcatgtttctagttatagtgtacaactctgcctgtttatctgagtgagtgccaagaggtgaggtcagggcaggggctcttgcacatggcacatactatctgccccacagctattttgacttggacagtcattgtgctgggtggtaaaaattccagtgggctgggtaggacatactggggccctgtttcctctcatctgtgtttgagaactaggcagcattgcatcaaatggaaggaacaagtgatgagacatcaggaaaatatcagaatgaaagagaaatgcaaggctctaaaggaagttccaactcacttcgacaccctccagttagcaaagaggtgacagaatcccaaaagggcaggggagagattatggatagcaggctcctggaggaaaaactaggtatgtccagtagcagatctgtggaaactattagaaaccgagctaattgtggacttcttagcatgcctcaggaaatgggaaggaacttttcccttttgggcttgtattttttccaattttccttgttcgggaaataattaattctttaagcaatgtaacctcctgctgtgatttctcaattccacaaaagagaataattatagattaataatggaccaaaatagaaaaagctaaatgtgtgtagcagataagtaggaaatgttctgtcttgtaaagggtattgtttcggtgcccggcaacacagaaacaattctcatctatgcagctctaaatggatgttagaattcacccctctttcctactggtataaaattttcagtctcagtaggactaacgctttgacacatcctaaacctcaccaggagtaggaaatatttctcatagcataaatattttttcttccttgaactgaaaggtttgtggccttccccatgcatgataactgggcagttttcagaatatacctcacagtaaaacttagacttcacacctgtaatcccagtactttgggaggccttggtgggcggatcctgaggtcaggagatcaagactatcctggccaacatggtgaaaccccatctctactaaaaatacaaaaattagctgggcgtggtggcacgtgcctgtaatcccagctacttgggaggctaaggcaggagaatcacttgaaccagggagtcagagtttgcagtgagccaagatcacaccactgcaccccagcctggcgacagaatgagactccatctcaaaataaaataaaataaaataaaataaaataaaaaacttagacttcaagttttaactattgaaaaacttccatgaattgggtacagtactgagctaaacgttgtatatatgttatttattcaggaaatattttcaggtactatgctgagtgctaaaagcattgttctgccttttaatactaacaatgcctgtgaaaaatatgtaggattatccagactttataaatttaaaacattaggattcagaaaagtaatatgcacatgctcctatactttacatgtgacagactggaatcaaatggtttaggatgccccgaataactgaactcttaatgccccagaagcccagatcgggacccaccactgggagttacagccctctggagccagcttcagaggtgcacaggtttattctcttccctattcaccagtgaaagaagcccagagcctccattccaggcactctgtgcttcccaaagtaacaattacttaatttgacaagataatttaaagagattgccaaaataacttacaggagattgccagtataatcagccctcccatatctggggattctacatttccagattcaaccagttgaagagagaaaatatttgaaaaaaaaaatttaaaataatacaaataaaaacaatacaacatagtatttatatcatattgggtattgtaagtaatgtagagaccatgtaaagtatatggaaggatgtgcataggttatatgcaaatatgctattttatgtcagggagttgagcatctgcagattttgatatggaggcaggggtcctggaaccaacatcccatggatacctgagggacaaatgtaatcaccatgttttcccaggtggatttttaacagtggccttctggagacactatgcctatggtttagtctaattgttaaaaattgggataggtgaagaaagatggcagataggcacaatgggaggcagatatttccataaatgccttttaaatcagatcctttctagattcacttttggctctggatctggaagctatcatcatggcaaccccagagtcccattggtttgcctattggttaggtgggccaaggtgtccacatatcacaaaagagttctcaaaaaatttcttcccaataacgagggagatttatatttaagagcacctttagccaaactgaaggaagggaaagttcacaaatatggtaatagctcaagtcaatgaattagaggctttgtgtagggtaattgttgagacctccccagttgactgaccaaaacaattctttgttggctagcagagttagagaatagaattttgcataatccaagtatttcatataggtcccttctgctgttactggagcactagtgagctattgtatttgtggtcataatattagctgcataggtagttctataaatgtgtctggttaataatccacaaacgtcagtgttttacatttgtaagtaaagaagtctctgtccacagcaaaaacgttaccaggcaatattttttagcattaaaaatataaaataaaatcaagttacttcaaagttctaaagaactagaagtcaataaaattcataaatatttatttttcaataattctggatgtatcttaggatcctaatataggatgtacatcctaatatagttatgtttacctgtcatttattttaattgatatatgccagtacttctatagtaagattttattggtaaaatgttttttattcttcaaaatgcagattcctttcatagggtatattcatctaccattttccattctttgaaatctgaaataagtcctaaccttatacattcaccaggagtgtgtattaatcacttctcacactgctgataaagacatacctgagactgggtaatttataaagaaaaagaggtttaatgaactcacagttccacatggctgggaagacctcacaagcatggtggaaagtgacaggcacatcttacatggcagcaggcaagagagaatgagagcaaagcaaaagggaaaacaccttataaagccatcagatctagtgagacttattcactaccacgagtattgtgtgagggaaaccacccccatgattcaactgtcttccaccaggtccctcctacaacacatgggaattatgggagctacaattcaagatgagattcagatgggaacacagccaaaccatatcagagtgtatactttcattttattcctcaatcttcattccttaagttttcaacaaataatttgcttttgaaaggattaggagcttaagttggctttatagttatccagtaaccttttgatttctccaaccaatgatttgtaaaggaatcttcagattcagatttatcctttcctacttcatcttcaattgctaaattaagcatgagtcccatcactgagataacagtctttcttggacagagttatgccaggtctttttctatgtaaagcagtcatctattaggctgtcgttggtctgtcaagatgaaactgtgtgcattggatccatgtgaatgaacatagaacattatacaaatattgtatgtttctattctttgcttgaagcttctggttacttagatcttatagtgcttcatagtataaaaaatggttaaaatacttaaaagttttaaagataaagatgtcagtgtcacagtgcataactgggttttacatggtcaagtatacacacatacacacacacacacacacacacaatttaaaaaatctctgatgcactatgccatactcagcaccaatccccattacaactctcccaatgtttcctggccaggcaggtcaccaagatgtttgggactgtttatgcctttgcacctactcatcataatattgtgtggggatcaatgggagagatatttggcccatttttaagccatatcaggggatcttccacttcctaaactcacttagacttggaatttaagtctagactattttgtttttaaccttgctaacacctacctacctacctacctattcattgtccatagcctaggtagtcttgaaaaaccctccattcccgcagcttcccccaatgcctcctctgaactcagtgtcactcctgtgtgcctcctttagtgttttttttgtttgtttgtttttgtttgtttgtttgtttttgtcattgcactcaccaccttatattgtaaaagtctattactaaggaagtattcctccctcctttatgtgcagaattccttgacagaaaggataggtcatgtttacctctgtcttgcctccaatgcgcagcatgaagcctggctctatgatcagctctaaagaaatgcttgttgatgggcaaataaactcgagaatctcacaccagagccagaccggaagtttccttcatttcatgactggttttcacaaaaacaagcattagggagagtggaaggaagagcttgcaaaataccttactactgcattatgaatgtggagttgtaattttgaggttcttatccatgaagatggtccttaaaattcagaattttaattaccaacataacaccatcctttcttactagtatcattattttatactatgttttcagtaggacatatctgatggaaatacatttcttttgatattatttattataactggtgagctacattccacccaatagtaaatgcctctcagcaaaaagatagatacttttgatagttaatatattcagatattatgttgtttgtggaaaccataacttaataaattttaaaacagtgtcttctttaaaagtaattttttattaaactttgtattttgaggtaattgtagattcacatgcagctataagaaataatgcaaacaatactttttacccagtttcctccaatggtgacatcttgaaaactatcgcacaatagcacaactttgatattgacactgatacaatcaagatacagaacattttcatccaggcatcccctgtgcttagcccttttgtagctacgtctacttcctttgcccaccctcaccttaaaaccctggcaataattaacattttgtcatttcaagcatgttatataaatggaaccatagagtatataactttcaggtattggttttttccaatcagcataattctttggagattctttacttagcatacttctctggagatttatctaggtgcttgtgtactagtagttcattctttgttatcgctgcatagtatttcatgctagggatgttgagccatttacccattgaaagatacttgggttgtttctagtttggggagattataaataaagctgctataaatactcatacacagatttttgtgtaaacatacattttcatttctctgagataaatgcctaggaatgagtgtgatttctagatctgatagtaattgcatgtttagtgtttttaagaaaccaacaaaatattttccaaaattagatgtgccattttatattcctaccagcaatgtgacagcaattgtttttctgtatcttcaccagcatttggtggtgttactttttttattttagccattatgatcagtgcatagtgatagctcattttggttttactttgcatttctttagtggctaatgatgttgaacatcttttcataggcttatttgcatctgtatatcttctttagtgaaatgcttctctgttcctgttgcctattttctaattagattgttttttgactgttgagttttaagagttctgtatatattcttgatagcagtcctttgtcggatatgtgatttacaaatattttctcccagtccatagcttgtcttttttattctctttactgtttttttccacaaggcaagagcttttaattttgataaaaataactttttatacttaattggcaaccaaatacctaaatgtcttttgatagaaaaacttgtcctagataatgtaaaatcattttacatattcacagatccatctccactaatgtcatataagtttaaaaatcacaaagtaatttgaacagattcctaaattataaattagttaacagttattttttgctctaatctttagttgtacatttacttcaaataaacatttgttaaaaacgtactctgtactgaggaatgaggatacaaaactcataatttgtcatttctttgcttcagggacttacattttactggattacatctaaatttttatttggcagttttattccaggaagatcatgacagtcttgttttctaaatcttaactgccttttgatgaaaaagaaagataaggctttaatttctctagtgaaacctgaagaagtaaaataaaataacttgtatgtcccttcacaagccacagtcagaacactgtcacaatctcgacctttgctccccaaaccctattttgcaaaccagatgctatttctttggacattacaggctattttcaaaatacatcagaacttaacaaaacatcatattagctaaatagcactataagaaactgcttataatattaaaattatgtcttgagtttataattatataaaaattgaatctaccctagagcaaaaattataattaactactaaaaaatcgaataagtgatttttttttttttttttgaggcagggtctcactctatggcccaggctggagtacagtggtgtgatcatggcttactgcagccttgatcttctgggctcaagcaatcctcatcctcccacctcaacccctccagtagctgagaccacaggtgcaccccaccacacctggtatattagtttattttcacattgctgtaaagaactacctgagcatgtgtaatttattaggaaagcaggttaaattgattcagagttcctcctggctggggaggcctcaggaaacttacaatcatggcggaagacaaacaggatgcaaaacacctcttacaaggtggcaggagagagagagagtgagaggggaactgtcacacacttttaaaccatcagatctcgagataactcactgtcatgataatagcaagggggaagtctgcccccatcattcaatcatctcccaccaggcacctcccctgacatgtggggactacaattctagatgaggtttggttgtggacacagagtcaaaccatagcacccggctaattttcttttcttttctttttggtagatatggagtgtcactatgttttgtttccctagctggtcttgaactcctgggctcaagtgatctgcccacctcggcctcccaaaatgctgggattacaggtgtgagccagtacacccagccaagaagtgatttgtataatggcaggattatgaatgattatttctgtgtctttaatttgatcatatttttaaaacagtcattatttttggtcatcatgctatatactacagagagcagtttttaatttgtgaacgtgtaagtcaacttgatttagctgaacatagcagagtcatcaatcaaactgattgatgactaagggtccgcagggtaacacatcatcatagttgtttccatggtgatgaattatgatgtcacaaactcatcaagactgtgactcagtgaaccatctagacagaggatgaaatgcagtagttcaccaacatgtatgccatctttgtattatatggtattattaattaaaacgaagggctgagtatttctttcattgagattacatgaagatattacgtatattcagacttgcctgaacacggctatgctggttttaaattgaaggttttcacaaagcaaaaaattgagaaacagaatttgacatagaattgtgtatttattagaaaagatcttttcttctcatattctgaaaagcacactcattaattacagttaaattcaggcaaatttggcaaattttcgtcagtatacttattcttttgttagttaatagctttgcttttcagttttagatattggtattaaatatataaagagaaaagaccttagtgttctcatgctcagagattaagagaatagttataggtttgaaattaggcactttccctgatagtttttgttggtacatgttttaggttatgtttctatgaacaaccagatgcaaacgtcctggcattcatcctgcctgcttgctgtttgtaccatctccgtggtagcaaccatccaagctgctggaagcacagactgagctctatgagtcaattattttatatacctgggaacgtgctagccttcctgtcactctttgatgtcactatgtagacagtttgcagcctaggcaacatggtaagaccctgtctccaaaacttccaaaaattagccaccaggtgtggtggtgcatgcctgtagtcctagctactctgaaggttgaggcaaaaggaaccctcaaccccaggagtttgaggctgcagtgagctatgatcgcaccactgcactccagtctgggagacatagtgagatgctgtctttaaaataataataataattttaaaaattaaaaaatatctagacaatttctctgctttcaagactcttcaaagatctcaaagagaagctttactctggagtctcaacagaggccattcaaaaactcaacctggtttttcaacaataaattagaaatgtaatgctaacagtaggtgccaaggccgaacatcagggaaaagacattagtgaccttgagttctagactagattttaccagtttctgaccttcaactctggtactcgattttctcataaatgtgagaaaatatcttaaccgtatcacagaattgatgtgagaattcaaaataaagcatatttaaagctcctaggttagtgcttcatttatgaaggtcagtgcttcataaatgatagttatttttttccattcaaaatagagataaaaaagactttatctcactaatgtgtcatgcaaataaggattaatcctgttttctattcctgaagcatacagaatgtgatttctttctccatcatttccatctgactatcatctgggagaacacacagctgctccacatctggtgcaacacaggcagatgtagctgtccagagggagaagagtgtttgcttttctccacctaaacactgaccctcttctgcttagattcaaagactgtcttccttctgcaggtttacctgagcctggactcaaagaattaccttcattatgagctaaaggaagtcaggcccattcttcttctgcctggcccctctggctctttggcacttcccacatcctcctcatttggaaaggcttcatgactttctggttcacaaagcagctctgttgttgcttatttccactacagggaaaaagtgaaacacttcactcagggcgcagaacaatggaagtccctggaaggaaaggcttgcaagagaaaaccaagtggcttctgagatattcgaaagtccagttgttttccctttttaaaaattttcagatgctctttgatgccatttcataaagcctgtgattgggccaaaagtcttagttcaccatgtaccacaaatagtgtactctatatagcatatgcttaactaagaaaaaataaagatttagaaatagatgtattgaggacatgccattaaaagcagcttccattgaatcaactgtttttcagagtactgtcaagattaccttaaactagtctaatcaaggtaggtggtggattccaaacttgggaaaaagtgagtctttgtattctgtgaagtttaataactacccaaggaagaagtgttggatacaacaactatgagtatcttagaaagtatgtcttttttttttttctgagtcagggtcttgctctatcacccaggctggagtgcagtgatgtgattataactcattgcattgcaatcttgaccccctgggctcaagccatccttccatcttagcctcccaagtagctaggactacaagtggatgccaccatgcccagctaatttttttcttaatttcatttttgtagagataggatttcccaggctggtatcaaactctcaaacttcctggtctcaagcagttctcccaccttggcttcccaaagtgctggcattataggcatgagccaccacacccagcctgggtgtctgtctttatgctaaatgtccgagcctttccatttgtcttttgcctcttcataaacctctgctgagctttatcaggtcattcacatctttcattacaggcaagtggtaaacttagtaatatgcttcctctggtgacaatgggcaaaggactagaagcataagtaaagaaatagtagactgaaataagcggattttgacatgcaaaaagatgcagcaaggtgaacctggttaagaaatagactcagagagcttgaacatggaaggatgctaggacaagtggcagctaaggcagaaagacagccatggttccagatgtctggggaaacaatggaaggcagatattacaaagttttccattttgtaccagaagtgtccgtatgaacacaaactcctagtaagtgttcttaattgttctgtgggctgatgtgcatttttctcctacaataggaactagcaatctacatattatttaccaagccttcctagatagaagcatttatgattattttttgtttatataaatgtcttgcatttactagaaaatcatgcttttcgagaacgcatttctattatggagtttcttaaagagagaaaaaaaatgtatggctttagaaaaatcctagtgattttttgacagtatgaactgtattgtgtgttcttgtcttggatcaatatcatggcacaatgctttgatagtgtctgaagattaagatatacaatacaatttcctcccttcccttctttcctttttccttccttcctttttcctttctttcttttccttccttccttcctttctttttctttctctctctctttctcttccctccctccctccctctctctttcctctttctttctgtctgtctgtctgtctgtctttttcttgagatagggtctcactttgtcacccaggcagaagggcagtggccctatcatatttcactgccacctcaaattcctgggctcaagggatcctcccgcctcagcctctcaagcagctgggactacaggtgtgcccctccatgtgcggttaattgtagttttttgtttggggtggttttgtttgtttgtttgtttttgtagagactttgttgcctaggctggtctcaaactcctgggctcaagcagtcctcccactgcaacctcccaaaatgctgggattataggtgtgagccaccatgtccagcccaataccattttcttatgtttcccatatatgcataattttacttgcatgcaattctgaatggatgaaacatgttttaatcacctatttttctactttgtagaagagccaaggtaacatgaactaaatcattaaagcagttgacttgttagtggattgtgataggactcaggcatttcccaaagggggaacccatattttggtaatcccagacattttaattatatttttctatccattcctcaatgccacaatgaggaacagcattctttcctgggaagtctcacaattttgtcaaaagtagaagagttgcctttgacgaatacaaatccagcaataaagaagaacaggtctaacaaatgaggccaccttggaaaatgtcattttgcccctttgagccttgcccatcttacctttagaggaagagatgggactgaatcagttcaaagagcctcgatagctttaaatgtctgtgattgatttttctgcagagcaagatcaaacaaaacagtatttcctagctgctgcccttacatgtagtggtgattcacagagaatttggggaggaaagtagccattatgggatgttttgcaaaaggcaataccaagattgatcatcacctgagggcgatacactatagttgttcctctgtatccatgacagattagtcccaggaccccttgcagataccaaaatccacagatgctcatgtcctgcttataaaatggcatagtatttgtacacagccttgtatatcctcctgaatactttaaatcatctctagattacttataatacctagagttgtataaatgctatagaaagtattgttatactgtatttttaaatgtacattagttttattttttttccgaatacctttttatccatggttggttgaatccacggatgcagaacccatggatatggagagctgactgtaatagtcaaagacaagagtggctggtggtaagcacactatctgtccacaagtgaatttcccctaagaatcctgctggtacatttcttcatttcttgagattattgaaccacgtgatttgcctcactgcttatttcaccttctgggtgacatgggctgtgaatgtgcagttcaaggcctaaatattagccctgattcaaaatggacattaaccaaaaaaacaaacaacaatgatactggccaactgacttctctcacttctctcttctcttttctttaattcattccttacctatttagaatagctgaggctcatttttatcttcttatgacagccagaattgtcatctattaagattaagtaaggaaggcataattgatattcacaaaccaccccaggatttatcagaagtgagggtgtttcatatggattactaattgtctaaaatttggctctaagcacctgaagatcactaggcaggagagaagagtagggtttgttgtacatgagaagaggctgtggggtggggatgttcaccgagaagactgctttggtctttgatactagcatttttccttctatatggttaacaaggcacatattttcatttttatatccccagaataaaggcttgaaaggaaacaaaatctcaaataaatggactaatttgttaaattctggactaaacctcagtttattttaacagctttaacaacggtctctggagctcataacacatatagagcactattggtgtcacacaaaaccttgaaatcagaattgccacagaccgaatctgatctgaaatggcatttcattcaactgcagctttgtgtcacaagaacctgtctctgttttcctaacatgggtatgatgcatattcagaagcagccgagtgatttacttcttttttcattacgcttgtggatttgcatagattcagaaggggcatcttctgggaggtataagagtttatagaaagactaatttcttgactaggcacgatggctcatgcttgtaatctcagcactttgggaggccaaggtgggaagatcacttgagaccaggagtttgagaccagcctggccaatatggtgaaaccctgtctctacaaaaaatacaaaaattagctgggcgtggtggtacatgcctgtaatcccagctactcaggaagctaaggcacaataattgcttgaaccagagaagtggagattgcagtgagccaagattgtgcccctgcactccaacctgggcaacagagtgagactctgtctcaaaaacaaaaaaaaaaggaagattgatttcctgtagacagaaggagtgtttatattggcagcagcaatgcagatcaaaactttggggtcaccctcttgaatatcttatttgtatttcttcttgggttactaaagtcttgaggagaaaaatgaataaaaggcttaagaggattctcatttccatgcaaagcttctccacactcctgagagaagtttagggtcaggaaggaaggtcagacaatataaacctcagcactattcagtaaaatagccatggggaaaaatatggtaagtttgtcttaattcatacccaaggacatttagcgctcagaaaactaaaatactttttatttatttatttatttatttatttattttgagacagagtcttgcactattgtgcgggctggagtgcagtggcgcagtctcagctcactgcaacctccacttgaacctccaggttcaagtgattctccttgcctcagcctcccacgtagctgggattacaggcgcccaccaccacacccggctaattttttttttgtatttttagtagagacggggtttcactatgttggccaggctggtcttgaactcctgacctcgtgatccacctgcatcggcctcccaaagtgctgggattataggcataagccaccttgcttggccctaaaatacttttaataagattgtctcatccttctcttggttttccaatggaaatggtggtatagcaagtccatctgaaacacttctgcaaaataacaatgaagctaatcactgtgggaaacatttacatcatatgtatttgcatacagaggaaattgataatcttgagacatcagcatactagaatagcaagagacatgttttattctattatattctcttagtcagcaatgtttaattgttgcttaaaggaaactgaataaaacgtgggcgcagtggctcccacctctaatcccagcactttgggaagttgaggagagaggatcgcttcagcccaagagtttgagaccagcataggcaacatagtgagaccccatctctacaaaaaatattttttaaaattagtcgagcatggcggtggctccctgtagttccagctacatggagggctgaggtgggaggatcacttgaaccagggaggtcaaggctgcaccctggcctgggcaacaaagccaaaccctgtgtcaaaaaaaaaaaaaaaatacgtaaagcaacagtttttctataacggattgcatggtaaaaggaaggatgactttcttactataactccttatgataattttttccaaagtgttaatcttaggggttgaaatttttataggtaatcattaactttagtagaacattattttaaagtttaggtatttcatctgagtatattactctggctttcctaagctagcttagttatatatgttcacttcagtttgagtctccactaaattttaacatgaacaaaatattatatgcaacaccatagaagcaattgttaaatcattgttacttttaatatcacctaaatctaacctaagtaaatgtgtttatttttattaccaactgatgtagatatacccacatggacagaaaacagcataaaccaccaaaaggacttgaaaattccctcttcaagacttcttttgccaatgactaatgtttaatgctatttgctagagattctggtgccaggaggatttctaaccaggttattttatcaataggaataaaatatcgagggcttaaattagtgtaatctctcaagatcttgaatttgacgttttcataatttttacttaatcatagctcctggggattggaattactcttttagctggcccgagtctgggaggaggatccaaagtctttgagttgttttcttttatttctttttagcccctaaagcactggaaatggttggccctgaagtgctcctaaggtaaccgcaagatgaggcaaaacaggattgagatgaaaaccaagctcacccacatcctacgtcaattagctatttttttttctgtgtaaacaatgggagggaggtggattgtagcttttatggtagaggttcctcggcacctcctgacgcccccaggggtcccccctgccactgccctcagcccaaatataagctgacaacaaaatgtttcttcaaagtgctcattgtttactctattctggcttcttcttaaaggtcatcatcatgttgaattatcttgagaaaatcctctgaagtgtatgtgtgtgtgtgtgtttaggaaggatgtgaggaggattgggaggtgagtctctgaataacaagttgaaaaaagagtatggaggaaagcggtgtttaaaattgtccaaagccatcggccgggcatgatggctcacgcctctaatcccaacgatttgagaggctgaggtgggaaaattgcttgagcccaggagtttgagaccagtctgggcaacatggtgaaaccccatctctacaaaaaaagtacaacaattagctgggcatggtggtgcatgcctgcagtcccagatactcaggaggctgagatgggaggatcacttgagcctaggagtttagggctgcaatgagatgtgagtgcaccaccatactctagcctgggcaacagagcaagaccttgtctcaaataataataataatatataaataaacaaataaataaaattatcctaagtgaaatcagttgttgatagaactgaagtacatcaagcctagtgggactgtggttgtctctccagcctaaaaaaaaaaaagaacaaaaacaacaacaaaaaaacttaactccaaaattgctgttgctccatttatttcaggtgtaagacttctttgagatttaaaaacaatataatcatttacaatgtactttgttggacctaagcataggaaaattcattcattcattcattcattgagtacctgttatatgccaggcaatgcactaggcaccatcaaagatgaataagctatgtgctaaaattcacagtctaacagaagaaacatgaaagcagagtggaaatatactgtggcaatacatatttggatatactggtattaaaaagtaaggatgtttcagctaaatcttttttggtgtttattttttaaaaattcatctattaacttcctacacaccatgcatatattcagctaaatcttaaagtatgagaagaaacatgccattcatgaaagggaagagggagccagtgcatcagatacaacctatgcaatcgtgaagatttatggcagagcacaggatatttggggattggcaggcatttcaaaatggctggcacataaagttccgggatgggaacaggctggcaagagaagagatcatcggagccaaagtaactgaactgtgattgaattttagatatgataatatctataggaaacctggcaacccggtgggcaggtaaatatgatagagcgaagatagaatcttcaggccttcaggggactaagcaggaatagaataattttattgagcactttaagtggacattatgctagattattttacatatttcatctcctttaatttacaccacaaccctgtgagtgcaggttgataaagaattaaataaaatccaggtgaagtagcagcacctatagttccagctacttgggaggctgaggtgagaccattacttgaggccaagagttccaggctgtagttcacaatggttgtgtctgtgaatagccactgcactcctgcctgggtgacacagtgagacctcatttctaaaaaagaaaaaaaaaattgagacagggtctcgctctgccacccaggctggagtacagtcacgcaattacagcttactgcagccttaacccccaggctcaaacaatcctcccacctcagcctcccaaatagcttggactacaggtacatgtcaccacacctggctattttttgtattttttgtagagatggagtttcaccatgttgcccaggctggtcttgaactcctaggctcaaatgatcctcctgcttccaccttccaaagcgctgagattatagacgtgaaccactgcacctggtctagaaattatttaataataaaaaaatgaagacagaattcaatgaagagcatagaagagtctcttaaacctttgttttaagctatgagccaggaaagagatggtggcaagggtgagatggttgcagtgcttttttgttcacttatctcaggcctgtgtgttctgagttaaagacaagtcagttggcaagagaaggagagaggaagcttcccagaaccatttgaaggaaaatttggaaagtcttctctaagggagttgccctcaactaccttttaacacaaatggaggactgaaaaacaaaacaaaacaaaacaaacaggaaggaattgcagatatacagatctttggcctttcaaactatggtatctcttagtactattttatatattgataataattataatttttctcaaacttcccaaaagtggaacattgtgggaaataatatgggagtggacatttgaatttctgtttgactttgcagcagaaatctcttttctaactctctctttcaatctcaccatcagagccatctgattgcttgataacatgattctttttgcccagcccttgttatcctccctcctgccctagtcaccatgacataggctccactcatttctacctaggaacctggatgcactgctttgcactattgcctcctggcaaaacagggcaatgagaaaggaaatggaagcccaaattcagagccctccttcccagcacaagaatgaggagatgccctttttccccggggagggggattcttccctctctcttcagtaattgtctttatcactgtcatgttctagccagtctttattatccccgccacacaaatttcatgttcttctggcagtcaaatcaggaaattcaaggacacaactgctctggcttcgtaaagatggggatcaaattgtttgagttgctgatagcaactctttgcttcttgattctccatgcctcctcaagcttttttggctgaacttttagccttggaacagggtcactggaaaatacttcttaatatccttaatttctaattctaatatttgccttgtttcattttgtttatttggggaggatgaagttcaggtgttcacctatcaaactcacttccttcttttttttagacaaggtcttgctctgtcgcccaggctagagtgcagtggtatgatgttggctcactgcagcctccacctcccaggttcaagtgattctcccacctcagcctcccaagtagcagggatcacaggctcgtgctaccacgccccactacttttttgtattttttggtagagacggagtttcatcatgttggccaggctgatcttgaactcctgacctcaagtgatctgcctgcctcgacctcccaaagtgctgggattgcaggtgtgagccaccgtgcccagccctaacttccttctgatcaagtcattctcaaaaataaacatttaattgactgtcaactacaatgataataagacaatgtttgccttaaatgagctctaaatctagttgaagggataacacatggaatggactggtaataaaaagtgggctttgcttggtgctacagttgtgatgtgaactaaagagggagtgttttggactgactttgagttggggaggctttatggaggaggtgacatttgagttgggccttacgttgtattttatgaaataaaaaaagaggaaagacagtccaagatgagaagacagtataaataaagggacagaggcatggaagggaatttcttggccaaaggatagtaaaaagtacagaaccactaaagtctagagcacataggctagaggctagaataagtgagaaatagctaatcctaggaagataaattggggcttaattgtaaaaacctttgcatgctatactaagaagctttgagttcattctcttggcaactatgagccattacatgtttcaaaagatagatctgatggaaaaacagaagtatagagggtaatattctaatgtgtaaacttctactgtgagtccaaaagaatatggtatctatctctgaaccatgttcaatattttgcttagactgttcgaactatgtaagaataagaaatactaaagtgttttttctctgatataatatttaaataccttttagctatcaattccttctaatttccctttaataagacatttactacaaatagacatcattcccatagcaatcttttcttgagacaaagaggtcagtaggccaggttctgcatagaatataagctatttttccattttagaatgccactctccattgatgtctactctcgttaagtagaaaattccaagaagtactaacaaaattatgttaatttgtgtatgtactgacttccagacatttggaaccagattctgaacctgtaactcatttaaatcttgccgtgactttggtttcccaagttctaggtctttctctgaaaatttaaaatgcttctggaaagatattttccatgacacttttgccttaggaaaaaaatttttggtcaacattggaagaaaaaaaaactgagacaacatatatcttgctccttaacatattctgtatgaaattaaggtcttattgacaatctacgtatcagagcctcgtacacaggagctattgaaatgatgtgtcagttcagaaaatcatgttcattatttctgattctcatcataaacaagcagtaaatcaccgtataaggggtgtatgcattagggcctcccacataaacttcacctctgcgtgtgtaaacattttcttattatcgcaaataatcaacaggagaagagcaaatgcaagtttagcttttctccagaatgtttatcatggttactttaaactgtttataggaaagagtgaactataaatgtctttcaggaggtgggtaggaccatatggctcagaggcttttctgcagtaaaatgtttggttaaattttaggcaacagacagtccttccacagcaattatttgtgatttcgagcatcgttgttgatactcaactcctgaaacaaataacaccgacctaaaacatttataataactgaagaaaccaggttccttttaaccctgctaggatccagctgcccccttgcaacccatccccagtcagctgcagctcaggcaagcccagcctttccatccctgcacatcagactgtggtgcagagaaactccctgtgttcttcaaaacaaacattggatgtaatccacctcaatcttttccatggtgaggctttacaaattttagttttctctaagaagatagcctgtatattcaattgcctgggtaaaagtttaatttctgatgcgtaaagcatatcctgccttgaaaaatatctcaggaaaaataaaggccacaacagtttcatgtgtgcctatatcaggattgctgctgagtaagttgtgaaatgtttttggatttctgagccatttggatttcagaattgtggaggaattctggatctgtattttattgtgtattaccaattattttcctttctcttttatgtgacgggtagtattttgattatttaaaatcatctttgtagaaaaattattggcagctatgaatttcatttcaagatatttaagatgccttagaaacttttctaaaaacagtataataggattgagaaccactcatgtatggcctttactgtttcgaggtttttcttttttgacatgtattatttgatgaaaccctatgagattaggtctttacttccgaaagaagaaaaccaaattcaagggcaattaaaaacttgtcaaatgtctcaattttagtaagaaaaaaaaccgacattggcctagatcttaatctgtgcccagtcctcttcccatccctcttttttttttttttttttttttttttggtggctgctctcaaatttttgggctcaaatgaacctcctaccttggcctcccaacgtgctgagattacaggcatgagccaccgtgcctggccagctaaggttaatttagtattgaagaaatatttttgttatgaatttagtgtagccaagtgtgcagtgtttagaccatctacagtaatgcacattaatggcctaggccttcacattcactcaccactcactcactgactcacccagagcaatgtctagtcctgcaagctccattcatgggaaaggcctcacacatgtataacatttttttgtcttttattctgtatttttctatgtttagataagtttagatgtataaatacttatccttgtattacggttctctagtgctcagtacagtgacttgctgtacaggtttgtagcctaggaacgataggttataccatatagccaaggtgtgtagtaagctgtaccatcttggttcgtgtaaggacattcagtgatgaaattgcctactgacacatttctcagaaggtacccccatcgttaagcaaccattactgtattagaaagcagaaaaacaaattcagctccggacttagcctacccatatagcatcattggccagaagaaaatcactttgctttatgaatcccagttttctgcgggaatgaaatgaggtaccatacgtgatcctaccagcataacacctgccaaatagtgcacattcaatactaaaccatcctttttatgcctataaataaaggatttgtactatatcaagagcttctctatgtctgaagttacaatagagtaattccaaattatctttcatggaatcaaatccctgatgatcccttgattttctgagttctgtgaatttcatcacagcccaatttgacccattactgctaattcagtgtttttattagtaaattatatttccaagttgaatcaaaacaacagtatagcaggcacagcttaagacacaagataaataagttgttgcattcaccagtcaaaatatttttaaaaaatcaagaagcaatcactgaatagttttccttgatttagataccaattaggtttaatgaccaaatgagactgataatcagagctgaggaactcaatcaacaggattgcaacatgctttttttaaacctcttgaaagatcacatcactacagaataaggaaacctatttatttatttaatttgagacagtctctctctgtcacccaagctggagtgcagtggaatgatctcagctcactgcggcctccaccccagttcaagcaatttcatgctcagcctctgagtagctgggactacaggggcacaccaccacgcccagctaatttttttgtatttttagcagagacaggttttcaccatggtggccacgatggtctggaactcttgacttcaagtgatctacccacttggtctcctgagggaaatctatttatgactaatgctgttctttttactaattgtttcattggctgtcagcccttagaggaaaaactgttcaaacaaccttttattcatagacccatgttatttaattttagaattatttcccatgtatgcacaaccgaattttcattttcataacaagaaaacaaattctttaagtgagaaacagtacattttacacccttccttttcacaaaaatctcacagtattttctgacttatggtcttgataattagcactcctgtttgctcgtgttctctttctttcacaagcaatgtgatcttatttttaaaaaggacctgagacaagtagacaattgacccttgaacaacacagatttgaaaagttttggtccacctatacacggattttctcccacctctgccacccatgagagagcaagaccaagccctcctccataccctactccatctgaagatgaccagggtaaagacctttatggggattcacttccacttaattattagtaaatatcttttctcttccttatgattttctcaataagtttcctttatctagcttactttactgtaagaatacggtatagactacatataacacacaaactatgcattatcaactatttatgctgctggtaaggcttctagtcaacagtaggttattaatagctaaattctgggggagtcaaaaggtatatgcagattttcacgggtggttggacccccccagcatccatgttgttcaagggtcaactgtatatcctaattgttatttgacactggaagaaattagatctcctggccgggcgtagactcacgtctatcatcccagcactttgggaggccgaggagggtggatcacctgagatcatgagttcgagaccagcctggccaacatggtgaaaccccaactctactaaaaatacaaaaattagctgggcgtggtggtgggtgcctgtagtcccagctactcaagaggttgaggcaggagaatcacttgaaccctggaggcagagattgcagtgagatgagattgtgccattgcactccagcctaagtgacggagtgagactttctcaaaaaaataaataaataaataaataaattatatctcctcttagaagtttgtccctctcttcaactgaaatctatcacagttcgacctacatggtagttgcattgatctgtccatcctggtgccacatatagaacatctactttgtcagatactgttccacatacagtaagcagaacacatgatcccagtccacatgaaggatggtgtccagtcatgtatggcctgattcttttctgtaaagtgctttcacatttgtagttggttcctttcctagagcactcctgtttttgcattcttgtagaaagcaaattatttccaccctgtcactgatttttttctccaattcaaacaatacgaactagaaaagagaactcccttgtaatataaaaggaaatagaaatccctatgtattcaatgtttttaaagtttaatatgattcctcttagcaataaccagcaaaaagaaaatgtttctactttaatcttttcttttgaactgaagtgttcctctatgtcatttacatgacaattggcccaaatctctctgttaccaggacttggtattcaaagtaagaggcttcattaaatttcaagaggacttttttggggaaagtttttgtttgttttgttgtgttttatcataacaaaacaaggcatagtgaccaggaagatggagtttctagttagtgcatacatatacatgcttatggttacttaatgtgatagaagcaaattattcagatgcctcttctccacagaaggttttggtcttcagcacgtaaagcaacttttttttttttgtttttttgagatagagtctcactctgtcaccaggctggagtgcaatggtgcgatctcggctccctgcaaactctgcatccggaattcaagcgattctcctgtctcagcctcctaaatagctgggactacaggcacgcaccaccacgtccagctaatttttgtatttttagtagagacggggtttcactatgttggccaggatggtctcgatctcttgacttcgtgatcctcccgcctcggcctcccaaagtgttgggattacaggcatgagccactgtgcccggcctcatgtagagcactttaaaagtacattggatccatagtaatcacttaactatgaacttgtatatccatatcaaaacttcatgttgtacagcttaaatatagacaataagaataaaataaataaatgaaaatattttaatatgctgagccatgttctggccatttttctctggccttatgtagctttagcttttcattctcaaagcatggatcaaagagctataagaagaaattaaccagagactttatcctgattgtttcacatttccaaaggcaataaatcagtcatgggctgagagaagagaactgaagtctaccacaacaaatatatttctgccattttttcttttatttcctataggttttgctttatgaattttgacatgatattttcatcatgtgtagatatcatacctctttatgcttttattgcaggtgaagtcatttcctaacatcactgctccctctcccttctcccagcagttatctatgtgaaacaaataaatgttatttgtgaggttcagctaattcagataattagcattaccaagaggcttacaattattctggaatttgtgtttgcttatttgtttccccaaatacagctaaaggagaggagaggatcaccagatcttatagtaggcaaaactatgaattattagtaaatcttcctcctggctttctatctcactggctgctcattctcattgtccttcactctttctcctctgtttaacttccaaatgccaagcatccctgggagtattctcttcatttattacattcactcaaatggttttaaataccatacatatactgatgacacctaacactctagttctcgtctgtgtctccctgaactccagactcgtaggtccaactgacttctgcatatggctgtccagtcggcatctccaattgaacatcgtcagaacaaaacttcaggcttttccccaaccagctcttctggtcttgcccatctcaataaacaccactgctatctacccaattaattgagccggctatctggtagttattcccttctttgcctcactgtcttctgatccccatatcctataaactctaataccaagtatccctggaatcctttcagtttttcctatctttacttcttctccttagtctaagctattatactctcttgcatagtttagcggtagtttttaagccctttttttatttttattttacgtttgccttttctaacaaattctccttaaaacagccagaatgatctctttgatgtatgatttagccaagtgtggtggctcccactagtaatcccagctactccaggaggctgaggtgggaggattgctgggagttcaagaccagtctgggcaacatagtgagaccccatttctaattaaaaaaaaaaaaaaagaagaaggaaacatgaattagattttgttgctcccttgtttaaactctctattggctttttacttcatttagaataaaatgaaactccctgtcctggcccctatttgatcttatttcctgtcactttcccattgtctgttatacctcacaatcactggactgcagttattgctgttcctccgaactacaggccttagggcctttgcaattgctattttctatggctggaacactttctcctcagatctgcaaaagattggtatcttgtttagtcagatctcaaattaaataccacactctcatagaggccttctctcacctcaggctggtgttggtagcagtcattgaacttcacaacaccttatgttaatgttgtgcagaacacttaccactgcctgatattttactgataggtcttttgtctgtttcctgccactcctgcccctgaaatagaaagcaagctccatcagagaagaactttatctgtttgttcacggcagtaattccaggccttggaagagggtttggcacacagatgttacttaataaacataagagtgaatgaatgaaaattgttagaagacaccatctaaagtgagtcagacaatatgtccagcttcttgtgtgtgctaattaatgacactttgtggactatatatctgtatataactacttcatttcttacagagccttgatagatgaaagtaactagacatttaacttaaaaggtgctaggtcatcttcagttccaggctgtaagcattaagattgactgtacacgacctgttaaaaccattttctgggaaaggctcttaagtacctgtcagagtttacaatttgagagcaaacataaataaacccaaacgcctttcaactttgaacatttgatgcttgaaaatcacctctatttaaatttttgctagtcacatcttctcatcttttggtttcaggacctgattcatcagtttctatagatccatttataaactcagtcagcattttactttgccagcctatgagcacaagtaggcaactggaggcttggaaaaaacccagacaacaacaatttgtttttcactggttctgctttcaaacaacttccaagagcacaatacagcaaaaagtgagagttatctatttctcccttcttcatccgaatacaaaatacatcctattttactgctttttttttgtcttttgcctctactttaagacttatctaagaaataaagaaaagccaaccactcgttctatccacagaagaaaaacacacaccagcatagacaacacaaaagactgtgtctagatgttaagactatatatcctataggactataattttcatagatctaaaaagtgagaaacatatatatgtataaaattatgtgggatgcaagttactgagattttgaatatggggctctgtcatttaccctaaaatgttcagtggtcttttctattttttctctattctcagtaaaatagaactttctcaacaattctggctcctactcttccaatgggctcagcttgtctcatgatttaatagtactaaaaaccttttcttaaaaagaaaaaaaatcctttttaaaaaagtttaggtataaataagaaatttctatattatgaaagactggtttgcaaagaaactttaatatcttctggatctcatctcaatcacagtctatgaaggaaataaaataagtgccttctaaaacggcctattatactactatagctgttgtctataaggaaaaagtttgttagtgagttgtattcaatagaaaacctcaaagatggctgggcgcggtggctcatgcctgtaatcccagcactttgggaggccgaggtgagtggatcacttgaagccaggagttcgagaccagctttgccaacatggagaaaccccatctctactaaaaatacaaaattagctgggtgtggtggcgggcgcctgtaatcccagctatttgggaggtgggagaattgcttgaacctaggaggcggaggttgaaatgactctagatcatgccgttgcactccagcctgggcgacaaaagcgagactctgtctccaaaaaaaagaaaagaaatcctcagagaagatatcctagaactatttagttttcccttaatcgagtctgaaaacctcctgtgcccttccaccacttaataatctaaccaactattgtaaaattacctattcttctaaaccaccaaatagttcgaatagaatagccttagatatctaataactaaatgaaaccacagtttacctctctaggcttcagtttcttcttcataaaataagaagcttgaactcgaaaagttttagatgcgaagttcccaaaaatctagtagaggaagcaaaactctgtttggcaccctgtttccttgccctggacttttagcatttctttcttctggtgtaaagtcaaacaaaaaatagagatgaatctctaaatttacctttttattggggagataagagttgcaatacagggcatacacacagacctgatagtcttctgtatgtcagaagaacaaagagaaggttggaggttttacgaaaaggagaaatgtcttgtcctgaaagaaatttcactggcactagtaaagttgtggggagtggcaacctctgattggtgagtgacaacagtgcagtaggtaaaactaatcttagactcacagtggttgtcttagctgctattagataaaagtgatttcaggttacagcaggcagtttcagcagctaggtttgcagagaattacattcctagaacatgatattttaatatacatatccattgtgaaataaatactataggcaagcaatttaacatatttatcactttccatagttaacatttttgtaagagcacataaaatctacttattctgcagattttgaatatacaatacaatattatttactataatctttctgttgtacattagatctctagacacactgattctttttttttttttttttttttttttgagacggagtttcagtcttgtcactcaggctggagttcagtggcgcaatctcggctcactgcaacttctgcctcctgggttcagatgattctcctgcctcagcctgccgagtagctgggattacaggcatgcaccaccatgcccggctaacttttatattttgggtagagacagggtttcaccatgttggccaggctggtctcaaactcctggcctcaggtgatccgcctgccttggcctcccaaagttctgggattacaggagtgagccaccatgcctggcctagacatacagattctacatgattacaagtttgttccctctcatctactttccattttctcctctccctgcccctggtaaccaccattctactctctgtttctatgtatttgatttttttttttttttaagattctacatgtaagtaagatcgtgcagtagttttgtttctatgtctggcttatagttcacttagcaggttcattcatgttgttgcaaatgctagaatctcctttttaggttggataattattccattgtgtatctataccacaatttatttaccgcttcatctgttaatggattcttaggttgttttcatatcttggctattgtgaataatgctgcaatgaacgtcaaagtgcagatatgtccatgaggtgtttatttcatctcttttgggcatacccagaagagggattgctggatcatatggtagcagaatgttttatttggaagggaaacttttatactgttttccataatggctataacaatttgcattccctctgaaagtggacaagggttccctttattctacactctcaccaacacttgttatctcttgacttttttatacgagtcagtgtaactttaaatccacctggcctgatgctaaattatgaatgggaaaaattatattaatacttagaatcctgactgggtgcagtggcttatgcctggaaccatagcactttgggaggctgagatgggaggatcacttgagccaggagttcgagaccagccagggcaacatagtgagacctcatctctctaaaaaataaaatattagcctagtttggtggcacatgcctgtagtcccagctactcaggaggctgaggtgtaaggatcacttgagcccaggaggtcaaggctacggtaagccatgattgcactactgtactctagcctgggtaacaaagcaaagcaagaccatcttcacacacacacacgaaaaaaacttagaattctttttttttttttttttttttttttttttttttttttttgggggagggtctcattctgttgccaggctggagtgcagtggcgatcttggctcactgcaacctctgactcccaggttcaagtgattctcctgcctcagcctcccgagtagctgggattacaggtgcctgccaccatgaccagctaattttttttgtatttttagtagagacggagtttcaccgtgttggccaggatggtctcgatctcctgacctcgtgatcctcccgcctcagtcccccagagtgctgggattacaggcgtgagccatcacgcctggctaaacttagaattctttacattcaaataatgtctggtatttttttacattattttcatgtatattccctaatttaaacttatccccacccccccccaccccaccatgatgtcgtcaacacagaactgttttctagattaggaaactgaggatagggattttaagtatctcgctcctagatcaggaccgcatccaggttgcagaatcccaatccagcactcttccacatagtcacagcactaccccaactctaatctactgatgacacagaacaaaattaaagtccttgtccaaatcccagagttcatgaacacagagatgttaatgctcctgtagttcatactgcaaaaagaatgtgagagcttgtttcatttttcacttagaaaatgtatgagatgttctttctgaaggggttctgtcactaacaggttgcattacttgtacaaccattatatctgaatcttcccagaccgtggtttttttttgtttgtttgttttgttttttattaaatactgtcattaaaccagaactcatggatatctatgtcatttccagctataaaattctagaaacttggggattttacctttttgtttcttattttattttcttttttatcaaaagccttatcacaggtaaaatggtaatctaagcaagaataagctctgtcatgatttatgaagcatggaaattcagctgtggccaggcacagtggctcacatctgtaatcccggcactttgggaggccgaggtgggtggatcacttgaggccaggagttcgagaccagcctggcccacatggtgaaaacccgtctctactaaaaatacaaaaattagctgggtttggtggtgtgtgcctgtagtcccagctacccaggaggctgaagcaagagaatcgcttgaatctgggaggcggaggttgcagtctttagcatgggtgacagagtgagattctgtcttagaaacaacaacaacaacaacaaaaaccaacaacaagcacaaaccaataatagaaactttaaatgattctgagccttgagaggaatgtgattatgcaacctgggaaattcacctgcccatgaatagtatctctgtaattaataacaaagtcttacaggacagtccttgccatcaccatatcataaacgtatattgcttcttttagttcataggaacagggtctcctgctgtgtcatagctgtaggatttagcctaaatgctcagtgagtttgatgctcccttgagcaagcccgcttatttaagaaagtagtttttggatattcatggtttattgctgacagttaacgttctcaaaatagtgagagtcctaaagtcaaaggggaatttattaacaattttatttctgagaggatatgacaacaacaaagacattaataaaaaacaccagcgagctttctggcaatatgtattaaaattttcaaaaacacttatactctcgaatccagcagttattatttcgggaaattgctctaagaatattatctttttatacaaagcattttctgaagagaagtattcaggaaattttcatttatgaacagaaaaagtccaacattatggaaatagtgatataaaatacagcatatatagttctttggtattttacagtcatgtaatcatggagagaaatacttcagataaattaacataataaaccacaatacaaaaaagtatatttacaatagaaaaaaagtttaaaagtgtgttagcaatacaaataaacaaatacaagaaggatctatcacaacaatgctacagtgatgagccttcagataattttcattatttttcttgatacttctatatgttcaaaactttcattaatgagcctgtaataccagcactttgggaggccgagatgggctgatcgcttgagctcagtagttcaagaccaagctaggcaacatggcgagactccatctttacaaataatacatacatacataagtaactaagtaagtaaattagccaggcatagtggtatgttcctgtacttccagctacttggagggctaaggcaggaggattgcttgagcccaggaggtcaaggctgcagtgagccatgtttatacccctgcaatccagcttgagtgacagagtgagaccctatttcaaaaaacaaaatttcactgatgacaataaatattaccttgacatcaaaaaaaaaaaaaaaatccagtgcctggatgatcacccagtagcatctaaaagtgcatttgaatatatatccaggttctgatgccagcattgatgcttgttatgtgacaaaaagaaatcacctaactgctttgggcttccatttcttcaaagtaaaatgaagtggttaaacaggattactccccagatgtctccccaaactttacactggtgtaataattgtttgcaaggatcattgggtgattatgtctaaaagcctgcagttattagtcctcatatcaggaatgtgctatccccattcattttattgtagaacctggtttgctgtgggatagttgaaatttgaagaattcacttggtcagtgtgtttcacggccttgctactttttctgcttggatggactcacttctctatatgattttctctttaaatcagaagtatttgacctgaagcagtaactcctctattcatataatagtgatattctgatacatatgtgaatattataaaaataagtagaatgataatattattactaatattattgtggcagtaataatattatcattcacatgtgatcaatagtaaaagcacacacagcaacccctcaggatttcatcctcaggccattgactcccatcacctttactgatatttagcttagctttacaatcctcccctttgaaaaattcatattttaaccttgcctcccataaagacacacattttttcagatatagaatttgcaaggctgagacatatctttttagaatgaacccaatataaacacaaagcaacataggagaaaagtactagttacatgcccatggcaagaaaatatgcctgaaatggttctgtttattttgttgttgttgtttctgcttggaatttcagcagttatttggcaaagtgattagctagctgggaaggaagaaagctcgtctccatcagccttttgtcagagcccgccttttggtcccggagcccccatgaaagtgtgctgtagaccaggaccactgttgccctgaatgcatgagtatgcagcctttttatcgtaggcttgtcatctcctgagttctgcaatagatgccatgtgaaatccagtatatactcagtctaacacatagctgctgcataagaaaatttctttccatgcttaagcaatttctgcatagagcttaattcatagaaatcacttattcattcaaaaagcattcactgagttcctagtaggggccacatattacgctaaagtagatacaaggataaaccaaatgtagatctgtcctttaaagagtataacatgtagggaacaactacactctacatggcaatagaaagtcacaagtgggtgagaaccacaggagagaaacagtcagagggtgatgacagccagaactggtatgatgtgaaaggtcaatgacatcagaaacggcctcagggattttatagcctggctccttcaatttcagttcttggtataggccagcttttcaggactgttgattgtccctcttctttgtgtgaaattcctagtgcacagagcttctgcagtgcctcttaggtactttgaaaatcccaacgataaacatctggacccaacacagaagcctccaggaagctgtcttgttggcagtcacctacgagcaggcgataaacacaacacattaaatagtatgtaatgctccagggattgcagtcctctgcctcctaatctctctgtcctttcctcttttattgacttgtcaggagcatgacagttgtgcacaaccattagcacacaagaaatgactttcctgtgggggtgatggggactggggaacctactctttgagatagaaagttaccctgatgcagaataattacagtccagcttagcctccttataagcgattaatcttacttttcctcttagcttctgtctgtttgtaacctgaggttgaccgaagttagttcttttagttggttcttgagaaaaccctttcagtctgtatttccaggaataaatcttaactctaatttaaaaaacaaaagggccctataaatagttacttcaaaccctttaatttatagctgcattctcaatgtcttcatcctcccaaaatcactcacctctacatttttgccctaagtacctaggttagcacaacttttcacaacttctctttaacatttctctgaataacgtgaaccttccttatttccttaaaatataaacttatatatgttcttcctaggagattttcaacttttctgttctccacttattactctattcactctgttctctatctgagctgtcactaattagtatctacttaaataaatatttgagcaatttaacattacagttttttttttttttttcagcaagaagtgtgttcattatccattaaaagcctgggagagggactactaatgttacaccatcaatatctatttttagccacttcggttttggaagtgtctcttcttttggaagtgggagaccaagtggaggggaagaacatgaacaagggattgaagccattgagaaagtcatttattcattcgatagatatcttctgagcactgcgctaggacctaaggacagaataatgaaggcagagtttatccttccactagcacagcagtcaaaaccaataggaattaagattgtcagaagtgacaaaactgtacatagacctgttcacataactaacaagggaaacgatggaggtgatgtggaagtctgaacgtggtgcaggaataactcagccaacatccccctcctttgggaaatttagatagatgtaggtagattgagaagtgatataacagtcatgtggcatcattgagagagtcagttttctataatgacaaagacatggaaagagagatgtttagtacatgtacagcagaaggagttgattcacaacgcaatggaaacagaagtcaagaagacagtgaagtggatgaagcaaggagaaatcataaaaacaagcacactgggactgtcggacctcaggggagagtgacgtggatggtaaaccaagtttggggccagagaaaagtgaaagcttgtgctgttcttgttggtagtcatgggcaggctgtagcagggttattattaaaactctgatcccccaagtccaactgaaggggctccagtcactaccccatcatctcagtggtgagatgtagtcaaggcatctaacctctctgcctcagtttcctcatatgtaaaatagagacaatcattataaagtgtttagcagaatgccagatccacagtaaatatcagtaaaaggaaatttataaatttgtaaattgttagggaatggggtgagaccctcaagattctaatcttcaagggaaagaggatgctaaggaaagtcagaggaagcccgagaatcctaagagaggatgatacaagcaaattaattaaggaataagatcaaagaatattgggaaatgtttaatccacttggtgtgggaaaaggacttttttgtttgtttgtttttgagacggagtcttgctctgtcgcccaggctggactgcagtggtgcgttctcggctcactgcaagctccgtctccctggttcaagcgattctcctgcctcagcctcccgagtagctgggattacaggcgccagccacaacgcccacgcccagctaattttttttttttttttttttgtagtagagacggggtttcaccatgttggccagattggtcttgatctcctgacttcatgtgatccgcccgcctcggcctcccgaagtgctgggattacaggcgtgagccactgagcccggccgaaaaggactcttttttttttttttttacacagagtctcgctctgttgcccaggctggagtgcagtggcgccatctcggctcactgcaagctccgcctcccgggttcacgccattctcctgcctcagcctccagagtagctgggactacaggcgcccgccaccacacccggctaatttatttatttttttctttttttcttttttgtatttttaatagagacggggtttcaccgtgttagccaggatggtctccgtctcctgacctcatgatccgcctccctcagccttccaaagtactgggattacaggcgtgagccaccgcgcccgaccatgaaaaggactctttttaacctcttctccatgtctaatctgagtttcaacctttttattcttattctgttataagtacttctcccattcaagagcatataaaactagaattactttgggatgagtgtgagtgggggagagagaaggttgggagatcactagttgtgtttgctggtactgaatcctaccctaatacttccgaaatgaacctcattggataactcaactcttcattatgtttttgctaatcttttaggagcctttttgcaacccaccgtctccctaccctcgttgggtctttttttttttcttcttcagtcagggttttgctctgtaacccagtggggaaagtggcatgatgatggctcactgcagcctcaaattcctggactcaagctattttcccgccttaccttcctgagcagctgggactataggcgcatgccatcatgcgtggctaatttctaaaaaatatatatttttgtagagacatctctctatgttgcatttctggtcttgaactcctaggcgcaagcaatcctcccacctcagcctcccagagtgctggggattgcaggctgtttaatagaagttatcaacatatggagtcatttatgtctattgaaatatgaacagccaattcccttcacttgtcccatttctaattcagacactaattctgtttcagtttaacttggatcaatggacttatctttgcttctgttcagttatctgtttcaacaacaataagattctttatctatatggcatagtgggtgaaaggacacactaaccttacctactgctccttttatgtcagaaaatccattttctaatcactttttcttggacccaagtgagtctgttttttcccctacattttgtaatttgtcacatttacattttaggtgggttgttctaatcgacttttcttataaaagggtagtggttctagatcaatcgccatcaatcatgctaccaagcaatggtgaagtaccctttttaaaatattttatttagaagaatttcttatttcagatacaacagatgatacaagttgaatctagtagggtttagtaagagacaataaacatattaaacaaagccttacgtattttttaaggtgaaaaaaatcccccaagatagagtccgtgcttagaaactacccctgttaaatacttaatatataacatttgtaatgttcaaataccgaaagaaaaaaatgtacttgttcagagtctattcttgagtcaacctaccttctcagctctactgaccccaaacaaggtaaacaagctgatttaagttacaactaacttaaaaattatacatctaactcttttgtaaataactttagggctggtgctcaaaataattggaactagctatgaaaagaaagctagaaatgagaatgaggaaaattggtagtaagtgtctatagagaagtgtggaccatctgcaattcctatatttaaacagggagaagagggagatggggactcactctctccctcacaaccacatgactaaactggcccagccaatatctcatcaggtgtctccaccactttacaaagccactgggaatttatcaagggataaatacaaaactggtgtagggagaggggaatgggaagttacttccaaagactctgaccctgagttcttggcgtttattcttttttttgagacagtctcactctgtcgcccaggctagagtgcagtggcgcgatatcaactcactgcaacctctacccctgggttccagtgattctccagcctcagcctcctgattagctgggattacagacacccgccatgacaccctgctaatttttgtaattttagtagagacagggtttcaacatattggtcaggctggtctcgaactcctgacctcaggtgatccacccaccttggtctctcaaagtgctgggattacaggtgtgagccaccgtgcccggcccttggcctttattctttattttccctgatattaatccctaatgaaatgcatttagtacacattcatctttttaaaatgtgcagtttttgtcacagaagtagtgtaaaggacaccagaatggttggaagacgatttttgtggtcttctacaagtcctgttttggtgactctgagcaagtcttaaccttgcctacatttcctcacatttagggcaagtgtactcttcagggtcaactgcaatatctgtgggagtgctttgtgttttgtagcatgcatcttactagtgcttttgttgttgtttgcgttgtcgtgcgggttccccacctcccccataacactgtaaagaaatgctgagactaagtggtagggagtggcagccatctggtgaggatggaaagttaatatctttatttatgtaataaacctccctttagaattctgttactgtcaaatttctcctggaattctaatagtattttcgctatgtgttttgaccttttgctattgggaagacacaagtttatgaatgacaaatgggtaggggaatttaggctgcacagttaagtaggaagaatgaagtctttgctagagttagaatccagtttgaccttgaacaagttactcaatgactaagctccatttgcaaaatcgttttgttaaagggattagaggtaacatatctacatatgtacatgtgtacagtggtatggagaatggactggatgaatgcgtgctgttaccaatgtgataattactattctttttaaaaatagagtattttatgcatacacaatacttattcaattcaatttgccttagtgcacagtgatggaattttagaactggaattgacttcagaaataatctggtaaacgaaatcttttcgaggctcttcattttatggttgaggaaactaacatcctgagagctaaaagtcatcgttttcctttaaaatatctaaataatcccagatgttggatcagaactccaaagtcataatcagggcttttcctatttctatagtatttctaatactataacatgctattgctcagtcttttattctctaattccatcctggtttctagaccaaatatacctaattgtattctaacccacaagtacctcatcaatgagaagtctgacctatggtttatgatttccgcagacttaaatcaaccctgggcttctatccttatactagttttattttatgttttttgtttgtctttagagaaatgatcgtgttctgtcatccaggctggagtgcagggacataatcacagctcactgcagcctcaaactcctgggctccattgatcttcctgcttcaacctgctgagtagctaggactacaggcacgcaccatcaggcccaactacatttttaaatttttttctagagacgatgtctcgccatgtttcccaagctggtcttgaaccctggcctcaagcaatcctcccacctcagcttccctaagtaccaggattacaggcataagccactgagcccagccccacccttacatgttttctcttggcatcctgatccctggacacaaccccattgagatacccttccatttaatacttttcttagtcatttaccaaatgtgtttatagtaatatattcccatatatttgtggcagagtacagcactcatataaattttgatgaacacagacatgctgtcccatacttgtaggtaaaacaatcatgtgaaattaaaataaatattttgtttagatagatcttgactatcatacacttattctaacaatattgcccattcctcaaaacattctgggaactccttgaaataaaactgactatggtaagaagagtttttctgggagttgggaaactgattccattagaaggcagatggtgatagtctcacagcacactctctcccatgcggtctctattctacaggcatgcagatatttccaaaagcatcccttccctccagggtcctgaagaccctacctctggttctgccttggactgctctcagtgatattccctttttttttttttttttggacggagtctcactctgccgccaggctggagggcagtggcaccatcttggctcactgcaacctccgcctcccaggttcaagtgattctcctgcctcagcctcccaagtagctgggactacaggcacgtgccaccacgcctagctaatttttgtgtgtgtgtgtgttttttttagtagaggtggggtttcaccatgttggccgggatggtctcgaactattaaccttgtgatctgcccacctcggcctcccaaagtgctgggattacaggcgtgagccactgtgcccggccgatattcctgtttttatggttgcaattgtatgctatggcaccggtactatgtgggaagaatgatgctaggtactctactggtatggcctcatttgtcgatttgaggattattggtttatttatgcaaagcacataggatcataggattgctctctaggagaatggagtaattaataccatgaagactcatagacaatgcttcctcccctagaaactcattatttttcgaattttggcactgatctttcctgcctacttcctggcttttactaccttgtgaaaaagccccaagtgttagaagcagcttccccagcttactgccatcccttctaaggtccctggacaccactgcttgtctcctaccttagaaagtgcctacttggccaggcacgctggctcacgcctgtaatcctagaactttgggaggctgaggcaggaggatcacgaggtcaagagatcgagaccatcctggccaacatggtgaaaccccagctctactaaaaatacaaaaattagctgggtgtggtggggcatgcctgtagtctcagctacttgggaggctgaggtaggagattcacttgaagccgggaggtggaggttgcagtgacctgagatcacgccactgcactccagcctggtgacagagagagactctgtctcaaaaaaaaaaaaaaaaagtgcctactcataccctcctcctatttattctgatttctgtgcatgtattctttttgtttgtttgtttttcagagacaaggtcttgctctgtcacctaggctggagtgcagtggcacagtggcatgaccatagctcactacagcctcaaactactcctgggctcaaaatgatccccctgcctcacctaccaagtagctgagactacaggcaaatgccaccatgcctagcctgtgcctgttttcttaaggcagaaatgatctaaaagtgtggcagagggaaaagaagatgggacttagagcttaaataaatctagatgaaaatgttggttctatcactcacaggttctgtgatgttagggaagttaagttatttgcaataaaaattattaatattgtagaacatgtattgatcctatgtatcaggcttgaattaggtgctttaagtgggttgtctcaattaattcatcactctgattttcaattttctgttctaagaaatgagatcaaatatgcctatcttgccgaagagtagtaaaaattagacaggtagctgcctctggatcctgcagggtagagaaagtattacatatctgcatgtgtggatgtgaaggacacacagatacataaggtaaatgagaatttattataaaggtgtatttgacaaaaattggggaaaaaaggaaaattggagaagatatctttctgtgagattaaagacaaataggggaaaaaagggaccaatgacaagaattagagcaaggtatgtaaagaattccagagctggctctaagagatagagcagctggtcatatatgaaagggatgattcattcttcaggggctatccctcgtgatcctatttccttgcacaagctatcagttaatttattgattcacctcctttatgtgctcataggcatcaagaatacaatggatcacatacaattacagaaaagtttcatttcaggaggtcaaacaggaagtttctttctgacttatattgaagtactcatgatgacaatggagaaaaatgaacataatcttttatgggtggggaccatgtgatctcttttctttcaagctccagagggtttataagacatttccatgttcaatttgattccggaaattatatgttgggtagaacagactctttttggcaactcatgagaattgccaatgatcccagcatttgctactcttgatagtaattcccttcatttcctccatttttatacatgacctgcagtaaatattgacagttactttgctggaaagaataacacagagacagcttttcttaagctccaaactgaatttcgtggttaattgattggccagctggccctgccgtctcttgacctctacaagagccagcaagattgatggtttcagcagcctttcatggtgcactaaagcattcagatctatcttttgttatttgggaaacactaagttcttatgtagcacattatttacatggactcaagggctgacgagctgggaggcagcaaatgcccaaatggaagacaatgtatgtagatcaaagaagccgatgagacagagagttcataaaatgtgaatacaattccaggggagaattgatgattatggaagcagaaagccaattgagttaaatattcattccagcaacaagtctgatcgtctcactgggacctgtgcctttccgaagtttcctcagcttttcaaggtctacacaaggaaagaacaaagccatcaaggaggctctcattctggaaagccggctgcaagatggcatgaaccagaggtcagcggccaccactgagagttcatcgtattcgcctctgtaaagaataagcctcaagcagtggttctgcaggagcggttcagcatcatcaataccaatgagccctaatgaatgtgacaattcagaatgattgggccttttcctccaaaacgtttttctcctcaaaagtaaaacaggcttgaaactcatgtcttatatatgctgtttagattttcatatattaatgtcacgaatcagatgataggaaggtatattaacaagtgagacattgggatatggccccttgttcaagagcatcaaagcattaaatatgttgttttaaaaatacctttggcatagttttaccacctatttctcaattgccatcaaaattttaacttttaatgacttttggaagtaggttagatggggtggtgggagaggaatagaggatacagaaagataaaaactaaatccaaaaatagtattgaatgagaattactaataagaattattaattgagtgtcttctcataaaaatagtaatatctgttctttggtctctcacaatacatagtttaactccatatataatttaatgaatgcaatgtgtcactttggttataggtttgcatcttggaaacgatgttagtagaaacaagtcagtttccctctgttcctttttgcttagctttctgggctatcttcaccaatgccacagtccatctgtaacagaatgcattggagatttgaaaaatcacgacagataataaatctctatatacttctcatcctctggaacaattgagacattgaaattgcctgatctttttgagtgagtgttgccactttgacccaggcaaatgagaaataaaacaacaataccaaccagcagtttcaagtatccttctgctgcataataactcagcagtaggctttgctaatggtgtttatgagctgccaggctagaattggcccttaagcagggaggcatttgcccagtgggcttcttccatgtgggggggcctttttgcagcctgggggcccttttaggtgattctcagccggagcggtctcttcaggccaaagacttttgcaatgagctaactatgttcaattattgctttcagatccaccctacattcaaatgttttgggacaccaatgtaataccataaaaatgactgtgtaggacacgcctatgctaatgtcatgactggtttgttttacgtattatttatttatttgatactgttaataaaaagcaaacaagccaaaaagaaatactccccaacgtttaatagagatcattgtatcctaaaatcttatagcacattagagtgcaatgaagctcaatgtaacaagcatcaacaatcaactacgaaatgagtatggaaatagagtatatccaaggaagacagaagtgtagaccacatgatgacagcgggataaagacaaaggagaaggtaatcgagagccaagggttaaaccattcaaattgtcctttggcattaaaatgatccaagatgtttcatgagttcaggttaaaaaaggaaatcagtaaaccccaatatactttaagtttcatttgacgcccacaagctgaaactacctctttgtggtgtgtgtctttacatcagcaaagagtataattgaatttggttattatctccagtgctacctgtttggacctgctatttcaccttcctgaaaactgttgcattgagttctactggggaaaattcttaagataacatctgtttactaagaagggggtgtgcttacctgctctaaggtattgaaatacattgtaaatctatacctaattcatataaacataatttcaaggaaaaacaaaaacataagagacagaccctggcggagtgccaaagaatttgtcagggtcccagtccctgtaccttatgggagaattaaattcattaaactgggccagatgtggtggctcacactggtaatctcagcactttgggaggctgaggcaggtggatcacctgaggtcaggagcttgagaccagcctggccaacatggtgaaaccccatctctactaaaaataaaaaaaattagtcaagcttggtggtaggtgcctgtaatcccagctagtcaggaggctgaggcaggagagtcgcttgaacctgggaggcagaggttgcagtgagccgagatcgtaccactgcactctagcctgggcgacagaatgagactcagtctccaaaaaataaataaataaattcattaaactgaacaaattgagcccaatttatttgtcatagttcaaagaaaaggagagagtagagtaaaggggcttagtgcaaatgtctggtcagatactcaaaggtttagagcctcttaacccttatatttctttacataatttattctcattattttttgtttgttttttgagacagagccctgctctgtcatcagtctggagtacagtggcgcgatctcagctcactgcaatccctgcctcctgggttcaagtgattcccctgcctcagcctcccgagtagctgggactacaggcatgcatcaccatgcccagctaattttttctattttggcagggatagggtttcaccaggttggccaggatggtctcaatctcctgaccttgtgatgtacccaccttggcctcccaaagcgctgggattacaggtgtgagccaccacgcccagcccattcttgtttcttggtaaaggaaaatccaactatatatatcttctttaggatcacttaaagacccatacagatctgtcaaatagacatccaatattttggtaggctttgaaaggaggtgcaaaaggatgagaaggaatttagggagatcattatctgaatcattgaacaaatgctccttaagcacctggtgaagagaggctactgagaagcagagcacgtggtcccagcctacgaggtgacaaagtaaaatggcagaagcaatttgtaatgatctcacctatatgtggaatctaaaaaaaagtcagcctcatggaaacagtagaaaggtgattaccaggtctgggggctaggagagagatagggaaggggaaatgctgtcaaaggatccaaagtttcagttagacagaaaaaataaacttcagtgatctattgcacagcatggtgaccacagttaaaaataatgtatggtacatctccaaattgcttaaaaaaaaaaaaaaggtttcaaatgttgtcaccacagaaaaacaaaaacaaaaacaaaaaaaacaaaaaaaacgaggcaaggtgatggagatgttaattagcttgatttaaccttcctacaatgtatatgtgttagtccgtttttgcgttgctgtaaagaagtatctgaggctaggtaatttgtaaagaaaagtggcttattttggctcatggttctgtagactataaaggtagcgtggtgctagcatctgcttttggtgagggctcagaaagcttccaatcatggcagaaggcaaagggggagcccacatatcagatggtgagagggagcaagagttgagggggaggtgccacgctcttttaaacaaccagatctcatatgaactcagagcaagaactcactcattatcgtgagaacaacaccacgctattcacaagggatccacccccatgaccaaaacacctcccactgggccccacttccaacactgcgggttacatttcaacatgagatttaaaaccatgtcagtatacatacatacattaaaatatgcatcacattgtgccctatacacatataaattattgtttgtcaattaaagaaagaaataattttaaaataaataggccaggcgcagtggctgatgcctataatccaagcactttgggaggccaaggcaggcagattccttgagcccaggagttcaagagcagcctgggcaacatgatgaaatctcatctctaaaaaaatacaaaaattagctgggtatgtggggggtgcacaggtagtcccagctactcaagaggctgaggtggggggattgcttgagcctggcaggcggaggttgcagtgagattgcaccactgcacaccagcctgggtaacccattgagaacctgtcttaataaataaataaataaataaacaaacaaataaaggttgtgttagaacaaaaaagaaaaagagtgacaatgcaagccacatagttgaagttgacattaactagcatgtgccaacgagtgacaaaggaaacaagtgcaaagcaagaaaagttagccattatcatggtccatagataatactctcaaccccggctcttgagtgaagcagtattgtgcagtggttacatttatggacctaatggtcaaactgcatgagttcaaatcccagctttacagctaatggttgcattatcttgggcaagtcatttaacatctctgccttaattgattcacctctaatatagagctgataggagtctgaaatagctgctataaggactaaatacattaatatatagatagcattcataacagtgttttgtggactttccgaaggtgctgggccttccagttgccttaaagaatggattggattagggtggaggagatgaaaaaaggcatcacagtacatcaagtgaatggtgccagtgtaagtagaatacaggaataaggaaatgcccagcttgttggggggttagtatgaagacctctaactgggactgaaagttctagcaacagtaaaataccctggcctccaactactaagtaccctgaatactaagatgagtttatttttcattctatagacaatttccatctctttctttcaaaacaaacaaatgatgacgctgtatgagtaacagaagatgactgggaacagaaccgtgaacagaattaagcacctgcaatcaaataaaattcacagaaaacttaatttaccacattagtgatatgcataatcgttgttgtgctggtaaccagctcttcaggaaaaaaaaaagaaaattcctgatttgttaaaatactgtcactatggcccactgaaactatcaaaatgaggcatataacaggaaattgggaggagagttatacaatcagctcttgctagaaaatgatgatcattgacattacccttatggaaccaatccaaatttgggggttgttttctttctttctacttttgtgtgtgtgtgtgtgtgtgtgtgtgttctctggtatctgtaaataacatccatatcagtttctccatccattctttgcacatcactggtaatgcctgagatcaaatctgccatgcttttccgggcagatccaggctgggatctcagtatccctgcttccctgaagctgtccaacctcactcccttcattgctctgctgtgattaggaaggagccattccaaggactatggggtgctctgtgggataagcccagtccttcttccatacaggaggaacaggggacgggtgctgacaagaggaaatgcatggagcagagagagggaacaggcagatggactcaaggtccccagactctttcgagtgttgaatcagaaggactggagctgtgggggaagagggtgggaacagggtagtggaataacatgcagacagatgggctgaactgaaggtccagaggcactcccagccgtcaaccagcagttcttacaccaggttgatgttagggaacaaccccagctttaaaacttatttataccaaagtgccaaatgactcatttgagacaaggctttgatctctggggacagggcgttagacagcatgaggcttaggttgccaggtgtcttcccacagttcctgtcttgtgtatgttacacactcaattcatgtcaggatgacactacattggcatgatccaagggaacccataactgacatgaatatgtgtgtgtgtgttgattggggagatgggaaagagaacatttcttccagattttctagttcttatagttcataatcttaatcctcatctccacttctctgccacttctctggctaaatccaaagcacagcctggctagagaggacttctcttccttgggggttctagtctattctctgagttgtgacaaacatttccattccctgtaattacccacttgccttgtctctgaagaggcattcacagaataaaccaaaagaattgtagtgttaggaagatgtcaaatcatttgacctctactccatctccggcttttccttctccccccatgaaagttatgcatttagttgcctcttgttcattagtctggacttagagcaaagtgactacttcaacttcttgtgctcaacatatgccacagttgcttacatgtgataagtccatttgtcacttgataagcctttgctagaatttccttctctccatctccaaccttataatgatcttgaaggcaatgtcggaggctaggtaagtcttctttgtgttccccacttgagcataggtgagctgtcatgtcaatttccttacactactgagaagaggggatgtgggtgggcagggacccccagaaacaactttacccctttcacagtttccatcactgcctccaatgtccaccgacgttagaaagtttgggcagaagtggccaggtgcggtggctcacgcctgtaatcccagcactttggggggccgaggcgggcagatcacaagctcaggagatcgagaccatcctggctaacatggtgaaaacccgtctctactaaaaatacaaaaattagccaggcgtggtgtcaggcgcctgcagtcccagctactagggaggctgaggcagaagaatggcatgaacccaggaggcggagcttgcagtgagccaagatcgcaccactgcactccagcctgggcgacagagcaagactccgtatcaaaaaaaaaaaaaagaaagtttgggcaaaacctagagtttcagggaaagtcatttgaggtttggtttaggcaggaaatagaacaaaaccagtgtactaaggagaatacagtggaaataagagggaaaggaatgaagaaactggtaggctactaaaatgcccaggtacaaactactgaacatccacctttatgctgtcagtgggcagaaaaagaaatagacaatgacaagatacattttgaattagtgtgatttaaggactggctgatgtgcacaaaacatgagagaagggagtcaactttgacagagatttcaagagcagatcactgatgaaatgtgataacattcagaaaatagagaagttgacatgggctttgatgaaaacacaatgagttcagtttgaagcattttgaagtcaaggtgattttgtgaaatacaaacgatgctgtccagcaggcatagaatctatctggagtcatttgtacaatatacctatgccttttttttttctttctcctactgtagacttagataggaactcacttttgtcttttttctgctaggccaataaatacgttctcagcttagaaaaggggctttttggtttgcctatttctgtttctttttacagaagttaacacatttatttgtgacctattaaaatcatgaagtattaccactgggttttatgttttaatggaaacatttcatgtttagagaataatgatgcttaaaatttatatgaattaaaattttagcctgtaaaaagagcctggaaatatcttcataccatcatctatccttccacttaaatattaatcacaaagaagatcaggcgtagtgaacatacaccacgcaacctcccattcagagaattcttgtgcaaagaaggattccaaagggtttcagaaatactaaacttcttgaaattgaaattgaaattgaaatccttcttggcttctctacctgttacttcctctgcagtgctcagtatagtgtctgctctccctcctttctttttctttttttttgagacagattttcactcttgttgcctaggctggagtgtaatggcgcaatcttggctcaccgcaacctctgcctcttgggttcaagcgatactcctgcctcagcctcccaaggagctgggattatagtaccacgcccagctaattttgtcttttcagtagagatggggtttctccatgttggtcaggctggtctccaactcctgacctctggtgatcctccctcctcggcctcccaaagtgctgggattactggcgtgagccacacacccggtctgctctccctcctttcttcacttttctgcttcctctctcatattaataataagcttctatctttccttaattgtttacatatctgtctgtcctctttctccaccccacgaactcctcaaaggcagagtccctgtcttttttatttcatatccctaatggtagctgcaaagcagacactcaagaaggaaggaaggaagtaggtgggagaaaggaagaagaaaggaaaatgaaattaactactagtttgtttccctgtttcattgagaacacacgtattaaccaaacaagtaaacaattgtcagaatattgcattttaaactcctgagagaagttgctgcttctgtggcatttctatctaattaagtttccccttaaagttgtaatcttttctttcaaatctcataatacgtcttatttaggtgatcataccaattatatctttcccactcaaacccctaaagttatccttgaataaatgagccttgcaaattatatttccccaatttgcacttatttctttcttttttttcttttttctttgagacagagtttcactcttattgcccaggttggagtgcaatggagtgatctcagctcactgcaacctccgcctcctgggtttaagcaattctcctgcctcagcctcccaagtagctgggattacaggcgctccccccctccccatgcctggctaattttttatatttttagtagacagggttttgccgtgttggccaggctggtctcaaactcctgacctcaagggatctgcccacttcggcctcccaaagtgctgggattacagatgtgagccaccgcacccagcctcagaatttcttactgaataatccttttatagtttgttataactaacacaaaacagtagtgggagttcttattcagatagctaacaaattccaggcacctcctgtactataagtgtccctcatagcacaaaggggaaagctgccctttaagaatccataaatgcaatgaaactctacttacgccacccaggttgttaggacacaggaatattaatctggagaagcctttgataatagaatatagtcaaagttgacattgtgctagaatatttgaattttttattttccagaaattattttcactctttgctacatttactgtttgacctcaaaagaatgtaaaagcaagtttttaaatacaccattatttcctcaagaggctacagaattgctggatttttttttttttttggaatggagtcttgctctgccacccaggctggagtgcagtggcatgaccttggcacactgcaacctccacctcctgggttcaagcagttctcttacctcagcctcctgagtagctgagattacaggtgtgtgctcccatgcctggctaatttttgtatttttagtagaggtggggtttcgccatgttggccaggctggtctcaaattcctgacctcaagcaattcacttgccacagcctcccaaagtgctgggactacatgtgtgagccactgtgcccaacccagaattgctggaacttaatgccaactctcaattgtctttccttctgctagatctagttaatagcaggtgtctgatacatgttactgaagtgaatatgaaaaatccagagtaagcaaataaatcatatttttttaattaaaaacatataaagtacatttttgtcaaatgaacctaattggcaaagcaaaatctcatcttttaaatttctgagtttccactattgataaaaaaaaaaaaaataacgtaaaacagtgttggattttcaaactcaaaagaaagaaaaaaaccacaaaaaacaaaaaaagcagaagttgggtaaaaacgagttctgactaaaagctgcaatactgtctcaaatgtgcccatgaccccacctattgctcaatttctacaccatgagggtaaagggaaacgaaatgcaacttggattcacttgacttcttaagtcttacagagagagaaactgatcagaaaagatacatttttggaggttggtttttttttttaattcttgcttgtaaggcagggcttggtgactcctggtctcctccaatagcctaattttcctcccaaaagtaagcttttgattccactagggtgggcaagtatctttgtactctgccatttcagagataagagccaactgattttagaaatccaagagcaaatgaaatgtgcaacattttactcttggattgcttgagaccgcatctgtatgcctattccctggagtgcagactgtcttgtgagcatttggtgccactgaactctgaaaatcagggcatgcagcatctgctggggaacacaatctggtttctgtggatcagaagcatttctctacacgttagagtcttaaggatttttaaagagagcaggtctactcaggcaactcgttaccgtccctttcaaccggagtcagaactaagaatgctcagcagatggttgtggagtgaggtaaatttacatgcagccttcagtcattagtgacagatctattttaaagggacgaggttgtgcaacaagggtacaaaggcagctcatggttctaattgttgggctccattagaaggggtctttctggagactgtggtttcttagagcaccgcagtctacccctgaatgaaaggcatcctgctggctaattaacttgcagcactttcttctctattgtgccttgattttttgttttgtttggttttaatctcagaccttgtttctagtaggactgatggagtcttccattatttcgcctaaatattttatgaagaacagagtttccaatcactcactcactctgatttcattacttttagcatacttttcgttcttataatctgcaataaagaggaagactattaagattcaagcttgtttgagcaagtacactgccagagcaaaatcagaggaattcatggaagactgggaaggtgcaagtaatctttctcttagaattgtgatggtaacatatgaaataaaatgtgggagcaaatgaagccattgaaaagagaggccattatacttctgaccacttgggaaataccccccaaaatagctgaaaggtcccaagaggctgggcacagtggctcacatctgtaatcctagcactttgagaggccaaggcaggcagatcacttgagcccaggagtcagagaccagcttgggcaacatggcaaaaccccatctctacccaaacaaacaaacaaacaaacaaacaaactagccaggcatggtggcaactgcttgtagtctagctacagcttccatgaattgttcagtgatgctctcttaactccatgatctatggaacaggcaggcagaaatggagagacagtgggtggaggggaggagcctcagatggcacagaaatctgtagcatctagatcagagtgacacctcagagtttcgagtaacgacaggcacctggcccatggctgggattgttaccagtggtgaatctgtgcaggtctgcagcaacctcaattcttccctctttaggataaaaacttcattgaggggcataaagcagaagagactgaagcaagttttagagagggagtgaaagtttattaaaaagctttagagcaggaatgaaaagaaagtaaaatacacttggaagagggccaagcagacatcttggaggtcaagcacagggatttgaccttctgacttgggggtgtatatgctggcctatttccagcacttcacatcccttttcccttgattcttcctttaggatgggctgccgcatgtgtggtggcctgctagtgcttgggaagtgagcatgcgcagtgtgtttactggcgttgtacacatgctcacctgaggcgttcttcgggtgaatgcccccagaaagtcatgtaccagttaaactctgccatttggcctcttagtgcatatgtgtgagccccctgcccaactcctgggaccttatcgggaagctgataatcaccagtttcagatttttcctatttataaaaagactgcctttccctggagctggctgcaaccaattattttagagagacagttaccaaccacctgttcatcacttgatggtggcctgacattcctggttagggcggggggcactgtcctgctctgctcatgtctgcctacctactgtagcaggaccacaggcagacttttcttaaggagactcccagctttcttcctggtgaaggacccagagtttgtgagcccaggactgcagataatcaaaaatattaaattatggaagctaaatatttaaaataataactcataatggctctccaaatgtctgtaaaagcatttcacttaacaatagctggcaaatattatgtcagtggaaaatacagccaagttttggctcatccaaaatgttgtcatcaccgccactttaatatttaagagattaatgtttcaaggctcttccagaacattgtatttggagtctgattgaaagactcctcggtcctccctcattattctttatgtgtgactttggatgctctcaatacacttaaattgtatgtccctgtggggaatggttctcaaagtgtagtatctggagcagcagtatcagcttcacctgggaacttgttaaaaacataaattcttgcagctggatgtggtggcacatgcctataatcccaatgggagaccaaggtaggaggatatcttgagcttaggagtttgagactagcctgagcaacatagtgagaccccatctctataaaaaataaacaaaattagctggacacagtggtgtatgcctgtagttctagctacaggggagtctgaggtaggaggattgcttgaacccaggagttcaaggctgcagtgaactgatatcgcgccactgcactccagtctgagtgacagaacgagactctgtctcaaaaaaaaaaaaactgggggccacacaacagacatactgaatcagaagcctgggggtgtagctcagcttgtattttaacaaggcctccatgcaattctgatgtgccctccagttttagaattgatgctctgtgcaaatgaacaggtactggggcataatgatatgcaggactgttcttgagccaggctttgtattcatgaagtgggtgatagttgattggcattgtttcagtactcagtagctatgaagcattctattggtatcattggtattaaatatggagcagaagcataactcatctccctcatggccacatgaagaaagatcagtatgttagagctgaaggacacctaaagccccaaacaactgccagagaccaaaatcatttgtctcaagaaatgttaacaccctttttgtgttcaagttttattatttctttactaaaattgcccattcacccctttgttttatttttcacacctaaaaaagtagccaagtttgaaaaagaaagagtgcttgccaccctttctgtccttaaagtgaaggccttgtctatctcattctgatctctgcccatccatcaccattcagcactcctgttgtgacttcgccccatctccaatcttacattttattttcttggtacttttggtcatggctgtgttgatggtttcagaagaatacatagtatattaaggggtaacgtttacaaatgttcttgagagaactaatttttcccccttcatctcaaggtgtcactgcttaattattacggttcctaaataatctctatgatgtggttaactatccctaccttgcagaaatcctggaagatgagacggacctagcatgttgtgtgagcaacatctcttagagataatcaatttgatatcagcacaattattgtggctactattgaaatttctcttagtttcttagattagtactattggaactaatcgtaaataaccaatttacaagaaaatgagtctcattatattatagcacgaagaggatatattcaaggagatacacctttgaatctattatttcaatatgcttataaaaattactattttaataaatttcccagtcaatcctattgtgtagaaaaagatgcttcactgcttacatattttaagatgagactgggaacaagcagattaatttggttgtgagactgggagtttatgagcaaaatgttcttctgtgcaaacgaagtagaagcttcatttcccttcccttcagttaaccctatgttattggatacgtaccaggtactagagattctctccctgggtagtctggcttagaatggctccccaggctctagccatctgcatagctgctagaggaaaaagctgttttagttggctccaagaatgtctctgggaattataatgtattcatagaaatgagtgtggagtgcccacttgcacaatggaagatccacaataatacacctggatctgatagcaccttcctgaacttgggccacttccctctttgaggtttgtgaggccaaagggatatacacagaggctgcctttgtttgtgattacctgggaattagatggggtatcattcccccttatatccttttactatagcttgttcacttttgaaaaggtggaaaactagactaaattctgtattgaaaatgtcaagtcaaatatgctatataaccaagaaatatcagtatagaatatcatgtattctacacaaagctacattttcaatataatccccgtaattatttcactcatcaaagaaatgtatccagctgagacataaaaccttagtcaatacattaagaaaaaaagaaaaaaaaaaacatttttttcccagtcatggggaccagattgtgtctattattcatcagggcctagcacaatgttgagcacatgctcaaggtggccaataaatccttgtggaattgagttatatgggagtcaattattcggtcacagcactggattaggaggttgagttcttgatagatttactttcagctgacctgtgtgacatttggtatttggttttgcaactttgttttcagttttttccatgcaccaatactcctagaattttgcttttgcctcttttcttccctttcatcttttttttttttctgtagaaagcatacatccatatagaagacctctctcaatacattccagatctgagttgcagtgcagcacttagcttagcttgtgaaacactccaaagacttgattaatatcatcctatggagagatgtccttaagtaacttagaatggatcctttatttttccagtaaataaactctaaaatatgaggatttccaaggtgaaaagaaagagtacgaacccaagaaatattttaaatgaatcttgttttccgtccctgtgttctgagtaacatctgtattcacccctgcctttccattgattggaaacctttagtattctttgtactctcacagtcctagtttctcagaactgtctgtcccagtctaggcagttgtttcattaaacaaatgttattaaacaaataattttgagtgtgtgtctggtggggaggggaggctggggggttaaattcatgtatttttaggcaagagtattaacaagaattgtttgaaatatttctgaaaccatagtgtcataatgaaaataaaaataaggtggagactggattgtaattaacacagagcttttccatccaagacagagcttaaaggcctctgtttgttgggtcactttaaaaacaaaccctactgccagggatttccaatggcaactttaccgtgcttacccaaatggaggtaattaacaacccttctgtgtgttaaattaggtatccacagaattgggaagcttcagatatttattgtaaaccagagcctcttttcttgttaatctcctaagacagcagactagtgactcgcacccattagaacaaatgaactaagaaactgaatgacaggttctgaggcccctaagaagaaaaaacagagtctggattagagctgcttaacagaccactcactggggcatgctccctccccacgcccatttcctatcccagaaaataacaaacttcagatgacccgccaaaaacgactaccttttatatttgtcgttgaattatttcttctttgtttaaaattaaataatgcaagtgatttttttgctttagaaaggaggattacctcttcctagacatccagttgaaaaaccaactggtatagaagggaaatgcatctcaaacagatacaatgacattcttataattgcctcatttgaaatggcagcatttccccgtgctaattgtcatccttcagctaatttggtacattaaaggagattgttattaaaaacaaaattaaatccattgccagcatctttattctctaccagaagaaaaattttaaataaatgcaaatacgccagttttgctcttaatgttgcctgaagttgaaaggatgaactttgacttgaaagataatgagttccccctgttggaggatttgaggtttgggttggataatcccagatgatgttggaatagacagaatttaaggttccttctaaccctgaaattctatggttataaaatctatccttttcttgaaagaagaaatattaaaggtgttttcaaggaaatggtagcataatgaaaaaggaaacacaaaaatgatttttttttccttaataagcagtcacctcacttggtaatagtttttcttcttaattgcttgtttgtttgtaacaaatgcggtggtgtaatcaagtggcttttacaataataaaacacttctctcaattaaactgtactgcaaggaattcaaagatgaacagaagtgttccttcttttaagatgctgatttataagcatccctttaaaatttacttctctttctgatgataaaagtaatacatgtttattgtagaacatttggaaactaccagggactataaataacccatagttgccccaccagagaatattcttaatatttttggcatatttcttccatatatctattcatattcacattcatactaatttgtcatattctaatttaaccctctctttaatgtttataatgtgattatactactttttaacacatgaattgtctccaaataaaagccaaagtgatccatttgttaattttttttaatcctacccagctgaaatggacaaagaggagcccatctcactcgggggaggggatcaaagagttatcctttctcttgatcaattctgtagcaatcagccatgataagaagcccaaattaccaaattaacaaaaagaattttatttagtggccatatataaaagctaaatggacagttggagacagacaacaaaaactaatataaaactaaaaatgtgaaaattcagcatttaatgaaaatgagagcttagaaaaactagcatccagatttattcagactgaatttctgccctgggaaattaatgaatcatccttcagttcccttttgtgtctgtgcatccagcctcattgtccttggtagtaaattatgtacaccccctgtttccaaatcttcaaatacggtatgcgtcataaagtcacaaaatgtgtaatttgggtcctgtatacaaattctagccagggaatggcttgtagtcatgctaaatattctttacaagttgtgtaacaaagacaaagaaaactacaaaaaaatacagagaaacataaaaaatttcccattccttctgtgattctgatgtatttccctttgattctttgcttctacattgaaatagacttagtgggtaatactaataattacagttaacagtgaccaggtgatatggtttgactaggtccccacccaaaatctcatcttgaactgtagctcccataattcgcacgtcatgggagggatcccgtcggaggtaattgaatcatgggggaaggtctttcctgtactgttcttgtgatagtcaataagtctcacgagatctggtggttttataaaggggagttcccctgcacatgctgtcttgcctgccaccatgtaagacgtgactttgttcctcttttgccttccaccatgattgtgaggcttccccagccatgtggaactgtgagtccattaaacctctttctttataaattactcagtcttgggtatgtctttgttgttgttgttgttttgagacagagtttcactcttgttgcccaggctgaagtgcagtggtgtgatctcggctcactgaaacctctgcctcccaggttgaagggattctcctgcctcaccctcccgagcagctgggattacaggcgctcgccaccacgcccagctaatttttatatttttagtagagatggggtttcgccacgttggccaggctggtctcgaaccctgacttcaggtgatccacccgcttcagcctcccaaagtgttgggattacaggagtgagccactgtgcccagcctgtttggttttgtttttgttattgtttgtttgtttggagtatgtctttattagcagtgtgagaacaaactaatacatcagaagttctgattttcatatcagcacagagaaaagtgaccttcccagtccagtctatcgtattctcaaattactttctctaacttgtgaaataagatcttcttggtgaactttatcagacatttctgaacagaattaccactctgtggtggcctgggtaaatgtaatatatttataataatttgaaaagattcctccaggacttttacaaagacagatgatattaaactgaacaaatagtgctaggtaagaagtaaattgttcaattttttcacagaagccctgtagattttagcaaaaccccccagacacaatgtcaaatttctcagcaggtttcttggttttagctcttccccttaagcagtagttaacagaatattagatgttagtaaagttatttctttgttattctacctgggttgactaccagagaaaatccctgaacattttacaaattgctcaacagattttcatctaaaactagaaaagattggccagttatggtggctcacgcaggaacattgctttagcccaggagctgaaaaccagcctgggcaatagagtgggacccccatttctaaaaaataatatcttttaaaaaattaactgggcatggcggtgcgtgcctgtagtctcacctacttgggaaactaaggagggaggattgcttaagcccaggatgtcaagattgcggtgagctatgattgagccactgcactccagcctggaggacagagtaagaccctgtctcaaaataaaataaaataaaattagaaaggataggtgtgtttgggagggagactggttaaccagggtgcatgggattatgtagggcttgtctttcatttgagttcttctctgtctttttaaaatgactgattatatatattaggtcccaatggcttcattatcactattattttaattcataggttaaattttataaacatgaaaaataattgacaagcctagaatctcttttctgtctatattagaaattaaattatatttagtatttaagcaatacatgcatacatctcatgtaatccttactgtaattaaggatgaaattatgtaacataggaaaagcagatgtaagttctcattctccttttacacataaggaaattaattcagacttttagtaagttgcccagaatcacgcagctagtaagattcagaactaaaaatataatacctgtcttctaattcaaatgtttcacatccaagtgcccatatactaataatttttaactcttttgttggggttaaatgagataaaattgagtcttattgtatagaatttatcagaaatagcaaaatttcgcccaggcacggtggctcacgcctgtaatcccagaactttgggaggccgaggcaggtggatcatctgaggtcaggagttcgagaccagcctggccaacatggtgaaaacccgtctctgctaaaaatacaaaaattagctgggcatggtggcaggcacctgtaatcccagctacttgggaggctgaggcaggagaatcacttgaacctgggaggcgggggttgcagtgagccaagactgtgtcattgcactccagcctgggcgacagagagagattttgtatcaaaaaaaaaaaaaaaaaaggaaaatctctaaaatgatacctaaaatgataaacaatttaaatttagcataattatcattttttaacttacagattgacatatttctgcaagtgttttcagaggcattggggccacagaagtccaagtcaaggcaatttttggtactaaacagttgacttttctctggtccacatcaaagctgccactgtgcagagaactaacatgtgtacgtgactagtctagggctggaggaacatgcgaggggactgttggaaaggaaaaacttttgctcttcctctaggttcagtaaattagggactgtaaacaataataatgaaagattaataagaggcacacaattttattttattttattttatttacttatttttttgagacagagtttcactcttgttgcccaagctggggtgcaatggcacgatctcggctcaccacaacctccccttcccgggttcaagtgattctcctgtctcagcctaccaagtagctgggattacagacatgcatgaccatgcccggctaattttgtagttttagtagagactgggtttctccatgttggtcagcctagtctcgaactcctgacctcaggtcatccactcacctcggcctcccaaagtactgggattacaggtgtgagccactgtgcccggccccacaattttattaatatttatatgcaaaagagcttgtagaaaatcagtgaaaatcaaagaagtggttagactagggggtttataaacccttcttaaccaaggaaagagggtttgggcatcaatgagtggcgaattgtggagaagtgactagaaaatgtatgagagaaactaatggaaggtatattagttcattctcaagctgctataaggacatgcccaagactgggtaatttataaatgaaaaaggtttgactcacagttctgcagggcgtggaggcctcaggaaacttacaatcatggcagaaggagaagcaaacacatccttcttcacatggcggctgcaaggagaagtgctgagcaaaaaggggaaaagccccttataaaaccatcagatcctgtgagaactcactcactatcgtgagaactcacttactatcatgagaacagcatgagggtaacagcccccatcgttcaattacctccgaccaggtcccttccatgacacatggggattatggggactacaattcaagatgagatttgggtggggacacagccaaaccatatcagaaggtaaggcctattttagtaagttttgtttatgcaaactcatctcagtgttgactccctatctttataacatgggtcacttttttcttcctgatggtgtgggggagagggcacctatctcaaagagaaattttgctctgcttttagatgtacaagggaaagacagagaactgttcctgcatccattgattatcaattgccttcagctcaaaataatccttatgccaaagtagcatattttggggtggcatatttcaacctccttcatctctacccagctggaactgtccagggagttgcatacctcaaaagctgagttggtggctataaagacaagatttgggttagttcctgagaggtaagagacctgcaaagggaaagaacatagatcagaacgagaataaataagcagaaaagagcaaatctcagcacattcccactgatctcactaaaccaggctcctagtactggaaataggtcagtcaacttcaacaattgtatctcatttcaggaagcagcatgcaggtgggagtggggcacccctctgaagtttggcctttatgctatgtgaataatcacacacttaaagagaggcatttctatgaaaacaaaagaaaaacaaagattaacagttggagcagactctaaagccagtttttgagtccagaaggcagttagttggcaagatttctaaatgttggattcaaggctgggtgcggtagctgacatctataatcccaacattttgggaggctcaagtgggagaattgctcgaggccaggagttcaagataaacccgggcaacacagtgtgactccatctctaataaagtcatccaaatgtagttgtatgcacctgtggtaccaactactcaggaggctgaggtggacggattgcttgagcccaggaggtctaggctgcagtgagccatgatcacaccactgccctccagcctgggcgacagagtgagatcctgtcttaaaaataaataaataaataaataaatgttggatgaagtgtctttagatggtggattgaggataacaggggcagtctcagtcacgtgcatttcccggagtttgaaggaacatgttctggtgagcttcctgagtggtccaaactacggtagtgataattcctttgaagttaggttcagttgtccaacttcagcttccagggctccaagaaaagggcaattgtggttctcagtgatgccaagtcacaagggtgagagaagactggaaacattaattacaagatggcaggattcagtttataaaggggggaaatatctcaatgataatgaacattcacaagggtgggttatagttttccattaaaacataaaatttctttctacaatcacccccaatgtgatcaaaaacaatcaaagtatgtctgcttgtgtctggcaactgagtctagtctcattaaacttggccagattatttacataataagtgcagcaagaatagtaatttagcacgtaggcttttttgtgtttgctcttctggaacttttaataaggactctcagaatagacttttaaaagctcttgagagtagtaagccaagccaagaactagccattagactttatctgtaatacctatagattggggtgaatttcccttttcttgaggactctaaaacattctgagtttcccgggcctgccagaaagttaccttccttacccacctgtaaggctaggaacgctataaaccagatacgagtcttacttttccaagggagctttgtaagcgttggtgccatatagtcaaccttagttccttaaaactattgggttatatgtgattccacacacattattttcaaacatgacactgcagtcaaagccttagtaggacagccaatgtttccaattgtgttctgttccaaggagaatagattcttatggaacttaggcaaataactatattgccatgaaaattgaaatactcaataagcatttctgaattttggagagatcaggtaggggcaaaagataaatatttcatttttgtttatgaagacataatctattaaattattgtgaattacaggtagcttttagaaagggtttcctgacatccagaagatagaacattaaataaccagcaaggtttcaatcaaaaaggccataaaaattataattgttttttatcagttcattcagtcccatgtaattaattcttgttttgcttgatcttagattagtggatttatgaatccatcagcttctccattagttctggaaatccttactgtgtccagtgttataatcttgaagttatttaagcaatgtcagcagaagcctgtactccagagtacctgccaaggttttgttcatgaatctctaatatgctctttctttgctgaagatgaggcatgctggcctacagctgactgcgtgagccttcagaaaagcatcggcataaaacaataattatctgtgaatgacaatgacttaaaatggccatacctaaagatctgatgaaagttcattataagtcaattgataaagaaatttggttgtttctctgacatacaggattttaagataataatgtgataccaagacatctcatgaacagcaagggcattgacagatttctaggaattttatatgatttctgaaaaatcaaaatcattatatccatacaaatataacccaggaatggttaaatatcttctctttatttgacagtgcttcccatgcaatttagcatattaaataagctcatctctctttttacaaactgagagaacaaatcctttgagagttttccaggggccctctgggaaattccagagtcaattcaaggtcaagaagacttcatttggaatttgatttagggaagttgtgaaaaacgtgaaaaggtttgaacaattgattaaatgggatcacagatcactataaaacaatacttagttatctatttaaccaaagtgacaataaaagattttcaagataaatatggaagataacataatcataaaaaattttaactctttcaatcttaagaaaacttggttttctgaaataatcaaagacataataagtgcaacataaagcacagaatatttattttctaggtgtatcactcaagaggtaaagaaaacatttcataatctcttaccaagaatagactactcggtatagtggctgaggcctgtaattccagtcctttaggaggctaaggtgggaggattgcttgaggccaggagttcaagaccagcctaggcaatatagtgagaccctgtctctctaagaacaaaaaatagattaataaaccaagaaaacttgctcattttaaaagtagttttgcatcaatacactactgtattagtccattcttgcattgctgtaaagaaatacctgagattgggtaatttacaaagaaaagaggttgactcacagctctgtaggctatacaagaagcatagcagcttctgcttcttgggaggcatcgggaagcctccaatcatggcagaaggtgaaggtggagtaggcgtcttacatggcaggagcaggagcaacagagggtaaggggtcaggtgccacacaattttaaatgaccagatcttacgagaactcggtcactatcatgagtacagtaccaagagggatggtgctaaaacgttcttgagaaatctgcccccatgattacaatcacctcccaccagagcccacctccaacactggggattacatttcaacatgtgatttggtggggacacacatttaacccatatcaactactaagctcattctttaaaaccttataaatacacccattcagtcctagccagcgtggccacacaatgtaagattctctctctcttctgttctctctctctctctttcactgacctttacaactttctatatcaactcacatttttgtcctttattttcgtctttcttatttaaatgacctctaaactactctaggataaaagtcactgtcatttttctttaacaaaaacacatctcactctccttgtactctttgcctgcagagttttgtttcttcatcctattattactagtagttcatttacacatatttattagatttcttaacccttagtaacattaactttcagtgaaaatgaagaaataaacaatcataaactgtcagttacatacatgcattctgtgctacattagcacaggtataaatacattctctcataatttctagaggcatgtttcctaacagtacaacttctcagtgtggcaaaagagcaggtttattaacagatccaaatacctttagtctctgccaaattaagaagtcaaaagtagccgggcgcagtggctcacgcctgtaatcccagcacttcgggaggctgagatgggcggatcatgaggtcaggagatggagaccatcctggctaacacaatgaaaccccatctctactaaaaatacaaaaaaaattagctgggcatggtggcgggcgcctgtagtcccagctactcaggaggctgaggcagaagaatggcgtgaaccagggaggcggagcttgcagtaagccgagatggtgccactgcactccagcctgggctacagagcgagactctgtctcagaaaaaaaaaaaaaaaaaaaaaaaaaaaaggaaataaacttaaatagataaactttagtaattagtattttggtattttattttctttgaaattatctacctatttcatgaatatccgtcatttaacttagtataactttaagatttcaagtaaccaaaaagatgtcggaaactatttttaagtcactgtactataaaacagttattgttgaaataaagtttgtcagagtaatgactcaatctgaataaaatgccatctataagtttaatagccttaaacctcagtagttataatgttagtttgactagtaagtccaagtagaataaaatgtatatttcatgttgacaacttgaagacgtaactctctttaattaaagaaataatattaaactggtagtagcggtgaatccatacgggtatgcagcatccttacatcttgcctccttagaagaaagagttcagctgacggacatacgcagagtgagagaccgaggcaagttttagagcaggaatgaaaggaagtaaagtggaagatggccaagcaggcgacttgagagatcaggtgcaccgtttgaccttctgacttggggttttatacgctggcatgcttctggggtcttgcattccttctcgcctgattctttccttggggtgggctgtccacatgctcagtggcttgccagcacttcaaagggtccgcatgcacagtgtgtttactggacgtgtacgcatgcccacttgaggtattttttcccttagcaaatccagtgttcctagaggaaggtcatccgccattttgccttttagtgccatgcttgagcccacttacccaactcctgcgatcttagccggaagctgctgatcagcagtttcaggctcttcctatctgttgggagcctgcctttccctggtgccagctgcaaccaattattattttagagagacagttaaggactgcctgtccatcacctgatggtcgtctgacattcctggttgtggggaaagggaaccctctcctgccctgctcatgtctgactagctacctgctgtaacaaaactagttttatttaccaaagattatcttatatcagataaacttgaaaacatgttggttatatttaaccattaaataatatatttggttatatttctgagtgttttagcaatacttataagcgtttttttaagccaacttagaatagaactcatttattaatttggtaataccatcatgaagtgaggaaatgtcacataggtacaacgtacatacatatatacacacataaacatataaagatttatttattttaaaatttaatttatttaaagacagaaacagatagagattattttaagattttagccacaggtcaggtataaatatagaaacacaaaactcacaaatttatatgagctggcatttttgtctttttaaaaaaatctgaattgtatttctggcagatggaacaagaggttacctgctcaatgagggttaaggctttttatcaatattgttggtggagacttaaaaaatttttttcttgacataataatttaatgtagacagtagcattagtctcaggttattgttttagtcaacagaaattaaagccaggtgacttttgggctggaaatcaaagttattaatatttccttaggtgtttacatatcaaagagatggccctcaggtccttgagaagacagttttgggtggtagaatattttacagctgaaggaggaagagaaaggatgtaaactttcaagtagtccctttaaaagggagttttcgggcatttttgtctgttacagggttgctgcgtatcattgttgttattatcaattgttattttctgggacaaacagtaaattcttctggtagcactaagctttatcaagcaggcattttaaaagtggggttggggggatgatttttgatgggtgtgaattttaagttcttgtctaaatctaatttatgcttgttaattttgttaagggagctatccagtctaaccatgatacacttgtttccttctttcaacttgatcctcccataggtagcaatacgatgtttatttagggtgagagctctctaaatatccttttaaacataaaagctttttcaaatcccagttccatcatctggtctttgacaatttaggatctccaaaggtatacgtgctccaaaatgtgacacaaaaccagtaagacttttatgactcaaaaccaatcatccattttatggtttaaccggggaccaagagttgtccccagagagggtgcagaagactctgccctcatgatggaaagtcattcccaaaaatagccaaagagaaagcgagctgagaccctcatggtcacaggcagcaaaaatggtgtttgtgaaaatggtatctccagcgttacacaaaagtgaggcacctgcaatcacagacttgtggacctgtgacacttgggaggcaatacggagatgggactttttcagcactaataagacaatgaggaaggacaacaagtgccttgtatgagctgagacactttatttagacaaattccccagattgctgacatagccaggtgggaaattttgctagtgttttttagggtccttgactgacagcgagcacctccagactcaggcccaaccacctgtgcttcccagtgggcaaaaacacagacagaggtgaggcgtggtggctcaagcctataatcccagcactttgggaggctgaggcaggaggatcacttgaggccaggagttggagaccatactgggcaagatagcaagaccctgtctctaaaaaaaatttaaaaattacctggacatggtggtgtacatctgtagtctcagctacatgaaggctgaggcaggatgattgtttgaccctgggagtttgaagttacagtagctatggtcgcaacactgcgctccagcctgggcaagaccttgtctctttaaaaaagaaagaaagaaaaaacaaaacaaaacaaacagagcatgctgttactagatctaagtcaagttctcgggacagaagggaggacttcatcgaatttcttttttattggggacccacaacaacatttgcccaaagggtctgtagtctgctgagaactttaaagtcaccagtctgtgaggctggctcaaacaacaggcttatacacctgtgccaatattctattctatgattttcctccttatgacaaacaacacaaaagacagagacaaagagaaaacaatggctgtctccaggaggaaaaggattaatcacaaaagtcctcaagccaaaaatcacaaaagtcgcaatacccaaagaattatttcttacaaatgttttctcctgccaatctaaatttggagaggaaaagacaaggaaatgctcatactgcactccctcaaccaggctctctgcagaaatcttggggggtatgtggggggatctttttgactgggcatggtggctcacacctgtaatcccagcactttgggaggctgatgcgggaggatcacttgagtccagaagttcgaggctgcaatgagctgtgattgcaccaccgcactctagcctgggcaacagagtgagaccctgcctctaaaaaaaataagataaaaaaagcagtttttcaagggtgtacaatctcctacagcattctatctattctttgattaattaccctcaacccatttagccattaatttattgaacaatgtattagacatccacttcgttccaaagactctactttagggttgaaaaaaacctaggggtgaacctggcatggtttttgccctcaaaattcttaccctatgatgggagagagggaagatatgttcatgattaagctctaagtcagaatggtgaaaaaaatcctttatagaagtacaaagatggagcatgcctcttactaaatagttgtaagagcgagcaagagttactaaagcacttcaggttaaggggaggcagagggtaaggcaggttagtgatagggtacttgtaaaatctccaaagcatgaaaaattttctaatgttttgaagtagcagaatataaagtttgtaggagacaatgtccaaagaagagactgaaatggtagtttgaagccagtctgtgaatccattgaatggaacacttcacagtttagttgcctcttcttgattacagagacttacagaggcatttcaactggaaagtgtttgatctgctttgttcatttgaggaaacaactttgctggctgtgaaaaatgataaacagcatgagggagaatttgctggcaaaaaacaaaacaacaacaaaaaaactaagtttataatgcaacagtcccattaaagagtaacatgaggtgcccttatatacttttagtggcaatgtataacatttggaagtaacttggtagtacttattaatcctttgcaaatctttgcccaaatgagtgacagggtctcactctgttgcccaggctggagtgcagtggcatgaccttggcttactgcaacctccacctcccaggttcaagcaattctcatgcctcagcctcccaagtagctgggattacaggcatgtaattacatgcctggctaatttttgtatttttagtagagatggggtttcaccatgttggccaggcttgtctcaaactcctgacctcaagtgatccacccaccttggtctcccaaagtgttgggattacaggcatgagccaccgtacccagactacaaaaatgtatttatggggatgttcaatgcagtagcagctcatatgtccattcatagaagatgggttaaactctgacgtagctaaaccagctaacacttttcaaccattaacaaagaatggtagagtggaatgtggtggcacatgcctatagtcctaactactcaggaagctgaggtaggaggactccttaagcccaggagtttgaggtcaacctgggcaatatacaatatagtgaggccctgtagagatctataatatgttctgctgtaaacataagtccacaatataagggccatttttttttttttgagacagagtttcacactgtcgcccgggctggagtgtagtggtgcgatcgctgctcactgcaacctccacctcccaggttcaagcaattctcctgcctcagcctcccgagtagctgggattacaggtacctgccaccatacccagctagtttttttttttttgtatttttagtagagacagggtttcactatgttggccaggctggtcttgaatgcctgacctcgtgatccacctgcctcagcctcccaaagttctgggattacaggcgtgagccaccgcgcctggcctaagggctattttttaagttgcaaaacaaaaacaaagttttaacagttgtcattctgatatgtagaattattaggaaacctacactatttattttttatacttgtatatactttgtggttttgttgttgttttggttttttgtttgtttgtttgtgtgagacagagtctcactccgtcactcaggctggagtgcagtggggcaatcttgggtcactgcaacctctacctcccaggttcaagcaattctcaggcctcagcttcctgagtagctggactataggcacacaccaccatgcccaaataatttttatattcttagtagagatggagtctcaccatgttggcaacgctagtctcgaactcctgacctcaaacgatttacccacttcagcctcccaaagtgctgggatcacaggtatgagccaccgtgcctggcctatacttgtgtatactttgaattgtttcttttttcttttcctattttattttattttattttatattttattttattttattttttgcgacagggtctggctctgtcacccaggctggagtacagtggtgcaatcatgactcactgcagcctcaagctcctgtgctcaggtgatcagcctcctaggtagctgggactacaggtgaccaccatcacacccagctaatttttgtattttttcatagagatgaggtttcaccatgttgcccaggctggtctcaaattcccaggctcaaatgaacctcccacctgggcctcccaaagtgctgggattacaggtgtgagtcaccacatccggcctgaattgtttctattattcacatataactttgtaatcttaaaaaaaatacttaagactttaaaacaaagatgattagagcctggattaagctagtgtcggcagcctgaggagggaaggttttggatgccattgccaaagtagattgaagaggaattggaatttgagggatgcaggtgattaaaggagagggggaagagtcaaaggtgacactcacatttctagcttggtaaattggttgtttgtttattccattaatagaaatagagaaaagagacagcagaggagggcttcattgaggaggatgactttgttagtttcattttggatttaagtctgagggtcctgaaaaggcagctatatgtttggcttgaacctctccactttccaccttctcagtaattcattaatattttggatgtcctagcctgttgatgtgtgtgtactggaggtggtggtggtgggagctaatatgtttagaagttaacatttcatctgtctttatccttttactctcctttcattcagaccctacaattattgctacagggaagaaatgtggccttgcctgtgaaaatctagtttttggaattttttttgcttgttttccccctaaaatttagctccaaaagagagaagattcttaactagtggaaaaaatgtcttggtcagaaacaggagaaagaacatagctatcctagacaaaaataataataataataataataataataatcataaaagcaagggagggagggagaaagggaaagaaagagagacagaaagaaaaaagaaagaaaagacaggaaaggaaagaaaggagggctaggcatattgcctcgtgtctataatcccagcactttgagaggctgaggcagaaggactgcttgagcacaggaggtcaaggctgcagtgagccatgtttgtgctgctgcactctagcataggtaacatagggagaccctgtttcaaaaaaataaaaaataaaaaaaggaggaaaggaagaaaattccagtagaataaagaaaaaaggaaaaagaacaatatttacaagtacctgcagagagaaggtgagaagatgaagacctgttttctacttttttgggcagcactgctaaagaaataaaaaagtacccagaagtcgcaggactctaataaaatggaacatcacctctattcctgcctgttctttggaggagtagaaggtgaggaaatggggaagtgcaggatgagtgattctggagaagacatggctgtgctcatgttgggctgatgatgtcactgataactaaaacaaagggctcagccaggcacccagaagcctcagggccaccgcaccctaaggaccatgcaggctgagacaggactcttttcagtaatccggaagatggctccaccctctctagtccaggccataccctgggccatacccttagcagtgctacccaaaaaagtaaaaaacaggtcttcgtcttctcaacttctctctccaggttcttataaacattgttctttttccttttttctgtattctgttggaatcttcctttctttctttctttccttttttttttttttttctgaagcagggtctccctatttttttccatgccataccctgaaaaaaatctctggggagaggatcccaaagagacaaaggctaattttctcaccatgcttatagattaggggctttgagaaaatgagggtatgtttttaaagtattttaatagtggactgatctattttacctcctggaccagatgaaatgggaactgttccaattcatggagcaaccagacatacatgttcaaacaattatgaaaaacatacaacagatatttatcaacaaatacatcagtaaacaaacttacatgaccctgcttggccatcactgtttcttttcaacacacacacacacatttacaaatacatatatatgtgtgtgtgtgtgtctgtctgtcgatatatatgtgtatatatatatatatatatatatatatatataaataaaataaataggtaagagctgcttatagccctgaatccccacagaaaaccccgtctgtctttagtttcatgaaagcattgtactttttctcattatttttcagaccatcacagacacttctgatcagtgttccacttaagcttagccccaaatacacagaggaattttatactgaaagttaaagaagcgacagtagttagattatctcatgcctcctagattggctggctttgagcactttttcaaagtgtgtaccaactagggtttgtccaccaagttgcaatggcttgtatttgagtcagccatacgtgctcatggataaaaacaataagaactctttattaatataaatatactctgtgaaggcaaagatgtgctttaaaggaaatttctgagcatgtgagaagtagatgagttacatgaggttaggagcatgcagctgtgaccctaaatggggagaatacagccccagggagctgtgatgcacggccactgggaagctaatgaaatgggcagagccaggaccagtggggtagaattaaggcagaagcttccctcttgtgctggacattgtgctggtctctttcctgcccagcacatgccaggtaggaggctataatgtgatcatgggtcattccatgccacaggaatggattggcctgagctggccttcttcataatccaggaataaggagaagaaagaggtaggacagaagatggtcctttatgggggatgagggggatggaggggggaagcttctagaggaattggaattttcacagaaagacatttctgcttagatactaatacagacgtacatatttggacaatatacatgtagaataaaaattatttgaattacttcaacaattatgcctacttttcaaaaggctttgacatcagctatataatttagccatttggcaatattaatcataacttactaaactaaatttgacattgggataacagaatggtaaaatgcaaactgaaatcatagctttatgatcacatgaatttccttcaacagctgttcactgttattactacttatacctttgttagcattccaagaggatctgataatcatagctagcattgattgagcaattattatataccagacattcttctaagtgccattatctcatttaccctacataacaaccttatatggtaagtatcttttcctagtgccttttattgatgacatgaatgaggcacagaaaaaataggtaacttgttcaagtccacacagctagttagtggaagagcaggaattgaatccaggcagggtggtttcaatacttcagtcttagacataataccatattgccttcctggtacaatggatgctttacgtaggaggtgttatagggagaaattcccacattttcctttttatacttgtatattgtttgaatttgtttataataaggatacatctcttttgtaacttgaaaaccacaaagaagaaatagaacaataaccccattcctttaaaaatagcattgcagtagctatttcaggtagtgagatatcaaactggttttaacttttttgtttatttgttttagttttaagaatatccaaacaaagacggatacatgtgaaaacttgggacagtaaaattgtgacctttctataaagacaaagaggtaggaatcaagccaaagtgagattaggataatgtcaggtcttagtactctattctgcataatagtttattttaggtaattctctatattggttggcttgctgaagctggtgtgtgtgtgtgtgtgtgtgtatgcgtgtgtgcgtgtgtgtgtgtgtgtgtgtataaaaaatctttttagtcgttcttttttatttgtgcttctcaacatgcttaagcaagtgatatctttccatataaggggcaaaagaatttggggctgtgaggcaggctgacaaagaggaaatatatcctgtctaagcaagcaagaaaaagggaaaggagtgaaaattcttgcaacatttagctcttccgaaaaaaaaaaaaaagtggtcatgatttctcctatagtagttgatttgtcactttacacaaaaggcctagaaacatatccattatagatatgcctccttggggctcagcctctatctgtcaagtaggggtaatgggtcaatggaattgattatgtgatctataaactttgttccagctttaccatattgtgaattttgaggtttggtcaatgaatatgcaaatccaaccagaagtatcattggatacaaaagtatccgtatcatttttgagaataaaatttccaacagcatttttatatatatcagtgaagatctgtgtcacaaaacaaaactttatgaaataggaaataatctggctgatctttgacagtacaaaatttgacattccaagtcaaattttatgtttaggtagaatagggaagtattggttttgcagttttaccatatcaacacatataatatttctgcatagaaaaacggaccatctaaatgggaaaggggagagccaactagtgggtaaaatgctgtaacagtattttaatgctcaaggcccaattatgacttgaagatgttgttgtactgattagcaatactaactgaaaatttttctaacaggttcataacctaagtattttccagctatatactgttggtctcagggattggcaaagctgaatcagaacacttctttgccaagacttgtctgcaaattcttaacctttttttgtttgccaagaacaaagaaaaattgttgtaaacttagctgctgctgtaacatatgagcagtcttttccgaaaatgcaaattagacaaacaagaatcattacatcatttgcagaaatgcagttacatttggtttctgctattgtgtgtgtatatatatatatgtatatatattactttcatatcttacttgataccttttgtagtgctttaccattttcaaagcacttgcatatgtgtcgtattatttgatcttttctgagatccaaagtttttaacatgcttcatgcttgaaaactttgatacttcaatttatatgatgcatgtaacatacaacaaatgttttgattatggttgtatggaaaattcttattatatccccaaatataggttacacattttggcaaagtaagcagttattgatttttattgccacatgaactggattttcaaatattaccaaatgcatgtgtttttgtttttgtttttaatacaaaaacatcatctaatggatagtgatttatgccagtatgtaggaaataagcaagtattttgggtcaggtggattactgctgaagctttgattaggcttgaaaatttgatacactggaaagctaactgttaccctatagattactaacaaactcattgcttcaaataaaactgttattgattgttcagattaaaaaaataatgtcgacttttgttttagattcagggggtacatgtgtaggtttgttacacaaatatattgcataatgctgaggtttggggtatgaatggtcccatcacccaggtaatgcaagcaacatgattttattcttttttatgactgtgtagtattccatggtgtatacatatcacattttctttatccaatccactgtttatgggcacataggttgagtccatgtctgctattgtgaatagtgctgcaatgaacacgtaagtgtgtgtgtctttttggtagaatgatttattttcctttggatatatacttagtaatggaattgctgtgttgaatagtagttttaagttctttgagaaatttccaaactgcttttcacagtggctgaactaatttagattcccctcaacagtgtataagcattcccttttctccacagcctcgccagcatctattattttttgacttcttttctgactggtgtgaggtggtatctctttgtggttttgaattgcatttctttgatgattagtgatgttgagaatttttttcatacgtttggtagctgcttgtatgtcttcttttgagaagaagtgtctgttcatgtcctttgcccagtttttttgttttgttttgttttgagacagggtctcgctctgtttcccagaccagagtgcagtggtgtgatcagctcactgcagcctcaaattcctggctgaagcaatcctttcacctcagcccccaaatagctggaactacatatgtgtgccaacacacccagctcattaaaaaaaattgtagaaacaaggacacagtatgttgcctgggctggtctcaaacttctgagctcaatgatcctcccaccttagcctccagaagtgttgggattacaggcataagccactatgctcaggcctttgctcactttttaatggggttatttgttttttgtttattgatttaagttctttatagaatcttgatattagacctttgcccactgcttagtttgcaaatattttctcccattctgtaggttgtctgtgtactctgtcaattgtttcttttcctgtgcagaagctcttcagtgtaattaggtcccacttgtcaattttgtttttgttgcaattgcttttgaggacttagccataaattatttgccaaggccaatgtacagaatggtatttcctgggttttcttctaggattttaaaagactgggatcatatgtttaaatatttaattcatcttaatttttgtatatggtgaaaggcagcagtccaatttttcttctgcatatggctagctaattatcccaataccatttattgaataaggagtcatttccccattgcttatttttgtcgactttgtcaaagatccgatggctgtaggtgtgcagctttatttctgggttctttattctgttccattggtctatgtgtctgtttttgtatcattaccatgctgtttttgtatcattaccatgctgtttttgttactgtagccttatagtatagtttgaagttcagtgatatgatgcctctggctttgttctttttgcttaggattgctttagttattcaggctcccttttggatccatatgaattttagaatagcttttctaattctgtgaaaaatgatgttggtagtttggtaagaacagcattgagtctatagattgctttgggaaatacggccattttaatgatattaattcttccaatccatgaacatggaatgtttttccatttgcttgtgtcatctgtttgtttctttcagcaatgttttatagttctctttgtaggtatcttccatctccttgcttagatttattcctaggaattttaacttttgtgtggctattataaatggcattgcattcttgatttggctctcagcttgctgactgttcagattattgttttataaaagccacaaaaatgttccattagctaaaagtcacgtttcttagttaatagaagtcatagtacataagaaggtaagagtgtcaaattattactagttgtgaatgaattattactagttgtgaaagaatagcaattcatggttttgtttggtcagcaactactgcaccctagtgatgatgaattctctagcagattggaaagatacttagggagggaaaaaagatgactttattaaggatctctggaaataggaaaatatttaagaaattctataagtaaaaatgagtaattttatgtcagaataaaataaaatttggctgaatttatagttctccatctgcctgcttgcacctatttggggcttattttacctttgtggttaccctgagaagcatggtatggctggagcctaagtgagttctttgttttccaaccacattgtcctcttttctttttataaaatacatcaaattccttgcaggtttgtctgtctggagtacttacccaccttctttacttagtaaagtactacttcttttttaggtgtccatttaagttcaaatccttgaagaacttttattttgtaataaagattagattcatatctcctgttaaacactcttatagtattcaggatataccttctaagtggtacatgtggggcggccagcagaagaagattttgtattaggtatcacatttgagaggaaggaggccccgtggaaaaagcttcatcaaaagaaaacaaaagaggtgtttatatgtttctcaaaaggcatgtatctatgtgttggtgaaaactgccttaataagtattacatgtctaatgtgtgtatactaacatgcagctctacgaaatatacaaaaaagttaagcatatagcctatgcttttgaaagcttgagatatatttggggaagtaactatgaagggatgtcccatgtagcctcatatggagcataaaataatgaaatgctatttattatatgtcatgtatgggactggcctgtatggggtcatttgagtgctaagacaagatttctttaatttgcagtactttcccacaatattcatatgagttaatacattatacttaggaaattgcccctaagataattaaattaaaaatatattaccatattaacatgtaaacacaaattggtttaaatgttctctagcaaagatcaaatctaggacagagaaacaggagaagaaaacaggaaaatggggctcagagcaggggaatgctgtgttgtttaaaagccctggatgtcaagatctaaggaaaagataaaaaaaatagaaccaccaccaaatataaatatttatttccatatctcacaattttttcctaggccattgctggtgacagactttccagtccttttcagaacttactcatcacatccttttcatgcttgttattttgatcctgaacatccttgcaattcaaagagcatacagaggcagagtgaaattagcataatgtcacctattgctatgatgctcgttacctctacctccagaacatgccaaggaggcttccaggagccccagaaacacagaacagcaaatcttcaaaagcccagtgcccagagcagatagagaagaaaattctattttgaaatccataaagaatctcataattccttgcaatatctagtcccaattgtgtgggtgacaaactgacctatggcagaattaggaatgtgaataggaatgaggcttggagttccccattcctgctgccctaactcccactggaatgtaatttgtacaaagagtgacgacatgtgaagatgtaaaaaagaggactagagatgtcctcctgagctgcacaaggaagaaagctttttatgaccatccaattctgcaaaggacctagtttcccagtgcttattaccataaggatgcagaaagaaaaaagttcacagacataagatttcatgtgaaaaccaagaaaaaaaggttactgtattttttaaaggaatagcatttgatttggtgtaatggcaggataaagaaatgagaaataacagtggggaaaaaagttgactacaaagatgtgaataagatcagatggcatagtaattttattcgtaattaaaaatctggttcagttaatggagagatttaatttcaggagcattaactagtagactactggatacaatgtacatgtttaaataaatcataaataagtttctcctaagagctactttaatgttgtagcattctaactaatgagtagtatgacaaaattacgttgttattataatagcaatgtatcagtttttctgttgatgaaatttcttagggttagaatttttttttaccagatatgaaatagacttacacttaaatactgttgaaagttgccatataatgtggctattatcttggagttaattaaagttaatttagttttgagcattattaagctctttaagaaaactggaagacatcaaattcttataaaggaaagcaggacctatttgttaaaacaaaaagaaatagctctgtattcaagagtagttttctcaatggatactttgcccgtaaacattaaaactcactaacacttaaaataaatagatttgaatggatggctcttaccacaagttaaaggttgttatttcattaagctaaatgtagtacgtataactgatttttttttttgagggaggaggcattaccttggagaaggaaatggcttcagataacatctatgaaaataataataataataataatgagattatacgcaagatttgaaacattttcagagttggatagaaatttacacaaaccagatttcccctgggagatcctaagataaactaacaataatgtcacacacatatcctgttattttatttactaaattctaaattaaatttctgctctggtgctatgaaggtcacccagcgtactcttttagataatacaggagattccaggattgaaccaaaaccaagctaagcagaatattttccttccgagagatttgaaatttgtgataaacacgtttgattttttgtgtgacattatttggtaaaagtaactttttcagaagctcccccaaatctctatacccttctttgtgccaccgtgttttcttgtgtattggaggtggataagcaaactgcaattgggatagattttcacctaaatttctcacattttcataagtgttctgttcctcttatttactgcttgcaatccacatgtgtatactgcacacacactcacacacatatacacacacataccctcatattctaaagaataaaaacacaggcactgtaattgcatatgtgtatacttagggggttaaagcctggcttcaccactcagtgctggtgtgaacttggagagcttacttagctcaggtccttttgttttcttctgttgtttgtttttgagacagggtctcactctgttgcccaggctagagtgcagtggctcagatttcagctcactgcagcctccaaattccgggcttaagtaatactcccacttctgcctgtagctggtaccacaggcacgtgccaccttgtccagctactttttttttttttttggtagaaacagggtcttgccatgttgcccaggctggtctcgaactcctgggctcaagggatccacccgcctcggcttctcaaagagctgggattacaggcatgagccactgcatccagcctagcccaggttctttacctgtacaatggggataagagtactgatatcacagggtggttgtgaaattaaaatgagatatgtagagatatgtaaagctcttactaaagtgccagcaatataggaaagaacaacaaatgacatttactctttttatgttgtctaaagtcatatgagtatatagtgaagttttcagcataggctctgtgtgagaatacagtagtccccccttctttacagttttgcttttggcagtttcagttatctgcaatcaactgcagtctgaaaatattagataaaaaatcccagaaataaacaatttctaagttttaacttgtgcactattctgagtagagtgaaatctcgcccatcctgttctgtccctctggggacatgaatcctctctttgtccaggggatctatgctgtctacactccccaccctttagtcacttagtaaccatcttgatgatcagattaactgtcacaatgtagcagtgcctgtgtttaagcaacccttcatgtaatcatagccccaaagtacaagagtagtgacatcaacatgttattattattattgttcttttttattattaagtattgttgctaatctcttactgtgactaatttataaactaaacttgatcataggtatgcacgtataggtaaaaaatagtatatatagggtttggtactatccatggtttctggcatccactggggatcttggaacatattccttgtggataacggggaccactgtagaggcaaatggatatagaatatcctttaggtttatttttttgtctgtctttccctaaagcaataaatataaagaaaatctaaatagttggttttgacaacacataggtgtattatattctgcctttttagtgctcagtattccaatatttcattttgtagatgtgaaaattaaggtaatcaagggtggaaatgcttattggagatcatggaactggctcgtgatgcaacagtcatggagtgctggtttaaccgagttgaatacaacacgaatgcccccatgaaaagcaatgaatacagaagtgctcaaaagagtttacctaagaaaataaataggaagaataaaactcaaagacagagaaggtatattaatattcattatcactgaagagaagtaaacttaattttttaatattataagttaatgacctcaagcaaagtcagatattgaaaggtgatcgtttcaaagattgaaactgagtgaaaatatttcaggaaaagagagttttagctattcttaaagaaagagaaaaaagcagattcaaggatagctttttgaagaagatacagcttgaaatggcttcttttactccctcagttaaaagtggtaatggatgtgcctaactaaaattcccacaggaaaaacttctttagttcacctctctcttcctgctttttttagttgatttcctatgtaaatatgagagctcttaataaaaatatgacagaaagttggaaagagttttcctgaaataaataccagatgagtatagtggttacttgaattatgtgcagaaaagaagatgatactctacaagctcggcttttcggcgacaaatctgaagtccatctccattgtgagtatttcttgtgtggcttggacttcctccattccagagaaagaatcagtcctttgggaatccatgaagtgtgtcctactgtgccaggcctcagccactaacacaggtccctagagagccacgctgtcttgctccatgacctccaatgagaaccccttcttactgccctttcattgattaaaacgagacatttgctgggacctcattgtgggctaagcacattgcagtcagtttccacataatgttgctcattggatcattattttaatttttctctctttacctcccccacagctgtctttccttatctgcaatgttgcatgcacaatatttactttcagcaaatgatgtaaatcacccttgaatgaaaagactgaaggtgcctcacctttcttcttcctgtcctattactgtgttctcatggccttggattttctctggataaccacgtatcctagttcatgcttttgtgtcataaggaaaagttggcactcccttttgaaaagctaaacttcccttcctgctattcatcctgacatttctgccctttattaggaacttgattcaacaattttctcttctcttatatcttcaatttctccctttcttgtttctttcctttaggcttaaaaatgtctttaacatccttaggtctttcctattgttaaaaacaagcaaactcagaatccttttctcaaacttaatactttgttgagttggcacccaatttgcctttttttttttttttgagacagggtctggctttgtcacctaggctggactgcagtggtgccatcatagctcactgcagcctcaaactcctgggctcaggtgatcctcccacctagcctgagtagctaggactataggtgcccaccaccacatctggctaatttttgaatttttcatagatatggagtttcaatatgttgtccaggctggtcttgatctcctgtgctaaaacgatcctccaccctcagcctcccaaagaagtgctaggattacaggcatgagtccacgcccagcccttaatttgtctatttttattgttaagtttctcaaagaaatgctcaatgcctgggtcaaggacctctacagatcttgagtctccttaggacatccctttccaactactcatctatttgatgccagattttctacatgtacttcaaccaaaacaacatattgcaacagattgaatgcagaagcagatatgagaatctgctgccttctatgaagcaagacattaaagagatttgcaaaaatgtaaaccagtgctctcttcttttcaaaattatttttattagggaaaatatatttttcataaaaactaggttatttatattactatttaatggagttagcgttgctatttttaaaagagtttatttaaaaagtcttaacttctttagtggtaatttctagtacggtaaacactggtagatttaacccacagaatcagaagctctttgggggtcctcagtaattttaatagtgaaaaggagttttaaaataaaagtagttgacactttatgaggctgaggcaggtggattgcttgaggtcaggagttcaagaccagcctgaccaacatggtgaaaccccgcctctactaaaaacacaaaaattagttgggcatggtggcacgtgcctgtaatcccagctacttgagaggctgaggcaggagaatcacttgaacctaggaggcagaagtgagcgagatcatgccactgcactccagcctgggagacagagtgaggctctgtctctgaataactaactaactaactaactaaataaataaataaaaataggagttgcaaacagtaggtctatatccgtgattgcttttcctcaccactgttgcctcctttttttaaatctctgaccaaagaactggctccacttggtgtcctgtatcagatttcttgggccggccatggtggctcattcctgtaattccagcactttgagaggctgaggcaggaggattgtttgagctcaggagttcaagaccagcccgggcaacatggcgaaactctgtttctataaaaaacacaaaaattagctcagtgtggtggcatgtgcctgtagtcccagatacttgagaggctgaggtgggaggattgcttgagcctagagggtggaggttgcagtatgccagaccttctagatacaagcaagcctcttaccttagcttcctgagtggctgtgatttccctagtcttttatcctccctagttgctaagcaatgtttaacagtgcctacctctcatttcttcttgatattctttccttctacggcaacaaattcccctgatttcttcccaaccttcctgactacccatctttttctctcttggttcctttttcctgggagctgtattttcctcttagctgactcagtatgcttttccttaaagattttttttttctattgcccttccaaaattttttctagatccaaagcctttctcacagtgtcaagaaaaaaacattccagttgccagatgaacagcctgtttcagtatcatgggtctaaaaccagacaccggtttttcctccagcaattcttctggttaacttgatgcctctgtctatcatggaaaccgaatttcctaagtcatgcggatttaaaatgctagaaaatttcttactcctgtcaccactacatctaatgaatcagatgttctgtttgttcttgtgtcatcccagtccactccctgacaaagcatatctgcaagcttatcatcataaacctaggctatttcaatgctcacgtattaaccgctcatcacatgaatagaatttcatttgcctgatttaccctacacagcccttcaaatttatcaacgaaatcactggttttcaacttttatttttaagtaggaaaagcttttccgttaagtttttgcaaacaaatataatgcaatccaatatttgccctccagagctatgccgatttaccgctgaaaccttgagcaaagaaatactcaaagcttcttctaggttgtgtatgtatcacaacagaggaaggaaattatgagatgggcacttgggagactgttttcttggttgccctctccttgtgaaaggtagggctacaagcccccatttgagccaaagctaaggagtccggtgcccatgaaaaagacgcaagcaatgctgtcctccttgatggaggctgcagaggccagaaccacacctgctcagcctggccctgaggctgcccctgtggcactgctgaaagtcagtcttttgtcacaaggaaggcagtttttctagacaagattattctcatcttaagcatgaggtaggggtgtgtgtgtgtgtgtgtgtgtgtgtgtgtgtgtgtgtagtgtctaagtctacttgcctgctttctgggaactggtaagagataggaagatagaagtcatcatcattccaaatgtaggctttcacttaatttctctattttcagtctgagaccacacatttacacgtctctcagcctgcatccccaagctcaaaatatttctgctttaatctcttcagagactaaacctcctgtcccccactacatggagaaggcttggttacctgttattcaaggtgttgcctggatctgtgtatatactttaattcattccctctgttttcagcaccaacacccgccccctttcctcctagcttccttggtacttggtgcctccaatttttgaggctttctataattacttagcacaaatcaactttcttgttgattttcttctttataggagcatagatttcagcatttgtgactttgacaagtcagttgttacaaattcatcagctgcccatctgataaaattttaatgtcttttctactctatctcttctagcttttcttttcttgtgtgtcgatacccattttatttctttacttaccctcattttagtggcatttcaaaaggcgtactagttacctattgctatataacaaattaccataaacttagttgcttaaaacaatgcacatttattctcttagagtttctgtgggccaaggtactgggtgtagctcagcttggccccctactttagagtctctcacaaggctgcagtgaggtgctggccaagactgggatctcatgggaaggctcaaaaggaaaagcatctgcttgtatgctcctggagttacaggcaggttttagttcctgatgagctgatgaactgacagtcttgttctttagtgactctgggccagaggtcaccctcatcccttgccacatggctctctctctatagcagtttgtttaatcaaagctagcaatggtgagaatctgccaacaaaatagaagtcactattttgtgtgacataatcacagaaatgacatctcatcatgtttgccacattctattggctaaaagcaagtcaccaggcccgcccatactcaaagtgaggagattatacaaggcgtaaataccaagaggcagattagaggctattttagtctgttgatataggaggccaaggtgataaacacatgggtccaagtctctctctaaaactggagtcccctctctctcacttccatcaagcttacagtccacttctcctgtcaaggtcaagtagtgacctccatcttgcacaatccagtgaactatcccaagtgatcatcatactcaaacaaacaaccagtagcaactgacatattctcttcctgaggcattttatttctttggatttggggatccctcacctccttgtcttttcccttcatctcttgtctctgactcacaggctcctttgttcattctcatttttcttccttttggagggctaaatgctagaggtctacagggctccatttgtagcccttcactcttctgtaattgtacctaagaaatctagtctcatgacttcatagtccatgtatatattgatgactcttacatttatatctccagctccaacctttcccctatgccccagatagtacccaattggcatctgtacttggactcaaagacattgcaaacttaatttctcaaagaattaaaaatagaactaccattcgatccagcaatcccactacttggcatctactcaaaggaaaagaaatcattatatcaaaaagatacccccacttatatgtttattgcagcactactcacaaagggcaaaaacatggaatcaacctaagtgtccatcaatggattggataaagaaaacgtaatatatatacatacacatacaacacacacagacacacaccgtggaatactactaagccataaaaaataaaatcatgtcttttgcagcaacatggatggaactggaggccattatcttaagtgagataacccagaaacagaaagtcaaatattacatgttctctacttataagtgggagctaaatatgtgtaccatggatatagaaattggaataatagacattggagactcataaagttgggagggtgggaagggttcaagggatgagaaattacttaatgggtcaatatacactaaaagctcagatttcatcgctattcagtatatcagtataacaacaaaactgcacttgtaccttctaaatctatacaaataaaagctaaaaaatgaaaacaaattagacatctcaaatgacaacttaatgcagaactcttgatttcctcatccttccctgacctttacctaaaaacacactctgcccaaactgatgcccatttcaataaatgtcactaccttccacccagttgcttaggtggaaatccaggcattttctttgttcctcttctttttttcacaccccacatacacttctcactcagcatatcctgacagcgccaccttcagaatatgtccattatccaaccgcttctccccagttctcctgcaatcacccaggcgtggtcatggttgtctcttgcctccccttgactggtacatgtgccgttcccctttgcatcaagcttacatctgctccaggatgtttatatttgcagttctctccacctgtaattcttatccttctgatttgcatgtaactcactcctttttatcatccaggtctctccttaaataccacctctttggaaagccttccttgatcactctgtgtaaaatagccaagcctccgttattcactatcttcttttgctcttttatttttcatatatgactacgtgaaagtactgtctgttgttatatgtctagttacttgttatgtgagtataagcttaatcaaggtgatgctttattgcacttagcgctgtttccctgcaatccagtacaaagcccagtatgcaagttataggcatgtggtaagtgttggatatgtgcaccagttgttggacaggattgaacttgcgaggtcagctttctcaggtgacctcaaaggcaagcatctagtttattgagtagtacaacaataggtatgttgcatgtacatatatgtataacagaagtttatttttaagcctgaattagtgatagcaactctgttcatgagtgattatgtggttctttttcatctttactctttctcagagaaattcttctcttcttcccacattgtttgactgcttagagtagataatagaggagtggtaagatgtctgagtatataatgtaagggggtttggttcttgtcatatatagaatacatataggtcctattataaacaacatatggttcttctcatatatagaatacatacaggtcctattaaaaacaacatattgtagctttaattcaacacacgactggttcttgtataaagtttcactgagatctttattgtggagaattgcatgactattccagtcctggactcaatttgaataaaaacataggaaccaaattcctccactaaataactgattgatacttaaatttgacaacgatagctttatagaatagtccagaacatatacagtcgtacctcacttaacaatgtggctacgttctgagaaatgtgtcattaggcaattcccgtcattgtgtgaacatcatagggtatatttacacaaacctagatggtatagttcactacacacctaggctatgtggtacagcctattgctccttgactgcaaatccatacagcctgctactatactgaacactgtaggcaattgtaacacaaaggtatttatgcatctaaacatatctaaacatagaaaaggtacagaaaaatgcagtatagaaaataaaatatggtacacctatgtagagcacttctcacgaatggagcttgcaggactggaagttgctctgggtgtcagtgagtgagtggtaagtgaccgtgaaggcccaggacattactgtatacggctatagactttataaacattcttcacataggctgcactaaatatgtattaacaatttttctttcttccaaaattaacctaattactatatcttttcactttataaacttgtattttttaaaccttttgacttttgttatacttactttaaaacacagacacattgtacagctgtgcaaaaatattctttcttcatattcttattctataagctttttctgttttaaagttattattaattattattattttactttttaaacatttttgttaaaagcacacattaaacacacacacacattatcctaggcctacacaggatcaggataatcaatatcactgtcctccacctccacatcatgtcccattggaaaaagtccagggacagtaacacacacggagctgtcactttctgtgataacaatactttcttctggatacctcctgaaggaactgcctgaggctgttttacagttaactttttttcagataagtagaaggagtgcacttaaaagaacaataaaaaggatagtaaatacatagaccagtaacatagtcatttagtgtcattatcaagtattatgtactgtgcataattgcacggactagccctttataccactggcaggacagtaggtttgtttacaccagcaacaccacaaacacgagtaatgtgttgtgctacaatgtcactaggtgataggaattttttagctccattataatccttttttttttcttttttttgaggcggagtctcactctgtcgcccaggctggagtgcagtggtgctatctcggctcactgcaaggtccgcctcccgggttcatgccattctcctgcctcagcctcccgagtagctgggactacaggtgcccgccaccacgcccggctaattttttgtattatttgtagagacggggtttcaccgtgttagccaggatggtctcgatctcctgaccttgtgatccgcccgcctcggcctcccaaagtgctgggattacaggcgtgagccaccgcgcccagccagctccattataatcttatgggaccactgtcatatatgtggtccacggtttagagtatggaaatgactctatttccatacagtacttccaataataaattaagttgtttgatttctagattgaaaatggctttgataatcttgtaattggatttatatgcctttgagtctctcaagtagaactgatttacctttccattcctttctctttcctctctggtcacatccctattccacatttgttttttttgtaaccagatacacaaataatactttgtattaagtggttatagtgaaagctgggcattctgttctagtgaataatgattcttatattccaaggacaaactacctattaataataattgggtattcggggcttaaaagttgtatttgaaagatgcagccaggtgtggtggctcacgcctgtaatcctagcactttgtaaggctgaggcaggcagataatctgaggtcaggagttcaagaccagcctgaccaacatggtgacacctcatctctattaaaaaagaaaatacaaaaattagccagacatggtgggaagcacctgtaattccagctacttgggaggctaaggcaggagaattgcttgaacctgggaggcagaggttgcagtgagcagagactataccactgcactccagcatgggtggcagaatgagactccatcagaaagaaagaaaggaaagaaagaaagagagacagagagagaaggagagaaggagagaaaagagagaaaagaaagaaagagatgttatccatgatttagtggaaatgagaaaacctagaaaataccatgcaattctaatgaaaattctagaaaactagaaaaaaggaaagagaaggaaattgagaagaccctgtaatctgttgaaatgctgagttttcctaattaaggaaagtaaaattctagtcacttaaaatgcctccaagaaagtcactgtttttgtccatttatatctttctgctttctttttcattttttccctaaaaattaattaaatattaattacttttagaggaaagattactctgataaaatggtcaagaaaagcaaagtttcttactttctgtgccaaagattttcagccaaagtaataaaagaaaaatcttaaaaagggaaactatgcaattcgaatggaagatccattttaaaaagttattgtggcagtataaaatgatactgtgtgctcaaatacctaaaaacttttgcaacttacgaaatggtatttttagtattacttagggtgttgtatgggtgtcttatgtaacttgttaaggtaaagaattttgctattctcaacttcagtttatgcatctataaaatgagaaagcgcaaaataatacttctacctcatagggttatcgtgaaagttaaatgacagagggataaatgaaatatttagtatagtgcctaccacaaaagccaaagctaaataagtgatagccaagaacaaacacagaaaacttcctaaataaaaatatgactagaataactgcaatgtatggaccaacataagcatgtttaagagtgaacacaggtgctattagtaattacacctggaccaaaagtataacccaggatgctccctgacatactagaatttatggtttctctatctataatctattaacatagcaggcagtaaaccttctcttttgtggagaccacacatgcaccagacaagcagagcctggattcaatagtgtgccagtaactcacccagattttcaagaagtaatatttactgggattatggattaatcagagcttgtgtttaccaaagtaaagttcaccaatgattcttcaaatatgttcacaagctaacttggcttatatccatttacttataaatcagaagattccccaagattttactgtctgcctgattaaagctagtatgtgctataagtgttttcaaaatacttttttccaaaactgtccttgcagttaaggtgctgttaattcaaagtacctatgacttcctatcagaaatgaaaatgacacttaatgagaacaaaacatgttttcacttgaaatgcaattaaaccaaattagagaaacagtgtttttctaactaagataaaaacagctgtgtttatgaagctgctctaatggtattagaatttctcttatggaaacttttgctttatttaagatatatgatttttattttaattgacattttagacaatgatactttcattacaattttttcagtcaagtatttctttagggaatctttcctataattcatagtgagctaatttgatcatgtattaatagagatttcatggagatttgtttttaaaggtttttatgtgaaacctttaaaaggcctcccaacaaaaactttacttcatgactagatatgatttaatcatgattatgtcaaaattgtaatttttaaaatgccttaagaaaaataatttctgcatacatttgtgtaatttttctaaaatgcaaaatttgtaacaatttctaaggtgtagaaaaaacatttacttaagttgctggtttttttaatattcatgtgtatgttttgggattttgtagatataacctatgccttagattactacatgttgatgtgacttgctgatgtttcaccaaaaaaaaaagaatgcttccatttctacacttaacatttttttctttatctttcataattacggtccataacacttggagtaacaacatgttttcctgtgtatatataatataaatggttatatacaaacaatagaagaaatacgcaatttcccaaaatgataacatttgaagacgtcattaccaacaacaacatcactagaaacattactgctgttaagagcttgatctagaaaatataagcttaaactgctctgtttggaaacagcatgtaatcgggatatttaactagaaattcaagtacaataaaatggatttaattagttatgtagctataaaataccttaaatttttttaggctatgtctgcatgggcaactacttaaatgtttttagattaatttattttagtcaatttaattttaataattacctcaactatatgttattttcttcctttaaataatcacagaacacgctgttttaggatcaggtagaagctgagacaatctcttttgaacaaattttatttttattccaaaattaattgtcctaaaaatagtacatttagccatgaaaaagagaaaacaagtaaacctatcaaaatgggacactgttaattaactaaacatagaaaatagattcattcattatccaccaaaaatttcaatgtacctgccaggtaaaagcaccatattcagtaccatgaaagtgataacgattccaataacagaacatcttccctcaaagaacttatcacatgtttatgtataagtttaaatgcattgaatgtcaaaaatgcagatagcgctttgatcaaggacattttagcaatgtattcagacaggatctttattttctagggttttcattataaggcagaaaggttagactaaagagtaatgttaaaaatacaaattatttttgtattctagacatttctataagaaatgtatggaaatagaactgtaattttggcagtttttgtcacagtgtcagtgagcaaatagatgtcatactcatgagtacagaaagaggacattctctttaacagccacatacttcttacccagaaacccttggagaagatttataaacccacatactcagaatatggtaatgaggaaatgctgtctgccctgggaaggggaagaggatctaaaacatttaggacaggtaattccacaaccatgccttaagataaatccatgccttgaaaagtaaaaagaacagcaaaaacagctagttagtcaaaggtcaagatagcaaaccctagctggtaaacttgtctgaatctttactgtattcctcaagctataaactatgtttatagactccttcaaacaggattaaattttggaggcattttcttaaaaaaatagtaaatccccactgtaaaattagttataggctttggacaggattcttgccaatggggctcagaggcttaagttttattaatttcacagtaactccaccttagttcacagatattttcaaaacatggaaagtgtgattgaagtcaggtaagtctaatcaaatatgagttctggtgccacagaacggtgatgttgaaatacttggcttttattggctatttatggcttttattggcatattaatgtcttttactgatgatctcaagttctgtctatagaaacactgatgtctgattgtaacagtttaatcaatgtataaaccaatctggatggttcagatctcaattccaacgtttcctttagaattcaggctcaatttatctaaattgggctcattatattattattaattttactttggctgtgggctgagttaaagcacactatgtttttgagcattctaagattgttccaggatttaaaaatttaagattactttggtttcttggaattatttaatacacactgcaattttccctgaaaaacacatgtaagctaaaatggctctatggaaatgttttatgttttaatgaggttgggaaacagagataaattcacctggtcataatcatatggtaaatattgatgaaaggaacctttttctaaactgcatagctataattctattccagctgattttgtagatttaaaatattttaccctgtttttgtgtctcttaaggagtttctgtttgggttatttgtacagatcaacagataaaaacttatgtcctagaacaaaaacagcacacttaaacacatcttttctttcaggccaaaaagtttgctgtttcaggaccatggacctccttaggaacatgtacatatttccctaatgaatccttaggctgtgatatgttttcgagttaaattgttattactgatagaaaagttctttatgtctgccataaatgtgcattaaagtttatatagcattcaccttcatgattggtgttttatcttactgattattttggcagagaacaaataccaaaagtctccccatgagaaataaaaacaaaccacgaccctctaaaaatagaaaaaaagccacaactcttcaggtcctccttggacccatggacaaggctcataaacctccttggtgtccattccatgttctgtgaatctggctgatggtcaaagaaagggctagagacaggatgatctacaaatagaggagattgaatttccaaatgaggtttgatcatctgctctttgtgaattttttccaattgcttccccatgtgccttggtttagcctttcaaaaaattagaattttatacccctaggatgtaaaataccatgtcagcgcactttttgtgcctggaatgcaccttggagatagccttgcccattgaccagctcttcatttttcagagggagaagaaagtgaggtctgggaaagtaaaatgcctgcccaaatccacagagctaagaagtagcagagcagagatcattaccacacattccaaactttcttcctatttatcatttttctccttgagccccttcttgtctgagacactacatcaattaaaattattttataactgcaacatcgtacaattgccatgtaacacattgcccaatgcaattcaatcttagcatctggaaacaatactcatttattaactcacactttgtaggtcagaagtctgagcacagcatagcaaagtcctgttcttagggtctcaccaggctgaaatcaaggtgttgaccgggccgtctcctaatctggagtgtggagtcctcttccaagtccattcaggttgttggcaggattaattcgttgtagctgtaggactgaagtctcttttcttgctagctgtcagccaggggcagctccaagctctcagacgctgccctcaggtcttagatgtgtggccctctcactatacgacagctacttcttcaaagccaataggagaatatttctcttcaggaaaggttcactccctttttaaggactctgctgatgaggtcagacccactcaagacaatctccctcttgattagctcaaagccaaccgactaacaactagtcaagagtggtatcccatcatagtcgtaattctcacttgtgctcaaaggggaggggatcatacagcatgtgtgtaccaggggacaggagtcttgggagtcatcttagaattctgtttgttgggccgagcgcggtggctcatgcctgtaatcccagcactttgggaggccgaggcaggtggatcacgagatcagaagatcgagaccatcctggctaacacggtgaaaccccttctctactaaaaaaatacaaaaaattagccgggtgtggtggtgggtgcctgtagtcccagctactcgggaggctgaggcagaagaatggtgtgaacccgggaggcggagcttgcagtgagcggagatgcgccactgccctccagcctgggcgatggagcaagactccgtctcaaaaaaaaaaaaaaaaaaaaaaaaaaattctgtttgtcggccaggtgcagtggctcacgcctgtaatcccaccattttgggagaccagcctggccaacatggtgaaatcccatctctactaaaaatacaaaaattggccgggtgtagtggcgcatgccagctactcgggaggctgaggcaggaaaattgcttgaacctgggaggtggaggttgcagtgatcccagatcgcgccactgcattccatcctcagtggcacagtgagactccatctcaaaaaaaaaaaaaaaaaaaaaaaaagaattctgtttgtcacgttggtctgattctactcattcaagtactagatttccttttgcctcctcttaccttctgctgccccccaactgagttggttcattgtcttccatcctacagaaatccagaaagggatgataagagaaggtaaattcagactagggtgacgaaaactccaaatccatgaacatatggcatttttattgggttcatgtattctttgcagctgtaagggcattggccagggataattcagaattaccttttcactaattactgaatagtaaaatttacctattctttgggcatgaagcttcttttaatacggctggcctggattcagagatgtctggggacacctgtgctgggttggcaggagcagcagcagctggaagtcaggggagagtggcaactaaagacctgccattttcttagtgcctatgcaggctgagactttactttcatgagctcatttaatcttcacaatggtgactgatacagtcaatattataatcctcattttacagatgaggaaatagcagagatgcagcagagtcagagttcaaagctcggtcagatacaccagtgctttttcaaggacaggcttctccttctcaggttttggttactcttgttttcttttttcttttttgagacagagtctcgctctgttgcccaggctggagtgcaggggcgagatctcagttcactgcaacctccgcctcctgggttcaagtgattctcctccctcagcctccggagtagctgggataacaagcacgcgccaccatgaccacctaatttttgtatttttagtagagacagggtttcatcatgttggtcaggctgggctggaactcctgacctcaagtgatccacctgcctcggcctcctaaaatgctgggattacaggtgtgagccactgcgctcagctgagacagtgaccctctgagggtctcagcatatttaggcagagattgggggatggcggagggagctactgagtgacaggcaccctctgagagggagcctatctcaagcaatcaaaaaatatcaactatatgtagggactctttctcccttcaagagttacaattaaacttttcagaaatcaagatcaaggctatagatgataaaaattttattcctaaaggaatttatagacaagaaattgattgaaccttataataccccatgatggttcatgagaaacacgtgttcatatgattataccatgtttttaaatatggggaaataaagcacagagtaggtgaatgtgaatttagggacatcaaaatgtaatgacaaaaatcagctaggcttgttcttgaatccctcaaactgtaacttttggctgaacaaatgaattaagatatagctaatacagctgcagagcttggaaaagttacagttgctttgttaaagtatattgagttggagtaaaaagttctatttggaaagatttcaaaacccttcaatggcagcccaatcattccgaagctgaattaaatgtaaattgtgaattatctgcatacgtttatagtctattcattttaatatacatacggtggttgtgtactttaagaagataaaaagatgattcctgaggcatcattactgcatggcagagagacaaacttgaaaacaagtaattataataatgcaagtgttaaactgaagatacagagaaggaatacacatattccacagtcactggttccctttgggaacatcaggaaaaaacagaagaggaaagttttgagttgggtctggaagaatggaactttagcaggcagaaaaggagaagaaaattccaagtggtaagaaaaacacagttaaaatcatagaggcaagaaaatataagaggctagaaaaccatagttcagtgtggccagggtgcccacaatgcaccaggagaagatagaaaagagattgtttatgcagcaatgagattggaaaggacctggctgccctctaaggagaagtttctattttatagcagcaggaatctaatagagacgttacacgaaggaatgacaagataatcgctctattttagaagattaactctggtagcaggagctgggatggctgggggtgtgaactgaaactgacgctgcataagaagagaatttacaagcccagtcaaagaatgaggaagaggacccaggtcagggaagaagcaagacaggcgatgagaataaaggctgcttcagaggtgaacactgtagaattgggggcaccaggtggctggaggcaggtgagaagaaaaggaagatgtaaagagaaaaatgaaggatgatgcctagtttctgatcctgagctctgtctggctttttttgcggggaagagatggagattaatgaattgtctttgggcatgtttagtttcaggtacttggaaatacaggcttgcagtttagaaaacaacttacagctgtagataaacatttacgaattatcaacatttgaggtagtggcaagtaaatgatgtttttatagaattatcatgtagttaagaagaaaacagttttaaatattggaccatgggccagcatttaagagaaagttaaggaaaaaaaaaagatttaagaaaaagacacacagaaagtcatgccactgagattttactatgagtcccaggcaaaggttttaagatgagtgtatcaatgtcccctaggcataaaaaggattaaaaagagaagagttcagatgacaatttggaaggcactggtaaactttgagcagtttaattagattggtggagagttggagacgagacagagtccttgaactgataaacaaaaaaaatctgagagtatttggtagtgaaagtaaaggaagggtcaaaagaaaggttttgttgttgttgttgttgttgttatggtttcttcgatagaaaggggaaagataatggttaattggggtaacccagcagtagagattggcagggcaggtaaaccggcaggataaaggaaggagagtatggattagattttaataaaagtttcttagggaagaggggaagaaggaaaaaaaatgagttgagaaaatatatattaaattctttacattgtgcttctgagacagagctatatttagcacccataataaatatatctgataagaatcctagtatgttgctgactctcagcactctgcttattattatgaaaataaaaatgacttccatgtcattctgtcagactatcttttggaaaaaacaacgacaacaaaaataaaaatgtcattcaatccgaaagcaagagaaaagacaccttagtaaaagtaactttcttcttccacctacaaaaccagaacttgaagacacaaatctcaggtgtactgaaataatttttttgtgcctggatataactgctttatgggatcacagagacttcagtacacactctgggacaaacagattattcacaaatgatgatccaaacatattctaggcattcaattgaataaggcccaggatcacccccagaatttttctctgggcgccaaagaatcctacatgctgaataagaccctaggcaagaccagagctccctgcaccatttgaattaggtagtttccatcttgcacctatgggaaagagttggagccaacccaatctttatgattaggcaggaaaaacaacattttccataagaatgtaatcttctgcatggttggtcaccagttatttgttggacatccatttggtttctgccaagttagctaattgttctgctaaatcatctttaaaagatgacttgccttcttgagttgttaatacttgtgaaattcttttcccaaatgaatgagaattgaaagacatagattcttttaacacacacatacacaaaattcccaaacatatagtgtgttgaaagttagtctgttgcaaagaaacttgagttctaggcccggatccaggggtggagatgactgtaacattccaccaagaacttcactcttggctttcacctcgaaactaaaaatccctagttaagtcagatatatgaagtattgcactctaacatgaggaggaactgaagaaaagggaggatgttttcataaagatttagtgaggaagttagaaggaattatgtgtgaaagaaggaaaaagagtaattgtggtattattacaatacatgcctgggccaggtacagaatatgatgggtccgtgtttcactccatacagccctgttatcatgatgacattatgaagtaatttcctatatactataatctgttttggaaatgctttctaccaggtgtctcttatggaacatacaggaaaaaaaaaaaaagagttgacctattaaattactctcgctgttcaaatatttgaagtactaattcatcactcatgacattcaatttatattttaacatcattataaatttaacagggttgaatctttcaaaataacaaagaaagtgccttttgaaaggaaagaagataggaacgttgaagaggttcttgtgggatcactcttaaaagccatcaaagcatctgaatctctctcttggctgtataataaatattcacagaaaatgaccgccaagtatgtatggagaaatgccttggcatttgctgtatgaatatggatgatgggaatatagtaaaatattagagagattaaatcgaaactcaaagatagttctaaggtgtttactgggtgtcacttgatgaaatgactctatggggatttatcactaatctgtgaagtgaaaaataatcttaatgacgagaggaagcttacctacattatgcctaggacaagaagtttttaattcccctctaacaatgcagtgtttgcaggttttcatccattatcactttgttagagtatctttgctaaaacccaactattttataggctcctctgacacctcacaagaatccaagggaggaaatgaagccaatgaatgtaatctacaggtgaaatttgcagagcaaattcaggaaaaaaaagtaattatgcttcttcgcattttatcattttataacctcaccttttagagaaggtattgagagattatactgattagtccagatttttattttacatatttgttcatggaaaggcttattttaacagaagttatatcaaggtgtcatgcccagtaccatcatcatcatcatcaaaaatttgactgaataaacctaagtacacacacacttctgtatgtatagtcttacatatgaaagtaatatttattcattcaccaaaaagtgtaaagagaggttaaaacaggatgggatgaaacagtgtacaaaggtaaggaaaagcttttccaagcaactgaatttcccttgaagcctgaatgttaagtggaattaggcaaagtgtggtggttgtgggaaaattcaggcagaggatatagctagtgcaaaggctctaaggctgcaaaggatgcaagctatgcaggcatggtgcaaggaggcctttgtgcaggaagcaaagggagataaggctggggtgacccacagcctccttcttcaagggcactggatagactcctgggaagcaaaaagtgactggattaaatttgcatttcaaaaagactcttctgactacagtatgtggcaagataattgggtgaagcaatagtccaggtggaaagctttattacagtcaaaacaaaaaaggatgaagacttggattggggtggtacttagtgaagaggcataaaagaagactgaagtcaaaatgacaggacttggggatgggtgggccacagaaagaaggtgtcaaaatgattgtcacagtaggtaattagtcattgattgatagaaaatggtaatcactgaactaggctttttatcttcattctgttctatttaggttcattctatccaaagtatttagtgcttaccagatgcaaagtacagttaggaattctaatggatagaaatataaaataaatggatacaaggttatataatctctgccttttataggcttatattcaaatacagacaatgctttccatttccagtaaagggaatgagaaattatatacccagatacatatatattgacacacaaataaacagatgtatacacatgtatgtctacatatgtatatatgtatgtacacatatgcatatataagtatatatatatttgcatcatatacacatctaaattaagggtgcattgccaggggactgaggaggataaataatgcagaggtcagaaaaaataactgaaaagttgtgtgggatggtattcttcttataagaaattcaaatgttttcaaaaatgattgtcttatatatctgccttattacagaagaaatgtatgacgttggccctgtttatcagggccagaagaagaaattcagcaatagtatttagcagtattaacaattttaatccatgatatcagtcatgacactacaatcctgacagtaatcttattaatagtaatgataaataatagtaatcattagtatgtagtaatttttaaaagtcacacaagcagaaaaacataaacatagatttgattttaatgttgtttgaacattgccttttagcatttttctttgaattctaagctcataattttatcataaaactgtctttacagcagacaatgactaattagtaattctattaaatatttgccaaatggagggtaccacttctagttttgccagagtgtcttgctggtcagaagtgctttgcctaataaactcaacatgcatgttgatgctaagagtctaactgaacacacaggacaatcgcaaatctgtgaattattaagcctcctttcacctcaatttcctccctcataggatggtctttgcttatctcagttttgtgtgtattccttttgattgcttgttaatgtctcctatttatagtgatattatgtaacagtattatttaatctccaaaatagtatacaattgtcaagtaccattgctgtaattatggtgcagatgttggaatatgcttggaatcactaaaagtgaatttaccataagctaaggaagcttactcttcagggactctgacttgcaagagcctatttaatttcttattacctaaatttgtaagtttaattttgcagtatttttcttttaaaagatcccccaaattttatgagcttcatttccagaaaactcatctggccttgtttttcatattgtattgtcatatttaatttgtttttatgcctttctcacaatattttaggttcatgagatcagagacagtattttatttgtttctctactgcctagcttattatttatttatttatttatttatttatttatttatttatttattgttatgagacagggtctcactgtcacccaggctggagtgcagtggcacatttatggcttactgcagcctcaacctcccagggctcaggtgatcctcccacctcaacctcccagtagctgggactacaggggagcaccactacacctggctaatttttgtatcttttttttttttttttttttttttgtagagacaggatttcctcatgttgcccaggctggtcttgaactcctgggctcaagcaatccactcatctcagcctctgaaagtgtaagaattacaggcatgagccaccatgcccggcctgtctatcacttagttcagtaaatgcttggtgaatgaatgaatcatatacatttagtggttgttttgaagttgactctgctgagtgagattttctttgcattcatgcatcttcattaatgtcaactttgttgcagtttttaaaaaagtaatctttgtttacattatcttaagttacttgatttaaaaaagttaaaagtgactatttgcagaattctaaagtcccattactgtcaacatgcataatattttgccaaaaatgcaatttgtcttgttagtcttctttaatttttccatgttttaaaacttttcttggagtatttcccaaatgggatttactgagaggatatattcagccagctttgtagattctaagagtccttctaaaagttaagtctagccaaggaaaaatgtagtggcacacgattgcgtttctcttacgctgtcatttaatgtgagatctaaattttgcatttctttaatgcccaaggtgtttattttttaaaatctgtactctttttatcaggagttatgttgacaatttacctgggagctgatataccctatataatacatgatctaagacctgaacaatacacaaattaataaaattaaaccattaagatatgtcatcatttctaaattatacaattgggttttttttttaaagcaaaaatattcttcctcttttctccatcccttgttctggtcagttccaaggttttttacaaatgcaaaagaaattcatttgctactcctgaccacagagatgaataatttaaggacaatatcaaattcttgataaatctcataaatgttttaactgtccaagaaatggacatttatttggttaatcttttagctggccataaataatgtaataaaaccccttaaaattaacattaaataacataaagacctaacgatttttagaaaaaaacctttttggactgagccttgaatttcctgagaattcagctacaagtgataactaaaatgtaactcgagaatctggatatggttccagaaaggattgttgtcatgcaattgccatttcatcatctttccttaaagtcccttcaatatttatcattgcaatttttgtcctgtcttttcccctccatcacatcaaaccaaggaaaaacaattattaaatgctcatttatactcacctccctcccttcatattcattcattcctcagccctaaaattcctgtaggaatcctgcttttacgttttatcttaaagccaccatagtatctgtaatctcttttgtagtcatgtatgcttaattttggaagactgtcaactacctcttcaggttcattcaaatgaaaatgtatcacaaaatcgtaggctcttcccctatctcactgaaaaattactctaaaaatgaccagtaagctgttttgttgaagcaaaacatccagaccctaaacaaaagtagcagaattacaacatttccatagaaatggattttgagcttcttttttttaattggggaaaatcttattttttaaaaaagaatcccagaatacatctttgctttcagtccttcaattctaacataatgccatgttagagaatatgtggtagtgtatactaagcccttatgctgtctcacatccttgggacaaaatatctgttttgaaaggacttctctgaattttgctatttcctgcttactgagcagtggccccctcctgggaaaacagagttatttcagccagtgttcagactccatcttgcatacgtctctgtggaatattaatagtgctactgagatatattcatcatcttttctctgcttttgctgtctttatagcccagtgaaatttatatttggtgtttgtaggaaggctatcagaagctacttggacatcaaacttttaaactataaataatgatggcaagactgctaggatatctttccacagttaaacccattcaacagagtttcgttcttatgacagtgcaaattaaactagaataaaattagtgtgattttaggacagttttaaagtgaacatatttccctccctcccttcccatctacatatcaaggagacactccagactgcacttttatttaaattgcggccatcagaaaataccgtgagaaggtagtgtgtaggtaatggttcagttagcattgaccccagaaaatggaaaaccaagagcaagtcacttttaaagtgaagcaatagattttgaatatggattgttccaactcaccacttcccgaccacaacacaagagtatttcactgtaaattaagagtctaagttaaccacagctgtggtataactctgagaatgttttctctacatgtagacaattctggatccttccgtggtgcccgttaccctggtctttaacttttgtcctttgcaggggaggggtcaatgccttcttatttccttgctctttagaattctccaccagagggaggacaagggaaggagtaggtttcacgcgcagttctgagtaaagtttgaatctgagaaaccccacattcacgaattaaggatctccagttctgtgtctttattctacccctccctgcctgcttttccactcggcagaactgagtgactttcagcggctgcagtaattttaattattctgagtcgtgctccgaactatgttttttatcagttcctctgaaaattaagttgtagtaagagacgtagtttaagggcacccccttagaagaggccaggttattttttaaggaaaagctgaagatttctaacaggcacttactaaacacacacacacacacacacacacacacacacacacgcacacggcgcagacccagcaggagagcgcaacctagcatctttaaggttcgcttagcccttcctgtgcacctggaaggaagccttatcttaaactcccttccacctagagtttattttcgcctgcgtgcgacagggcttttgtacttaagtgagttaaggaatgaaccccgaactcttctgggaaagccaccaacgttccccccgcacccctcccagggttcctgaccacggagactctgcttggggcacaggtgtgggagtcgcaaacttttctctgcgccgtccttttccgcgtggaatgggacggagcagccctcccaggcgctgcctggctgcggaggggagcgggcagcgagagcctcgggtctccgcctgggttcccgggtctccggggcgctggcctcggtctccgcgcagcgtccagcgacccctgtcgggggttcccggcagccgcgccgccaccccccgcccggccagcgcgggaggaaaaggggctgcgcccgggagcgccgagcccaggctcctcccggtggcgtgtccgcgcctcggggtgggggtgtggtggggaagagggagggggcgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtttaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttggatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacaccgtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgagctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcatacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgcgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgccttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccagaaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcattccattttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgagatggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttatcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtagacactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctgatcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtatgacaatcttcctttttttttttttttttttgagatggagtctcgttctgtcacccaggctggtatgtagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggaggacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctcttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgttgtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaa
